United States Patent 12,553,090 (MOLECULAR PREDICTORS OF PATIENT RESPONSE TO RADIOTHERAPY TREATMENT) - sequence listing, part 3

SEQ ID NO: 92 - DNA, 40471 bp, Homo Sapiens
ttaccaaaagaaatctttattcttcagcaggtagacaacatctgccagccctggtcctcagggccacactcatatgcactcacccctcagcagcatatcgccccttttctgacatataaatgcaagagacccaggaccctagatctttcttcaaacgcaagtgtctcacacacacttattttacaaatccactagaaatatggactcttatgttctttgtacagccatgcaacagaggcctagcatttgtgctgtgtctgtgggaaaggcagtcagagaccagtggtttccctgctttggggaagatggctcaacagttagtaatcccaggttagattgtcagaacagtctaggccaggactgagggctcagctgccagggctccccaacagaaacctgtaggcaaaaagaaagttggcagcattagtgatgaggctcatcttggtcccatctctccccacgacctagaaactcaccactcccctctggctgacactgcttccttgcgcaccagtctcttcttgtcatccaggggtttggctaaggcccgaatcacctgtggtttgtacggcagcagctgtggagtcagaggatataatcaaccttgctcatccaaggcaactgaaagtaccgcttttttgattctgtacaactaatattctgaggaaagcaaaacatctttagtgattccaagggatgttaagtggcaggatggcctttctgttaccttctgggcccaaggaaaagaatccttgggcccagaattacaagatctgtaccttgtaattcagatctcaattacacaccagggtggccaagcccacctgactaaggcaaaaaggtacttatgtgtctcttgagatgttcccaggccagggaaggacacctgaggtacttaccacaggggtgggcaggcgagtgagagcatgcatgcactgcagtgcggcgatccggacagcctggaacacaaccacaaggaggtgagagcatgcccagggagagatgctggtgcctaagagttgctggggctcaacgcaccatggaagggctagagctgaggttcagaaacttggtgacgagggtgtccacgtgaagactcatgacttggggtgcttccagtagaagaggctgaaggcagctgagggtggagagctgcaccacacagtcagggcaggacagggcctccagcagcaaggaaagaagctaaggggcaatgggcaaggtaggggatggccacatcatgaagatcctggttcttgttccctcccctttctagccccatctggggaagaatagctttgtcctttgcttagaagctctgcctgtgggacttaccgtgggcagctctggcaagagtacaggcttgggcagcctgttaagtacatgagaaagacccttcaagtagtttggcttcacatctgtaaaaaatggaaaggcttaggggagaaattggacttagatatatagcttgagaaatcaattccaatctgtggtgaggctgagacatcagcctacaaacgggtgaaagagcccttcacgctcagaataagcaagatacgcccatgaaaggaagaagtgggacaagaatctagaagtttagtcttctaggcacagaccacaatatagctctaaagaagcaagcgggccctaaattatcttagggaatgtggccaagcaaaggagagatgtgtatatgtggggaccttctttcagactcctcaccttggggagcagcatggaagccctggaccaaagcaggcacattatctgtgaagaaccgctggcggaacatgatccgcacttcggcatggccagcacgagtcagcacatcagtgcagtcagacatgagcagagagaagccatcagctgctgctggacctaattctgggtcactcaggaggcccatgagctggagaaaaaagagcctttgaggtacatcagggaagaagaatcttaagtgccaaagataaggatggggccgggtgtggtggctcatgcctgtaatcctagcactttgggaggccaaggcaggtggactgcttgagtctaggagtctgggcaacatggccaaacccagttcttacaaaaaatacaaacattagttgggtgtggtggggtgcccctgtagtcccagctacttgcgaggctgaagtgggaggatcacttgagcctacggaggttgaggctggagtgagctgtgattgcactactgtactccagcctgggtgacagagtaagaccctgtctccaaaaagaaaaaagaaaagaaaacaaaaaacacacaggggaggatggaagtccttgggaggaataggagcaaccagaaagtttgtttaggtcctgggttcttctgtctccagaaaggacgtacccgggctgtaaggcaggagctgagaggatggtatctgagcactagggcctttgttacctgtaattggagacagagagagcaattggggaatgacactcaaacccgagaaccctgagacatagatgtttatggtttagggtcaaacagggacattttatttaaccagacataattgcctctctggctaaccagactccactccaactccttacccagagaagaagagtgaaggcctgactacgacagggcccagagcccaggccagcctccactttgtccacagctagctgtaggaattcatccagctgctgccctaaaaaggagagaggaaatgctgacataaaggctacacattttccctttagcaatgaaatgcaaatcactttaagtgcagagctccctgagaagctgttagaaagggaaaatatcatttttgcctgtggacaaaatgattggacacctgcataagagcctggtattctcataatacagaggtgctgccatttgaaaagagagggtcatctacttccaataaagaattatccacactagccccactgtagggagtaggacggcagaactagactctttgtgctcccttctcttcttaggtactataaagctctgcccaactgtggtcttgacgcttttcccacgggcagtcccaggacagtgcttgagcagttgaagccctgttaatgttattagcaagctccttttaaaaagagaatgagtactgagctataagatttcatgggtagttgattctgggaggctccttacatagtctgatctcagtacctgcagggtgcttgttgaggagtcctgcaaagcacttggcagcagcggtggaagaaaaggggcagctgtggcagcagctcagttccaaaagctcccgcatgagttggttcagctgagggatttccacctacagaaaacctggccatgtaatggacccagagaacacttgaactccaagagaaccagtacatagtggcagcagggaccgggacggatgagaactaacttctctggtgggggaagtaaaagatcagcttagcctgtggcaaatttcagcccggagtcaccttgtcaaggttaaataacagtacttcccaaatgtgctcacttacatttcgaggcagggagcagacaaaggccataagcagtgcaatcagccgcctctgccctgaggagccatcctataaaggaaggagagcccgatcaagcctgccagcaataagcttgtctgcccctctacccattccagattagccctaaaaaaaaaccagcttgaaggatgtaagttctaagactgttacctggaatggctggaatctgctcgggaagctgttttcaggcagaaaggacacgttgccatccaagaagaggggcacaatgtgtgtcacactctgggcagctaacctgggggcagagtactaggtatgaccaaggagctaggattctaaagcagccctctcctccacagacgtgcttttcaacctagggtttgaattaggatcaccacgtcaatgggacatgccctgatcattcatgcattgaacaaatattaatttggcacatatgtgccagtaatcatttccattcaggttcccatctgggaagtcaaggtatattttaaaatgctctacaggtaattcttaagcacatctgcggctaagaaccactggccctggcttcccaccctcatagtccatggtgctaagagccccttccttttgttttgtcaacaaaacttacaagacgattaactgcaccacatttacatataggtaaaaggacagctgacaaggcagctacctgttgcttcttcctaagaatgctatccttctccctgggttcaagccacatccatgattatacttactcagggctcaggtgggttgtagcagtgccaatgacagacaccatggcagccaacacctcatcctccaatagtacttttctcagaactgagggctccttctctgcaaaacacacacacatgcacacaatcacaagaccatgacgggttcaagaaatgaatgattgggttctgtcagcatcactgactctggggcttgactctagccacgacagcagttcttaatctggtctctggtagtgctatagtcctgagaatcagggcaccagaaacaggagtggtctgacctggggccacagagcgctcctgagaactctgcacagtctttagactaggccaacagtgggaaagagggatagctaagatgaacattcttaacataagaaatagaaatgttgtccctggtgtccctggagatgcaaggaaaaaaaaatagtaatgttggtctctgaaaaaattaaaaacatagatttatcttcatgggtccttattatttatagcaactatcatacactgagtacttcctatgtggcaggtactatacactaacttatttaatccttaccaactaccctgtgaaacagttttttttttttttttttttgagacaggaacaggatctcgctctgtcacccaggctcgagtgcagaggcacaatcatgcctcactgcagccttgaactcctgggctcaggtgatcctcccacctcagcctcttgagcagctgggactataggtgtgcaccactatgtctgactatttgtagaaacagggtcccctgtgttgcccaggctggtctcaaactcctggactcaagtgatcctcccatcttggcctcctgaagtgctgggattacaggtgtgaaccatggcgccagcctagacggtactctttatctccatcttacaagtgaggaaattgaagcgtggaaaggctgaatatcttcacctaagttagcaagtggtagagttgaggataaaacccaaccaggtgggcttgactccagagtccaattctaagtaaactaatcacatagcacttcatggggaaaaggtgtgcattcttttgaatgttgctaacactagtggattttggttcctgccactggtcagggtggcaccctttgctatgaagtgaaatctcactctgaggacaaaggattgaaaataaacctctgatggtacaaaatacagtaccaccaatacccagagggtggtgctgttcaacaccagcagagggcaaagttcccaaaggccaggaaggagaggtggaaagttacctggcatagaggcctgcacagccaaggcaagcaggcaaggtatagctgtctggtggaaataccagcaactctcagggtcctgctgacatttttctgccatctgtctgaggctctgacagacagcaataacgtcactggattgtgcaaccatattccctgttgatgagaaagtgttctctgtaaggtttgcttaaaagcactttcaggtgtttccaattacacagcagatgagaggaacaaagaagagtgactgaagggaccaagagtgccttattaaaaagctgagtcactttattctcctggctgttctttctgatctattcagacttcatagttgagacttgctctgtcccaggctctgcagcagaagcacttgtatatattctctccttatttttcataacaaccttagaagtatcatttccctcactctatagagaaggacatggaggcacaatgaaatacatgatcagtggcttttccagggtcacaggaagtgcaaagtcaggaatcaagcccaagttataatccaagtctagtattcattctactatgtaacagctgctggatcaaccacagtgggcctgaatctacccacagggcaggctgctgtcacttttgcattggagcagtgcttctcaaactcaacagtctacgagttaccagggtacactgtcaaaatgcagattctgatcagtgagggcctgagattctgcacttctaacaagctcccagatgtcacccatgctgctggttaacagaccatcttttgagcaccacggccttagggtgatgcctctcaattcagatcccacatgaaaattacctaggtaatttttttttttttttttggagacagggcttcactcctgttgcccaggtcaggctggagtgcaatggagcgatctcggcttgctccaacctctgcctcccgggctcaaagtgattctcctgccttagcctcccaagtagctgggactacaggtgcatgccactgctcctggctaatttttgtattttttgtagagatgcggtttcgccatgttgcatcggctggttaggtctcaaactcttgagctcaagtgatccatcagccttggcctcccaaagtgctgggattacaggcatgagccaccacacccagcccggcacttttttttttcttttttgagatggagtttcaccctgtttgcccaggtgtgagtgcaatggcatgatcttggctcactgcaacctccgcctcccaggttcaaacgattatcctgcctcagcctcctgagtagctgggattacaggcgcctgccaccatgaccagataatttttagtagagacgggattgcaccatgttggtcaggctggtctcaaactcctgaccttgtgatccacccgcctcagcctcccaaagtgctgggattataggcatgtgccactgcgcccaaccctttttttcttttgagatagagtttcactctattgcccaggctggccaggctggagtacagtggcgcaatctcagctcgctgcaacctccgccttgtgggttcaagagattctcctgcctcagcctccccagtagctgggattacaggcgcatgccaccatgcccagctaattttttgtatttttagtagagactgggtttctccatgttggctaagttggtctcaaattcctgacctcaagtgatctgctggcctcggcctcccaaagtgctgagattacaggcaagagcagcggccctggccgggtactcttaatagtactgttgcctaagtcccatccctcctcagagactgattcagttggacgcaggcatcagtattttttttttcttttaaaagagttgattctgttactcttatgtatagctacagctagaaccactgccttagagactacagctccctattcagcccagtccgttggtggttattcctagtagttacctctgttcacttgccagagatgctgcagcagcagaggcagtgtctccttgacgatgctgggatgtgttgatacagctgacaaggcttgcagacagcacagatgccgggagcattgggtgggctcatctccgttagtcaaatttgactcccctgaaagcaacccatgagacaaaggtttactgtgtgataggaagcacgaaggccccaaagccttgctggaaagggatgggccacagaggattagagacacatacctacacgcagctcctcagcgagcttgggtacgaggtggctgctgaaggccacagggtagagagcagccagggttcctgatgcttccagtgctgccaccctgctggaggcgcagagcagataagcattggctgagcctgggctcacagctctcttgcctacgtctgatattaggcagattcaggagtgtgagctcccaacgcctccttgctaaagagcagaactcaagtacctacaccactgagttggacagggcttcttaaagcctaagaagagagcagtcctacatctctccaactggttagcagccagagtctaacacagagctcacctcccctaaggagagccaagggtcagaagcacagagccctggtcctagcttgatcttttgctgccaatacagaggcagggaacagcttgctctatctcattgctttaaattctcaccaactctgggaatcctccttcaggaagctcagtctgtacaggtgacccactgccagctccaagtcctcataagataggagatctgtagttagaagggaacatgaatctcatctttcttcccctgcagccatcacaacccttctaagctcttattagaaatcccaaatcatccagagttgcagtaagaagaggatagtaaggctgcttttcaccaaggcagtcttacaagaaaaggaccaatattttcctcttctctttcccttaagatgtacctggctgggcacccaagactgtcagtgtacggatgccaacaagctgaagctgggtgctggggtctgttagagccatgaataccagtgagcacagctggtccttgaagccattcagaggcctttgatctagggaagagacagaggccaggttagaaggaagccactgcattccatatccctgactaagctgtgatacacagccaacctggggtagattttttttttgagacaaggcctctgttgcccaggctggagtgcagtggcgtaatctcggatcactgcagcctctgcctcccaggttcaagccattctcctgcctcagcctcccgagtagctggaattacaggcatgtgccaacaggcctggctaatttttgtatttttagtagagacagggtttcaccatattggccaggctggtctcgaactcctaacctcaagttttccgcctgccttagcctaccaaagtgctgggattataggtgtgagccaccatgccccgcctcctggggcagatttaaagagcttaatccattgggtatccagaaagcacactgagaaaaataaacagatctcatccatctcatctgttaagtgttctcttgtgctacaacctcagaataggaccactgttctagactacttttccacagcactctttgccctgctatcctttataggctgaagtgttcaacagtccccagagcactgcaatggaaggcaacctcacctttgtcttcatagctccatttctgctgcagcttcaagaaacccaggagcatttcaaggattgtccgccgctggctgctctgtaacgtttcaaggggtactagagtcaaagaatattttaaaggatttcaatcctgctactctggatatagggaaaattctttctttcttccaagagatgggggttttgctatgccacagccaggctggaatacagtagcatgattatagctccctgcagccccgacctcctaggttcaagtgattctctcgcctcagcctcttgagtagctgggactacagatgcgtgccaccttatccagctaattttttttttttttttttgtagagatgtggtcttgtcttgttgcccaagctggtctttaaatcctagcctcaagtgattgtcctgccttggtctcctaaagtgctgggattacaggcatgaaccagcatgtcctgcttggctaatttaaaaaaaatttttttttttttagagatgggatctcactttgttgcccaggctgatcttgaactcctggcttcaagctatcctcctgtcttgggagaatgatccttttatgtatgagacagggaaaaagtgagtaagggaagcagcagcagcagctaatgggagcaaaacccaaggtctactatgttggcccaagctaaaacttagctcactctctgagaaagggaacctagcacacaggtcccatcatttcccccaaagattctgctcccttacctgactgtgcttgtggaactgttccagcagtaaaggcagtacattgctggtgacagagtcacaggcccgggcagatgcacctgcagctgcctgcaacagcttggcactaggccacaccagtttcatgtccggttcacacaggtggtgcctgcagtctagagaagcagcacatcacagagctggggaggaggccaaatggtgcctgactcccctacagtccacagaggttggagactgagacccatgacagtttgcaagcagttaacactcaaattgttttcaattcaaagtagggctatcgcccccaaatcaccaaatatgttgggactaaacaataaaggtcactggcccttaaggaatgtcatttgttttttttttagagatggagttttgctctcgttgcccaagctggagtgcagtggcgcaatctcagctcaccgcaacctctgccttttcaagcgattctcctgcctcagcctcccgagtagctgggattacaggcgtccaccaccacgcccggctaatttttgtatttttagtagagacgaggtttcaccatgttggccaggctggtctttaactcctgacctcaggtgatccacccgcctcggcctcctaaagtgcagggattacaggcgtgagccaccgcacccaggcaaggaatgtcgtttctattgtgctcactccccttcctggctgccacggccccattaccctgtagaatgttgctaaggaaggagtcaaggaggtcctcagcatcagccctcagcacagagcgagacaaacacgcagtcagggagtggagggccgccaggccctctgcctccacccgctcacttgccgtctggaacacctgtcagggagggatcccatggctactgaggtgagcctgcaccagatgagaccccaccaatccactgcctatttccttgttggagaggggagtgagaacctctaggacacagaaatggaaattaacaccccaactgagtgtcttctcaattggtgtgttcttaccaagtccttagtcacactcaggacagagacacatactttctgagaaacaaaaagccaactctgagcagtggctctgctcacctttctattcaccatggtgccaaaggcaccatgacctgcactccttgccacagaaggacaagaagtgggtaatgtgcaaaggtgatcagctgctcttaccaagcagctgaccgtcacatagggactctctctcttgtcattcaactagaattatgtccccctacttgcctcctgaataaccaggcattatatcttggccctggggatgacagagggaaaaggacaggatgtattatttcccctcatgcctgacaattgaaagttaacagtagtgagtttatctgagtgacactcacctctctgcggatagaagcccaaaggctggggaggaagtccttcagttccttctgtccatacacagcacagcaagcattctgccaaggaaaccgctgctatcagttatgtacacactcagacaccctaggatgtgcaggtacctcagcataatggcacctgaaggagccctggtctcagcagaaaaaccagttaagatttttaacagtcctactaagggaacagagaagtaggagataaccctggttgataaaatagaagcctaaagagggagtcctggtcagcctttcctcagttactatgggatgggggatgggacacgacgatatgcagctgggggcttcaggtcgacacaaaggcccaaatcctgggtatcctcttctgaggcccatgaactgttccttggctatcctagaatctatatcctttaggacccctaacttgtcaaaaggtagctgggtcctgcaaggagaaaaatcactcaccagagtctgtagagaatccaacttggcactcagaacctcagaatccactttctcaatcaacaggggcagcagaaactgtgggacagaaggaagatcttaagcctgagatgggtggtgtgtcagtcacatcaaggtcaaccctgtccttgccatcagtccctaaaagcaggtactacatcaaggagctgtactcaagtcaggagctatgaatgtaagctaaccttcctgccaagcagtgaccagagccccactacctcaaaaacaggcaagttgacaaagttacaggattttaaaagacagcaccatatagggattgggtttatttatttttttgtgtagcggagacgaggtctccctatgttgcccaggctggatttgaactcctgggtttaagtgatcctttccactcagactcctcctgagtagctggaactataggtgtgtgccactgaatccagctctggattatgaagagatggtaaagttttctacatcgaaggtctgaagatacctgccacacaagacacttgcagggtgtcatgccctaaaatgtataccagatatttttttctccatgcttttactgctctttcttcagagccatctatgggcagaggctatataccctaaccttggctagacccacctcagcaaatcgtggtgtagaagccagcacagcgcgaagactcaggatgaggtcttctctctggataccatggggatcattaggtggctggaaaagggagaagggctgtgggtttgtgtaacatttcagaccaccttgaacacaggctcgaacctggtaaccctgcagaacagggtgatactcatacccaatcagggaagatagtaagataatgaggccccagcaagaagacttgcttgatcttaggtactccttgggaacttttgtctttaggcattttaaaaaatctgattacacattttctatcatttcaccactcagaaataagcatgcttaactttctggtgtattcctttcttcgctgatatatattgttactatgtgctagtatatactgtttccatataaaatatatatatacttaaaaatcattttgtacatgtggtttttaatttttttcacttaacatattaagaacatttttatggtattattctttcatagcattagttttagtggctatgatttcattttgtggttgtaccagtttatctagataattccttgttgatggacatttccatttttttcacccttataaaaagctgtaattctgaaaacagaaagccttgatggtttctgtaccaagacgacagactgaaaacatatatcaggttttccttttcctctttgcaaactccaccaaaaacatagtaaaagaagggatttactattattattattatttttttttgagacagagtctcactctgtcacccatgctggattgcagtggcttgatcctagctcagtgcaacctccacctcctaggttcaagtgattctcatgtctcaacctcccaagtagctggggttacaggcgcaccaacacacctggctaatttttatatattttttgtagacatggggtttcatcatgttggccaggctggtctggaactcctgacctcgaatgatccacccacctcagcctcccgaagtgctgggattacaggcgtaagccaccgaacctggcctggtttctgttttcatgactggactttgatagaaaagataaaactgtggaattctcttataaagtaacaaaaagacagaggtacaaaatagaaaacaaaaggtcagaaaatcagaggtccaacagaagattaatgagagttccaaaatgaaggaacagagaaaagagagaggaagaaatcatcaattaaagaattcaagaaaaatttacaggactaatggacacgggttaccagattgacagggcctactaagtacccaacacagtacatgaaatagaccaatactaaggcacatcactgtgaagtttcaatgtatcggggtgaaccaaacatcagtttatagagaggaagaaaaaaatggtaaatacaaaagtttatgaaacagaagaaattcagacttctccacagcaaatgaaaactagataactaggcttatttatttatttgagatggagttttgctcttgttacacaagctggagtgcaatggcacgatcttggctcactgcagcctctgcctccaggattcaagcgattctcctgcctgtctcccgagtggctgggattacaggctcacgccaccatgcccggctaatttttttgtatttttagtagaaatggggtttcaccatgttagccaggctggtcttgaactcctgacctcaggtgatccgcctgccttggcctttcgaagtgttgagattacaggcatgagccaccacgcccagccaataactagatttaaatgtagcaatgccttcaaaatcttaggagaaaataatttccattttttttttgtttttgtttttggttttttggtgactgagtctggctctgtcttccaggctggagtgcagaggcatgatcttggctcaatgcaacctctgcctccccagcccaagccatcctcccacctccacctcccgagtagcaggggctacagactcgaccaccacgcccagttaatttttgtatttcttatagacaaggttttgccatggtgcccgggctggtcttgaactcctgagctcaagcaatccacctgcctcagcctcccaaagtagcgggattacaagcgtcagttactgcacctggcctctttctcaggtgcaatcatagtgcactacagcctcaaactcctggcctcaagtgattgttctgcctcagcctcacaagtagctgggactgcagacatgtgcaactgcatccagctagaattctctttttatttatttttttttttgagatggagttttactcttgttgcctaagctggagtgcaatggcgtgatctcggctcactgtaacctccgcctcccaggttcaagcaattctcctgcctcagcctcccaagtagctgagattacaggcgcctgctaccacgcctagctaatttttgtatttctagtagagacgggattccaccatgttggtcaggctagtctcgaactcctgacctcaagtgatccacccgcctcggcctcttaaagtgcttagattacaggtgtgagccactgcgcccggcctagaatttctattcttgaattacatgcccataatgtcaaaaatgagagacaagattgaaggcatttaagggttacaaatctaaaaaattctcacttcttcatacattctctcaggaaaatactaaaggaagtacaccatcaaactgagggggtaaaccacaaaatgaggaatatgtgaactcaggaaacaggagatctgatccaagaaaaaggataagggaatctaggatgacggtgaaggaagaaccaatatctactctgcattaggagtaaaaatcaacctgttgacattgtttggctaagaatggttttaacatttttaatgtttgaaacaaaccaaaagaatatcttgtgacaagtgaaaattatatgaaattcaaagtttagtgttgataacaaaagttctattgggatatagctactgtagctgttcctgtgtctaaggctgtttttgtgcagtaacagcagagttgaggagaccatatgacccacaaagctactgtctggccttttatagaaaaagttggccaggcatggtggcttatgcctgtaatcccaacactttgggaagtcgaggcaggtggatggcttgagcccaggaattcaagaccagcctgggcaacatggcaaaatcctgtctctatagaaaaatacaacaattagtcgggagtagtgtcatgtgcctatggttccagctactcgggaggcaggggtgggaggatcaccagagtaccagagtccagagaggtggaggctgcagtgagctgtgatggtgccactacactccagcctgcctcaaaaaaaaaaaaaaaaaagggaaagaaaaagtttgccaacctcttcttagagtgagcatataagcatagtgaagaaactgaaccttaagctcatcagatccactatgatggcacacaatactgatttgtggctggatatgtggctcacacgtgtaatcccagcactttgggaggccgaggcaggtagatcagttgaggtgaggagttcgagaccaacctggacaacatggcaaaaccccatctctactaaaaaatataaaaaaaaaattagtcaggcatggtggcacgtactgtaatcccagctattcaggtggctgaggcacaacaatcactcgaaccccggaggcaggggttgcagtgagcaaggattgtgttactgcactccagcctgggcaacagagtgagaccctgtctgaaaaacaaaacaaaacagaacagaaccaacaacaataaaaaccctgatttgtaagacaataaagagtatttgtaactcaaatagttacactaaagccaagtgtctctgttttaattaatatcttgataagagctttctgcttctgatagactgcagtgcagaacaacatacaaaaatctgcttgaatgagagaaatcttcctaatattatctgtaagtttattttgcctagattatctctgtgaaaataaacagctgtgaacagtgattgtttctaatgggaaaatggacagtagcagtaaaggggtatgaaagaagtttaattatctaccctttaaatgctgaatcatgctcattgtataacctttcaaaaaaatggatgaaatactgttcctctcccccaaattataaatgcacatattctttgacctagcgatttcttttaggaatttattctatcattatattcatatgtatgaaagttgtagcactgctcataacagcaaaagattagcaacaatccacagaggactagtgaaattattcattatttccggccaaaggaatattatgcagccataaagaatgaaagagctaacttatatactgacgtggaacactctccaagacatagtgttcagtgaaaaaagcaaagtacaggagaagtgtgtgtgtgtgtgtgtgtacatgcccgcatgtgcacacattgattttaggggggtggtggtaaaagcatttgcttacatatagatgaaaaagctctgtaaagatacaaacataactgataacttggttgattatggagaaaaaaagatggtagggagatttctcacccttttggactttgaatcatgtgaatgaattatcttttcaaaaccaacacaaaacacaaaataaaacaaagtaaaggctgggcatggtggcccacgcctgtaatcccagcactttgggaggccgaggcagttggatcacgaagtcaggggttcaatatcagcctggtcaagatggtgaaaccccatttctactaaaaatacaaaaaaaattagccgggcatggtggcgggcgcctgtaatcccagctacttgggaggccgaggcagagaattgcttgaacccaggaggcagaggttgcagtgagttgagatcgcaccactgcactccagcctgggagacagagcgagactccatctcaaaaaagcaaaaaccaaaccaaaacaaacaaaaaagaaacacacacaccaaaaaaaccaaagtaaaaacagaagaatgtgggagctaaaccaggatctttcaagatttcaagggtatagggttagaataagaattctgattatgaaagagataaaaagattcatttcaggagacaggtggtccccagtaacataatgtcaactgaaataagctggtaagaaattccctacagcaaagatggtggtgtcattataaaggcagtgagagtcaatatgctgtttggcatgctgcaatagaatgccttttatttctttcaaaccactaatgcttgcagcacacacacccacacggtgatgaaactcttgagtatttggcagtagaagggaactcaactgcagaatgggaggaaggcccaagagggtcagagcaaataccttctgtacactgtgcacaattgtgccttctttgttttgtcactttgtttctatagcctgagatgccctgtccaactccagaatcatatcttctgcatccctcacaaaccagctgaaatcctatcttaactgtgaagtcagttcctgcctactctagctcacactgaacttttgtcttctctgaacagctatagtactactcattttcctacctaatctcctattgttacttaaatgtttcagccttcaagggcagggacagtgttttgcaatcctgtagccttcagcactaaatacagtgttaaggagcttaagaattccccccaatacatgctgctttgaatcattcctcatatgtcaaatgcttttccatttcctagtttattaaaatataaaataatgagggcggggatgtctattttggtgacctgtaccctcagtgcccagaacagggcttggcacatagcagacactcaataaatatatgatcaaacaatgaaggtgctacttacaggggtaaaatcgatagggaaataacaggatgtcacttcaaacaactcctccacaaagggtcctgtggcaacagagaaaaaatgaggttggtttatcagcttcactcatctgataaagctccaatgagctaatcatggctaccacgatatacccaggctatagtccctggagatgaggtcatggacgatgcggaaggccaccagaagattacggggatccttttccccatccatcacctggatgaagccaaaggtgaagtcagctcctaggctctttagctctgggaaggagagaataaggttactatactgtcccacagcacagaaagtgtgggctttctcctagcctgtgttctccctctgctatcattgcctcccctttctcttcagggctgaccctttttccattccaagaaagtactcagtgaagagatgtgcaacaatatacacattgctgtggaggcaagaatttaaaacactggctcaaacaaactctaccctttctttacttcactgggagggagcagaccccctctttccctttatcattctctctcaggataccagctcttctatataaccccaggtaaaatgagtcctactaataggggaaaaagtaggatgtgcttgcttttgacatttcccagaaagctctgtctcttaccttcttcccgggttcgcataaaattggtgatgatattgtagactgtgtgtcggtccacctgtggcagggacttgggggtgggggagaaagaagtgaagaaaatgctcaaagaatacctcagctgacacagctagttcctgcttcataatctctaagtgaacagtgctctttataccagcataagatcaatctaagagaaactacagagaaagggtatggatattgactcagcagcacagcagtggtgccaataattcaaacctgcctgacagagggatgccttactttctgtaggtataagaggacacaggtcagatctaatggcatgcacccctttccttgtccaataacaaagatgagcatataaacatactgaagaagagcataaaaacattcacaagatccaaaagaattcagaacttagaaggcaataatttttgctattgaatcccagttatgtcaaggggtagagacagaggagaataccaacatgactgttatccctcacctgtacatgcacttcctggaagatggctttaagcacagaaacagccagccctgggggcagggccacacacaggctctgggggagaggagaaggtacgtgaataccgaaggaattgcagcatggcctccaagacacaaccctacgacaggcctaattagctactgtaagaatcacagcatcctggttgaggaagaagcactaatagtgagactctttctcaagctgatgagttctctgcagctctttccagatggctctggtttccagtcccccaaagtacacttttactctctagagggaaaacggaagtagagctggtaacactaatttagtcccacacttgggcacctgctcctcagcatgtgaaccatcacacccaaagcgcaaggagagaactagacaagggctcccttgaacaaagttatgtaatgaaatgaaggaaaactcacaagtgccttcaaaccctgcaggacagatgggatcacaagatgatggtccttcagccggttctcatagaacagtatcaggtgtaccactgcacaaaccagattcagccattagttgacataggcacgagaagggcccaagagctttgttccttccctaagtctataacagttgtttctgtttgggttccactacaaattttctctttcaccaagagacatgtcctgtgccttcccatttgaaggtagacacctgatcagtcgggaaaataggggaacatttcttaatatccattctcatacaggtccacagtaaaacccattctcagcccaaaactgcctttctacagaactagagttcacaaattttttcctaaagggtcagacagtaaatataggcttacagggtatggtctctatcccaactactcaactctgctgttttaacaaaaaagtagcatagacaacagggaaataaatgagtgtagctatgttccaataaaagtttataaaaacaggtgtatgatgtgttttttttaatgtgtgacataaattattttttctgtgtatctatttttaaatttatatagatgatattatactaaacacaaatacccacacacatatacccccaaacaggctgtaggttgggcatgtggtgcttgcctatagggaggctgaggtgggacgatcatttaagcccagaggtttaaggccaccctgagcaacacagtgagaccctgtctccaaaaaacaaataaaaggggttccctctcttggctttggagccctccctccctctgcctctatacagggaagattcttccttctcccttccttcttgccccttcttgcctattaaactctccgctacttaaaaccacttcatgtgtgtcggtgtcgttttatctaaaccagcatgaggaccaagaaccctggtgttcctccactcattggagccgtatcattttggtgtgttggctgggaaaggaaattcgttcatcagactgaagcaatcaaactccaaatggtactgtaaactgaacctcacattgacacgccattcttgtgaggacccttagatcaaccccaggaggagcccttgctgctgttccccattcgacgccccttttcagtaggaagtagccaggagtcatcaccccaaaccccgtaacagcagttagtgtggcatctctacaggggggaatgttgtaggagttattaagaaattattacgtgctgcatttgccccttgagccaggtggatgtttactgtgtgttatataacttcctggctccttcactgaacatgcctagtccaacattttttcccaatcagtcacatcctgggatccagtgtataaatctaatatcatatgtcttgtgcataattcttccaaaggatcttattttgtgaactatatcagtagtgtacattaccatataatgtaaaaacatctacatataaacaatgcaaccaactatccaagtgttataccaactaaaacccccaataaaccttgaacagttaagaaaaaaaaaaaagaaagaaattattttaggcaaatagagaggaaaaggggtccttgggaagtttttgtttttaaaagcatctccagaaaagtttcctgtaaagccctggctcttagtgccaggccgcaacctttgatatgcaaatgaaatccattagaaactgggtccacccaaatatggcgattcccatggcgttcctgccctttccccaccttcctggcaacatggctgcccccatgtatccccacatgtgtagaatatcatggtgccctgcatttgcatattaaaaggctcgggtaggagggccagcttttttgccggctatgtgaatgacatgcctagtcaaaccaatcccccgagccctatgcaaatcagacaccgcctcctccagcttctggatatattacctagctggtatctgtggcaggcggagttccctctcttggctttggagccccgctctgtctctgtacaggggagcttcttcctcctcccttccttcttgcctattaaactctctgctccttaaaaccaaaaaaacaaaaaaaacaaaacaaaaaaaccaggctatagtttgcctacccctgctatacaagataaataagttgttgtcctttttccccctcaggacctcaaagcatgccgatatttcattacttttcatctttacctatgaaatactgctctgttcattttacggagtgggaaaaatacactgaaaaaacagtctaaggctacatttgaaatccatgtgtctttcttttttgagatggagtcccgctctgtcatccaggctggagttcagtggcgtgatctcggctcactgcaacttccatctcctgggttcaagcgattcctgcctcagccacccaagtagctgcaggcgcccaacaccatgcccagctaacgttttatattgaaatccatgtgtcttgtgtctcaattctaatcatctctgccacatataccagtgaggaatgaagaccttgaattagtagttcatagatactttaagccctccctccctgcctgtaaagttggcttgaatagacatgggagacctgggctcagcaatccaggaagacattcctattagtgacaccagtaccttccttctccaggagcaaggtgtgacagtggagtagcacctgtgacaaaagctggattgctcgtgcccgagttcggggttctggattctctagagaggacctaggggaaaacaggatagagagaacctgcaattacccagttcaaatgtttgaagaaataaacattttacattagtcacactcaccccctgggcatggaagcagagccaagccctgttaagagtaaaaacagcccaggaaggtgttcctgaggtaacggcattacagataccagtaaggacagaaggcttaagagcgatcctcagactgaagtggcatcatttagaggcacacgtgacaccaagagccaacagaggtttctgcctccaggtaccccagtttggcacctaataagcactgtgcttactctttctccccagtggtatgattgtgacattcctctgaaatacagcttagcagctacccacagggtttgagagatgattggcagctgcagcttccaccaaaacaaggagaatacgtgtatttctgtaaattaatgctaaggaaaaaaaattgctcagaatcaccaccaagttcctagagtaaaagaaaacatgaaaaaccaaaactttataactggaaggttacaaagtaagagggccagaatatagctttaactagttaactaggtaggattattgatataggagaagctggactgaagcaacaaggaagtgacttatcctcaaaattgctctacggagattatactgaaacatactagaaataatctaagcagcaacaagcagaaagtggaagagttctggccatgacagttgtattgaacctcaagggtaagagtgtatataactcagagtaaggggaaaaaaataaggtcactcttaacaggatccccaggataaaaacctgtagaaaggtttctactcaggaagtagaaaactgtgcattcaggttgggtgtggtggctcacacctgtaatcccagaattttgggagacagacgagaggatcacttgagcccggcagtcgtgaccagcctgggcaacatagtgggaccctgtctctacaaaaaatacaaaaacttagctgggcatggtggcacaagcctgtagtcccagctacttgggaggctgaggtgggtggatggcttgggcccaggagatcgaggctgcagtgggccatgatcgctccactgcactctagctcgattaacagagtgagaccctgtctcaaagaaaaagaaaaaaagaaaattatgcatttggagcatttaaaaatggaacaaggcacacaaatgctcatagcagcattattaggaatagccaaaaagtggaaacaatccagatgtccgtccactgataaatgattaaataatatgcatatccataaaacgggaatattattcagcaagaaaagaaatgcagaactgatgtgtgctgcaacatggatgaaccccaaaaacatgctaagtgaaagaagctggcaacaaaggtcacgtgtgtgattccatttatatgacatttccagagtaggcaaagccatagaagacagaaagtagattagtgattgctgggggttgggaagaagagggaaggggaaatgactgctaatgggcatgggtttctttctggagtaatgaaaatgtcctcaaaatgactgtgctgagaattgcacaaatctgtaaatatacttttacaagccacagaattgtacattttaaaatggtgaactttatgatatgtgaatcatacatcaataaggctgtgtgtgtgtgtgtgtgtgtgtatatatatacacacacacacacacacacacacacacacatatattttttgagatggactctcactctgtcacccaggctggagtgcagtggcgtaatctcagctcactgcaagctccgcctcgcgggttcaccccatcctcctacctcagcctcccaagtagctggaactacaggcgcccgccaccatgcccggctaattttttgtatttttagtagagatggggtttcaccgtgctagccaggatggtctcgatctcctgacctcatgatccgcccacctcggcctcccaaactgctgggattacaggcatgagccaccgcacctggcctatatatattttttgatgggggtctcactctgtcacctgggttggaatgcagtggcatgacctgtttaccacaacctccacctcccagactccagtgatcctcccacctcagccttccgggtagctgggaccacaggcgcatgccaccacgcctagctaattttttgtatttttggtagagacagggtttcaccttgttgcccaggctggtcttaaactcctgagctcaggcaatccaccttcttcggcctctcaaagtgctgggatcacaggtatgagccactgcacccagccaatactgtatatattttttttaatggaccaaggccaccacaatgtgagcagaaaggtcaaatagtctgttatgtgggagaaatgtgtaacagtgactttgttttttaatttcccccagttttctagttttctgttttagaagacatgctgtcacaattaacaactcttactaataagacttgtcaatttaaatggtctataccaattatgaaatacgaggaaagtaggcattagactacaagcacgtacttcctctaagtgcttagaatcccaagctgtaacactgctttatcagctgtttcccaaagcctttcctcctagtagggatctgcagcagggtcagcctcctgggaactccccacacagggcccacagcttgttctgagtcaggtctaggcaggctagcatcccatggaggtaggtgggtctacagatgcacaaaggaatcaacaacagctgatggccttcaaccacgtacctcatcccaaagccatgggctgtgccaggagttgatgtggcctacaggctgtgtgctcccaaatactaaagaagcctcagccagacagcatgaaacttttttcaggagaaacaattcaaacatataggcttagactgaggtactaatatggaagggggctgctgggctacaagacaaattcaggctccaggaaagcagcaatgcgcaaaagtaacttttcagaatacacagtcagggttggagaagaacattctatagcagaggctcttacccaagggcttccacaacttgtaacactgtatagttgccagatttcacatctgcaggaaataaaataaataaatatgaaaaataaaaaaaaaacctaccaaagggttgaataacactaattataatgtttcctgcctgccctaggctttgtacctgggggcccactatatttgccaagagccctcctagatgagaagcagcattgctgtaacacttcaaatatgcagctttgtataaaaattgaaaagaaaataaatatatcatttgtgaatgacatgagcgtatatcctgaaaatccaagagaaataaaaaaatcacaaacaaaataatttgttaaattagctggatacaaaatattatgaaatttaaaaccttcatatatatacatatacacaatagcctgtaaaatgatataaggaaaaagaccctgtttataatagcgaaaaaagaaaaaccaaaaaaatacctggatataaactttttcactcatttttaaaaatcatggtaaaatacactacataaaaacttttgttttggccgggtgtggtggctcatgtctgtaatcccagcactttgggaggcgaggtgggcagatcacgaggtcaggagatcgagaccatcctggctaacacggtgaaaccctgtctctattaaaaatacaaaaaattagccaggcgtggtggcatgtgcctgtggtcccagctactcagaaggctgaggcaggagaatcacttgaaccctggagtgcagtggtataatcacagcctcccaggctcaggtgatcctcccacctcagcctccccagtagctgggaccaaaggcatgtgccactacccctggctaagtattttgtatttctttgtagagatgggtttcaccatgttgctggtcttgaactcatgggctcaaatgatcctcccatctcagtctcccaaagtgctgggattacagatgtgagccactgcgtgcgacctagacataaacttaataaaaaatgtgaaaatctgaatgatgaaaactttattttatttatttatttatttttgagatggagttcgcctttgtcacccaggctagagtgcaatggtgtgatctcggcttgctgcaacctccacctcctgggttcaagcgattctcctgcctcagcctcccgagtacctggaattacaggtgcctgccaccacgcctggctaatttttgtattttcttttctttttcttctttttttgagatggagtcttgctctcgttacccaggctggagtgcaatggtatgatcttggctcactgcaacctccgcctcccgggttcaagcaattcttctgcctcagtctcccaagtagctgggattacaggtgcccaccaccacgcctggctaatttttgtattttcagtagagatggggttttgccatgttggccaggctggttttgaactcctgacctcgtgatccgcccgccttggcctcccaaagtgctgggattacaggcatgagccactgcacctggccctaatttttgtatttttagtagagatagggctttacaatgttggccaggctggtgttgaactcctgacctcaggtgatccacccgcctctgcctcccaaattgctgggattacaggcataagccaccgcacctagacgatgaaaattttaaagcactagtgagatatcacttcatacctgctaggatggctattatcaaaaagacaagagataacaagtgctggtgaagagagagagaaaaggtaacctttgtacactgttggtgggaatgtaaattagtacagccattatggaaaacagcatggaggtttcttaaaaaattaaaaatagaactactatatgacccaacaatcccactactaggtacatatccaaaggaaatgaaatcagtatctgtagagatgtctgtactcccatgttcactgcagcattattcacagtagccaagatctggtagcaacctaagtgtcaacagataaatcaataaagaaaatgtgacgtgtgtgtacacatatacaacagaatactattcagctataagaaagaaagaaatcttaccacttggtgttttttgtttgtttgtttttttctgagacagggtctctctgtcacccaggctggagtgcagtggtgtgatcccagctcactgcaacctccacttctctgtttcaagcaattctcctgtctcagccacccaagtagctgggattacaggcgcatgccaccatgcctggctaatttttattttttagtagagatggggtttcgccatgttggccaggctggtcttgaactactgacctcaggtgatccgcccacttcaacctctgaaagtgctgggattgcaggcgtgagccactgtgccaggccaaaatcctgccacttgggacaacacaaatgaacctgggtgaacatcttgctaagtgaagtaagccagaagagaaagacaaatacagtatcctatgatctcacttatatggagaatctaaaaaagtttaattcacaaaagcagagagtagaatggtggctgcaaagtacagaagaaaatggggagaaattggtaaaagcgttttttaaaacaagcactaatgaagatctgaaaaggaaactttatagaaaggcatctcatatctttgaaagactcaagatgacaaatttcccaaatcaatctgtaattttaagataatcgccataaaaacactaacagaatacttttggaaactagataagcttatcctgaaattaaagtgccatatatatatatatatatatatatatatatataaaattaagacaggcaagttgtgaaaaggagtaatagaaaatcagggagaaggtagcccttccagatattaagagattattatatggtcacattttaaaagtgtacactttcaacaaaaaaaagaaaaataaaaagtatacacttttgaatatacttgtaattttccataataaaaataaaaaacaaccagtgcagtttcaattcatattcaaagaaatcagtggtgcaaaaatagaatggaaagtccagagacacaaatacatatgagaatatgatttttaaaatcctatttcagttaatgggaaaaataaagactattcaatagtgttagaatgattgtcctggaaccaatttggaaaacaaacaaaaacattggctttaaatctttcaccaaaatatgttttttaaatatgagaaaatttcttttttttttttttttttgagacagaatctcgctctttcgcccaggccagagtgcggtggcgcgatctcggctcactgcaagctccgcctcccgggttcatgccattctcctgcctcagcctcctgagtagctgggactacaggcgcccaccaccacacccggctaatttttttgtatttttagtagagatggggtttcaccgtgttagccaggatggtctcgatctcctgacctcatgatctgctggccttggcctcccaaagtgctgggattacaggcgtgagccaccgcgcctggcctaaatatgagaaaatttctaagaacaagataacattcagaagccctaaaagattggttttaaaaagtcagattttctacaaggcaaaaataatgatcataggacaaactgggaaaaaaaattacaagtcttataacaaaaggccagtttcccgatatataaagagttcccacaaatcaatgcagaaaagggcaacaatttaaaatgggcaaaaacaggctgggcacagtggctcatgcctgtaatcccaacactttgggaggccaaggcaggtagattgcttgaggccaggagtttgagaccagcctagccaacatggcaaaacatgtgtgtggtggcgcatgcctgtaaatcccagctactcgggaggctgagggacaagaatcacttgattccgggaggcagaggttgcagtgagccgagatcgtgccactgcactccagcctgggtgacagagtgacgatctgtctcaaaataaataaataaataaaattaaaaaaacaaaatgggcaaaaacaaaaaaatgaacaggcattccacataaaaggaactacaagtatgtacgaaaaggtgctcaaccatatttacaataaaagatgtaaattaaactacacagaaactttttaagaaaatctaacagactggcaaagacaaaaaacttagcaatatattatgtttggtcatgatattcagaaacagacattcttaaacattgtaggtaggattataaactggtgcaaccctatattgagggcaatataacatctttagaattccaggtacatataggctttaacccaggaaagctagaagtttatcctctagctatctagtcatcttttggtatatacatgagagactggctccaggacctcctgaggatactaaaatctgtggatgctcaagacccttatataaaatggtaagagtatttgcatacaaactatggacactctcctgtatactttaaatcatctctagattactcataatacttaatacaatctaagtgctacgcaaatagttgttacattgtattgtttagtgaataatgacaggaaaaaagtctatacatgtttggtacagttgctattttttcccccaaatacttttgacctgcagttgcttgaatcaaggatgcagaacacacagatatggagggctaactgtactgtgaaagtgcaaaataatgcatgtataacgttattcaatacagcattattcgtaacagtaaatgactgcaaacaacacatgcccatcaataagaaaccagttaaatgaattatagtacatccatacaatggaattctctgtagctacttttatttattttttaatcttttttatttttattttttgagacagcatcctgctctgttgcccaggctggattgtatttttagtagagatggggcttttgccatgttgcctatggctggtctcgaactcctgagctcaagtgatccgcctgccttggcctcccaaagtgctgagattacagacatgagccaacacaccgggcctgtagctacttttaaaaagacaaatgaagaaagactgaagctacatatatactgataatgagtcaagatctaaaataacagtgtgtataaacagtgtatataatatgtgcgtagcattgtttttaaagggaggggggattgtttttatttgcatttatttacatctctggaagatataaaaggaactaataacatttgttgccttcagggagggaaaatgcatagttaagggttgagaggtagactattgttttaaaagaaatatttcattttggaataattttacatttatagcaaagttgcaatgacagtgcggagttcccgtatagccatcactcggtttctcttaatgttaacgtcttacatggcacacatctgtgaaactatgtacgagtgtcaaaactaagagattaggttagcactgatacacactattaactaaactctaggctttattcagatttcaatagtttctccactaatgccaaatttctgttccaggatccaattaagaataccaaattgcagttagtcatcttgaattcttagtctctcctggtctgtgaaagtttcttagtctttccttgtttttcatgaccttgatagttttaaagaagtactttatagaaggttccccaatttgcatttgtttgatgtttccctcatgtttagactggggttatgggttttaaaaaagaatatcacagaggtgaagtacccttctcaacatatcatatcagggatataagatagtaacatggcttctccatcactggcaatgttaatgtttatcacttggttaaggtatgtctgccaggtctctgcactatagttactacttttctctttctggtactcttttatttgtaaggtattcattaagtccagctcacattcagtggggaggggaagattaaactccacctcctggagggaggagtatctacctatattatttggattttttttttgaggcagggtctagctctgtgcagtagtacaatcatggctcactgcagcctcgacttcccaggctcaagtgatcctctcacctcagcctcccgagtagctgggactacaggcatgcaccaccatgcccgcctaatttttgtatttttttgtagggacagggttttgccatgttgcccaggctggtctcaaattcctgggctcaagtgatccacccaccttgacctctcaaagtgctgggactacagatgtgagccactgcacctggcctttaaatgcaattttagcagcacaatagtaactcacatatattgaagagaagcatcttagaatgtattttcaagggagaaacagggtaaaaggctaacaatcttcataaggctttggttcacattgaacacttatagctaaataaggtgtgacaaccagagaattacttccagcagcctgttctgggttcctaatccacctacctctaaatgcagaaccttaactagtcagcttgtgccaatgctggaaaaagtgaaagagaggtctgaagaaatcctaaacttccagttctcctaaagtctgtggtctcacagcaacagttatgagctgacctgggcagaggctcactctagcaccacagtaagaagtcgtccaatgagactgaggaaaatgagagctctagttaggacttatagctcgtgactggcaccaatttagacatcaggcactcttagcccacttgtgccaggatgtggaaggcccagctgctgccccagctcctgagaaagagccaagggaaaaaatgagcagactgtaagggtgggggaaggggtagcagccagactaacaggccaaacaaaccaagttgggttctatacccaattccttaatggcaacacttacatgaactgaaacacctatttctgggttacgaaccacaaaagggcattgcaacatttgggaaggtagaaaagggtactttcttggaacagcctggctatagtacagaaaactctgctgaaacaacccatctaaaaactaatttcaataatgggcacagaaggagttaataattgtacagatgaagccataggggactaacaactgttaatagcaaaggatatcaatgaactgaatcatttttcttcagcaataccatcaaaaccctctgtggatgtcaggctagggtctatatttggaacgaaggctctaagacaagaagtgccaaatagggcccattcagtaccttctattttttcatttttttaaaaaaattgaggtaaaggccgggcgtggtggctcacgcctataatcccagcactctgggaggacgaggtgggtggatcatgaggtcaggagatcgagaccagtctggccaatatggtgaaaccccatctctaccaaaaattaaaaaattagctgggtgtagtggcatgcgcctgtagtcccagctactcaggagactgaggcagaagaattgcttgaacctgggaggcagaggttgcagtgagccgaaatcacgcctgggcgatagagcgagactccgtctcaaagaaaaaaaaagaaaaatgcttctttggcattctgcatacattaatatgaaaatggctgctttataattacaaataaatagccatttgcatgtggttccttgaatcccagtatgtgggtgaactctcctggcaaagccctttagtcttcatatagctttcacaaaattcttgaattaatgcagcacaaacataaaagtgactataaggccgggcacggtggctcatgccagtaatcctagtactctgggaggccgaggtgggtggatcacctcaggtcaggagtttgagaccagtctggccaacgtggcaaaaacctgtctctactaacacaaaaactagccgggtgtggtagcgcatgcctgtaatcctagctactccgaaggctgaggcaggagaatcacctgaacctgggaggcagagtttgcaatgagctgagatcatgccattgcactccagcctgggctacagagtgaaactcaatctaaaaaaaaaaaaaaaaaaaagtataaaagtagaaaaaattagagaaaaatgaggccgggcgcggtggttcacgcctgtaatcccagcactttgggaggccgaggcgggcggatcacgaggtcaggagattgagaccatcctggttaacacagtgaaaccctgtctctactaaaaaaaaatacaaaaatattagctgggcgtggtggcgggcgcctgtagtcccagctacttgggaggctgaggtaggagaatggtgtgatcccaggaggcagagcttgcagtgagtggagacggagccactgcactcccacctgggcgactgagtgagactctgtctcaaaaaaaaaagaaaagaaaagaaagaaaaaattagagaaaaatgagataataaagctattacaagaccgtaaaaaaaagtaaggaagatggtggccaggcatggtggctcacacctgtaatccttgcactttgggaggccgaggcaggtggattacttgaggttaggagtttgagaccagcctggccaacatgatgaaaccctgtttctactaaaaaaaaaaaaaaatagaaaaattagctgtccatgatggcatgggcctgtaatcctagctgtttcggaggctgaggcagaagagtcatttgaacccaggaggctaaagttgcagtgagccaagatcgcgccactgcacaccagcctgggcaacagagcaagacttcatctcccaaaaaaaaaaaaaaaaaagccatatgttcgttttcattcaacatttactgaatattataaatagggtaccatgttagggcttaagatagaaatatgggcagggagttttggggaagtccatagtctgttggagcagaaagacaaacattcattcatttattcatttttgagacagagtcttgctctgtcacccaggctggagtgcagtggtgccatctttggctcaatgtaacctctccctccagggttcaagtgattctcctacctcagcctcccaagtggctgcgactacaggcacaccaccatgctgggctgatttttaaagatttttgtagagacaaggtctcactatactgtacaggctggtttcgaattcttgggcccaagcaatcctcccacctcagcctcccaaagtgctgggattacaggcatgaaccaccatgcctagcccagaaagacatttaaaacaatcacagtaggctgaggctagaggatcgctagaggtcaggagttggagaccaccttgggcaacaaaacaaggccctgttcgctacaaaaaaattagccaggtgtggtggcacgggcctgtagtctcagctactctggaggctgaggccagaggatcacttgagcccagaagttcttcgaggtcacactgcactccagctggggcaacagagtggaccctgcttctaaaataaataaataaaacaatcacagtgtaacaagttctgtgttaccacagtgatataaacagagattgggttggcatgagaaagaagtaaaattcctgggtttatggaccatgggccactaactttaagtgattaattcttttaatggtgcaaattatccaaaattaaaaataaccagggttggcatggtggttcacacctgtaatctcagcactttgggaggccaaggcaggcagatcacctgaggtcggaagtttagagacttgcctgaccaacatggagaaaccccatctctactaaaaatacaaaattagccgtgtgtggtgatgcatgcttgtgatcccagctactcgggaggctgaggcaggagaatcacttgaacctggggggcagaggttacggtcagcagagatcgcaccattgcactccagcctgggcaacagagcaaaactccatctcaaaagcaaacaaacaaacaacaacaacaacacacccgtaatacctggaaatactattaattatgcacttggactcctgggatgaagaaagctaacagagagttaattttcctaacggtattttcgctggtatcaaggaaaaaatcagtgtaagttcatttccctttataggagggtctaagattttccaacacgttcaagatttgctcttaaaaatggacctactagcacctcctaactacccacactttccttagcaaggcaccagtttgtgtgggggcactgagaagtcaaaggagtattcatgtgatcattgacacagaatgcacaaacagatctctgtctgatggagttgaagcctcttgagaatctggactagcagccaaagggaagtgaggggaagcgggtagggtgggaggatgagaaggagcaggagagagaaaaatcccaatcaggactaagttccaatcaagctctcaaaatgccctttctgctgataatgcctcagatatttcactaaactgtattttactgttctttaatactttgacttaaggaatagaggtattcttagggaatcacaaacatggaaaaacacaatacaataaagactgaaatgaaggaaaatccaaataactaaaaggaaaaaaattatatccatcacctgcaaattcaacgtgttcaaaaatcacattctctgaaaatcagctctcgtcctaattttggacaaagtatttcttttcctcatcctctggttcaaaaccttggggtcttcttagagtcctctatctccttcaagccctataataactagttagaactcaaattccacagattcttccttcaacatttctcattgcattcactcaagcagtttttattgtgtacctactgatgccaatttcaggagattctggtggtacaactgggagggtaggatgtggagatgtatacagcaacagctactaaactagtccactaaatacatgagtggttgagaaataagtgcgtactacaaagattctgacgtatgagatgctgtctggctgggttaatcaggaaacccttggggaggggtagggaactcaagctgggccttgactctcaggtctaacttcgattacacagagctagtgaagggaattgggaaggaaagcactcagggaactacgaataaaggtggctgcctggaattaaacgtccagggagcagtgagaaaaaaaggctggggccaggtagtggcaggctttgaaggcttgcccaagaggcctttaacccttaggctgccaggttatttccctcccatcgcctgcagcttctttacagctgacactttcaccaggaacccaggtacaaaacaaaggtggcagcagctgcttttgtgatcaaagggtgctccttctgcatttaaatttgcaggctgctactctgagtgactgaacaggaagctagctggtccctttagcgctaacaaagcttgatttaggctgaaagattagaaagcacatcttattctataaacgcttcaacactctgttatccttcaacaaccctaactagggctgtgatctaagattgacaatattaacttaatccttgtcaaatttgttttcattttatggctccctggctcaaggatctacaacaactcttagtacagataacaggtcattcaaatttctctgcctggaatccaaagttatacacaatccaaccctaccaaaccttttcaacttttatctgttactattcctttgtaccaactttcttttctttttgtttttttgagacggagtctcgctctgttgcccaggctggagtgcaggggcgcgatctccgctcacggcagcctctgcctcccaggctcaagcgattctccagcctcagcctcctgagtagctgggattacaggcatgcaccaccatgcctggctaatttttgtattttcagtagagcggggtttcaccatgttggccaggctggtctcaaactcctgggctcaagcaatccgcctaccttgttctctcaaagtgttggcattacaggcgtgagccactgtgcccaccaccaactttcttttcttaggagggctaaattacaacagggctagtgttacagtcttaaatcagttgagttgaattcaaattaagcaacagtttagaccattttttttcagaaagaaacaaaaatataaattttgcaaaaacgtttgtaagaatttagcagtcccagtggctcatgcctgtaatcccagcacttcgggaagctgagatgggaggatggcttcagtcctggagttagagaccaacctaggcaacatggtgaaacctcgtcactacaatacaaaaattagccgagcgcagtggcacactccctgttgtcccagctacttcgggaggcttgaggcaggaggattgcttgagcataggtcgaggctacagtgagccatgatttcaccactgcactccagcctggcagacagagagggaccttgtctcaaaaaaaaaaaaaaaaaaagagaagaatttgcagtccttattcaagataagtccttattcaagataagacattcaagatgtcttttcaaaatatgttctgaatcaaaaaaaaatccaaaattattgttttcgtatcgcataaatgtgaaagactcatcacaaatgacactgatatagtaatgttctatatcttcgtagggggttggattgtataggtgtatgcattagtcaaaatcagtgaacgtacacttaaaggtttatatattccattttacatcaaaataaaccgtcaacaaactctagtcaatgacatgcatgccaaagtatttaaaggaaagtgtacaggtatctgcaatttaaatggatggatagctatatgataaagcaagtaatattaaaatgttaatggtaggatagatcctaagtgatgtgctccttataaaattctttatacttggctggatattcgaaaattttcataataaaatatgagggaaaatgacattggtaagacactgtacttgtaaattgtaaacactgataacacactacatttcataaaattgtaagatgttaagtttggtggcagcaccaggtatttgctccttgatgcttccaaactacgctgcacacacctcttacagaatggttgcctctcccagcatactataagttcctggtgggcacagatctaacctaatttgtatttatattcctattgctttgcatcatgtttggggaataatatgtattcaacaatagtggcatgattgaattaaagtggaatactgctaacgaacaaagtattatatttctagcagattcactattcttttcttacatattctaaaggttaatacgctcaatatccaagagaaatgtgtccttacttctctccaagcatacgaaatttccaaagtttttttaaaaaaactactcattagataattttatattgttacttaaacccaagatctgaaggcctcctaacattcaataactttttagtagttttttttttttcctagaagagcaaagtctcagaactccacggaagcctggaaatcgttttattctaattttagataagctgtctgaactaagagatctctgaactggtcaaaagcaggaaagtgggggtctgggaagaagacaaaaacaaacgccacataaaacgtcatggagcaaactaatcaagaactttagcaagaaacggagagaaagtcttaaggaggacacccagaacatctccagctcctcctggcccgtctcctcaactcctcttaattccagccagtcagagcgcggggccatctgccactcccaggatgccacgcgacgggagcggacgctgcgaggatgcacctccacacgtcaacctcccacaaacagcatggcttcgtggcgtgagcacccggttcggacctgaacgcctgggtccgagtcccacctccccctcctgcctggtctgcagccctgcgcaagtcctcttgccctcgctgagcctcagtttcctcatctgtaaaatgtaatgattccctataattggctacagggagatgagaagtgtaaatggttttaaggaagacacaggcaactctctaacttgttacggctctgaacctcgcggtgctcactaaccagccttgagaccaatctctcaaagtcaccccgctcctcccttcccgcccggcgcctgtactgaggccgctccctcctgttggcccccatgcggaaggcgcgcggcgccgtctgccgtacctgcagccacctggtcagcggggccctcttgctgacccacgacgaagtcgtgcacgaggccccatagggcacccataggcgccgccgcctccacagccgcggcagcggccataacgcgaactagagaccgtgggaggggatatgggcggtggctcgagacgggctctccgcgcatgcgcctcccgagccaatctccggggaagcgcaagggggcggggcgccggggtcacgtgcctgccggcttctgcctaggcagttccagggaggggcggggcctgaaatggggcggtggcaccgagagggaaggcggctgctgggcacgcagccggaggcgattgagggcgaataattcccagcccggctccccgggagacgggctgcggggcgggcacctggctgggtggggagaggggcggtacgcaccacgggggaagccaatgagaaaatcaggcccagccctagggggcggtgctgtcggtcacatgcgcacctggggcgggtggtggcggcggcgcgggcacc

SEQ ID NO: 93 - DNA, 37567 bp, Homo Sapiens
cttgggagtcgtggtcttcgatctggtaaacagaagacggcaactcggttaagtcttcccccaccgccccctgaaatccctcgccccacccgcgagggactggggtaggagtaggggcgttgccgtggttagcctcgaactcctaggctcagacgatactctcgcctcggcctcccgagcagctgggactacacgcgtgagccaccgcccccggcataaagtttgaattagtccttacgcaaaaagggaagagggcagtctgtaaactcgcgcaggatcaagctctcgagctcccgtcttgggttagcgcgcagggcggaagcggggagaaggcggatccgggaggcggggatacgttacgtcgacgcgggcgtgaccctgggcgagagggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgaggtgagtgtgtgaggcgcaggctgggccctccagagccgcggctcgtcctcgcccacctgcgtcctggccggtccagtgctcagcggcagttggggcctccgcgcgcagtgtgaaacccggacgtggcagggcgtgtccgcgcccgaccgaccctcagctgctggggcgaaaacacaagtggacctcagtctttagaactaggggagaaacattagagcctttataggcaacacctattttatgggttcgagcgagaagtccgagatcagagcggtgtagccacagctgtttaatatcacagccagggcttccggattcctgatctgtctttccattacaccgtgcttagaaagtaccaatctccgattgccaaaacagtgttttcatcatctaatgcggaaaaccattcacatgatgcctagagaatgatctgaagtgaggtttggttttcttaaaactttttttttgagatggagtctcgctcttccgcccaggctggagtgtagtggcgcgatctcggctcactgcaacctccgcctcccggattcaagcgattctcctacctcagcctcccgaggagctgggattacaggcccccaccaccacgccgccaggctgatttttgtatttttagtagagacggggtttcaccatgttggtcaggctggtctcgaacttctgacctcaggttatccacccgcctctgcctcccaaagtgctgggattacagccgtgagccacagcgcctggcccctgtttttttgtttgtttgtttgtttttaacttctaaagcgcaatgtaatatacatgtagaaaaattcacattcacaactgtatacaactccgtgaattattacaaaatatactggccgggcgtcgtgtctcacgtctgtagtcccagcactttgggaagtggaggcgggaggacgattgagcccaagagttcgagaacagcctggtcaagatagtgagacccgcatctctacaaataggaaaaattagctaggcatggtggcgtgcacctgtaggcccagctattcaggaggctgagaagggaggatctagcctgggaggtataagctgcagtgagctgtgatcaggccactgcactccaacctgggcgatagagcaagacaaaatgaatatacacctatgtaatcaccacttaatagaatggtcctcagaagccttcctgtgtagtatttaatattttcccctttttacagtggtaactgctatactggtttctaatgagatgaactaatgttgcttgtttttgaattttatataaaaatacatcaggagtgttgagtgtttcgttgtttcacatgcttgccaacacgatatttttcagcctttttgattttaactattctgctggttacacagtaatgtcttaatgtgattttaattttcctgattaataatgatgttggacatctgttcatatgtttttgcccattttgatatcttctgtgatgtgcttgttcaaatctcttgcctatttttctattatctttttcttactgatgtgaagttctttatatactggttatcagccctcagttatgtttgtgctaaatgttttctctactgtggtttgacttgtcactctcttagtggtgtcctttgatgaatagaagtgctgaatttatttttttattatttatttatttatttatttttccttttgagacagagtttggctcttgttgcccaggctggagtgcaatggcacaatcttggctcaccgcaacctccgcctcccgggttcaagcgattctcctgcctcagcctcccgagtagctgggattacaggcatgtgccaccacgcccagctaattttgtatttttctttaatagagacaggatttctccatgttggtcaggctggtcttgaactcctgaacttaggtgatctgcccgccttggcctcccaaagtgctgggattgcagacgtgagccacagtgcccagtagaagtgctgaatttaaatgtagttcagttttcagtcttttcctttttggctagtgcgttatgcatccagtttcaagaaatctttttctgtcccaaggttgtgaaaataataagtgttactttgtttttgacagacgattgtacatatttatgagatacaagatgatatttctttttttttttttttttttttgagacggagtctcactctgtcgcccaggctggagtgcagtggcgcgatcttggctcactgcaagctccgcctcctgggttcacgccattctcctgtctcagcctgccaccacgcccagctaattttttgtattttttagtagagacagggtttcaccatgttagccaggatggtctcgatctcctgacctggtgatccacccgccttggcctcccaaagtgctgggattacaggcgtgagccactccacctggcccaagatgatatttcaatacatatatacattgtataatgaatgatcaaatcagggtaatcagcatatccatcagttcacttaaacacttgtcatttctctttgtgatgagaacattcaaaatactcgcttctggctattttgaagtatacattacattagtgtttactgtagtcaccctactgtgaaatagaaccctagaacttattcctcctatctaactgaaactttgtgcctgttgaccaacctctctccttcctgccgccccctgcaacagctgcattctcctcagtctctggttaccactgttctatttgttccttgtatgagatgaacttttttttttttgtttttttttttgagacacagtctcactctgtcatgaggctggagtacagtggcacgatctcggctcactgcgatctctgtcttccgggttgaagccatttacctgcctcagcctcccgagtagctgggactacaggcgtgtgccaccacaccctgctaatatttgtatttttagtagggacggggtttcgcatgttggccgggatggtcttgatctcctgacctggtgatctgcccgcctcggcctcccaaagtgctgggatcacaggcatgagccaccgcgccccgccaagatcaacttttttagattctacatatgagtgagatcatgcagtatttgtctgcaaacacatttataatgtataatggggtatataaaaataagtaaaacttggcccctacactgaaggaatataaagcaggagaacagagaggcacaataagagaatggccttggcttttcctaaagtctttttgatacgactagctagatagaagatggggagagagatgcaccttatttctctagtgtttatactgataagcatttgtatttttcagtaatggcaatgcagatgcagcttgaagcaaatgcagatacttcagtggaagaagaaagctttggcccacaacccatttcacggttagaggtatgtggttagttgctaattttggaattatatactagattcttctacctagtggaaggtattacaacctttacataaaatataggtttactaccaaggtcaagacccaaattagacttttcagaagtgttgtcaataatcctgtggaaaggctgcagatcattgctaaatatgtctggcagggcctcttcctttgtcaacaattctcttcctactttatcatttttatttctgagagttggactgtcagaaactaaggcctaggatcccatggtggaatctctgtgctgtttttgtttgtttgtttgtttgtttttgatggagtttcgctcttgttgcccaggctggagtgcaatggcgtgatctcggctcaccgcaacctctgcgtcccaggttcaagcgattctcctgcctcagcctcccaagtagctggaattacaggcatgagccaccacacccagctaattttatatttttagtagagacagggtttctccatgttggtcaggctagtctcgaactcctgacctcaggtgatccaccctctttggcctcccaaagtgctgggattacaggcatgggccactgcgcccagcctgtgctgtttttttgtttgttttttaagaaatgggtcttaactgtgttgaccatgttgatcttgaactcctggcctcaagcagtccacctgccttggcgtcccaaactgctaggattacaggcatgagccaccatgcctggccaaagcatcctgtgctatttgcactaagtatgaaagtgctgttctgggaattatagcggcctggaccagttatgcaaggaagacagggaagcaccttctctccattaacctagatttgtgctgtcagctgtcattggcagagagaagggtgtggtggtgttatggtataagagacaagctccaattcaggattctgcacaagaacattaagcaccagagctgaggccttacactatttctgcccattgtatagagactgccctgtgagtgcagctgatttgggctaagtaggaggaaagcagagaaagacttgattcttctgtctctttttttcatatttcccatctctgactaatcttcaagactctagaagttaggagtgcaaaaggctaataaaaaaaaaagactctagaagttacttaaatggatttgtgataaacatttgaaagttcagagtcataacttctggtgccatgagcatccttatactcaaacatgcatattgcttaaatattaatagcagacatggcttatgttggcaaactaatctctcccctcttctaaattctcccaacccctgaatgcacccacattcacctactaactcatgttttcccagaagtcatggttttggtggctaatgaaaccaaagctgacttgaatataggaagaaagaggtgtctttgggtggtttgttttgagaagaggtataaaagtccctgacaaaaagtagttttcctcactgttaatgtcagttgttagagcagagctttctggtcattgttcaacaaaaagtattgacaggccaagatagtgctctttatattctgagcagccttatctatttaccctaccatagtgtaaaaatacagttttttatgtgtgcttgatgtggaaagtgttgagcaacactgtcttaaagtggtcttgtagggcccaaggtctcagagatcatttagggtcacaaaaaaaggttgggagttactttttaattccaattgctaataggagttctttttaatgtacatggcttagtgctagtttaaaattattgattttgataatgaaaaggttgttaatttgttattaagtacctcatatatagggctcatttttcagcttttgcatataataacagtaggctctctgtatctccggattctgtatcagcaaattcaacaaactacgtatcaaaaattcaatcaactacatatcaaaaaaaagtatacaggaggatgtacataggttatatgcaggtaatacgccattttatataagggacttgagcattgttggattttgttatctgctgggggtcctggaaccaacttcccatctccccccgcccccccaaggatttcaagggacagttgtattacaagtcttcaagcacctctgtgaagtatgtaggacacataacatctgtgttagattagagaactaaagcttaaatttatccatggttttcttcatttgcagcagtgtggcataaatgccaacgatgtgaagaaattggaagaagctggattccatactgtggaggctgttgcctatgcgccaaagaaggagctaataaatattaagggaattagtgaagccaaagctgataaaattctggtaagtactgcttacttaacctagggaggcattagtgggaatagtacaaaagggaatgtagtgaaagacttcttccttctatctcttattcttcggtcatctcattatcctttccaggggtgactgttacctgtttcttttcttcttttcttttcttttcttttttttttctttctttttttttttttttggagacgggttctcgctctgtcacacagggtggagtgcagtggtgccatctcagctcactgcaaccttcacctcccaagctcaagcgatcctctcacctcagcctcccaagtagctgggactacactacaggcacatgccaccatgccggggtagtctcgaactcctgagctcaggcgattcacctacctcagcctcccaaagtgctggattataggtgtgagctactgtgcctggcctatttatttttctagcttcatatagttctttaacatacatacttccccatggttacattttgttttatgaacctatttcttcagtgtttatatagttacacagttttattgcctttacccttgaagttttatgtagtataaagcagattttttttttttttttttttttttttgagacggagtctcgctctgttgccaggctggagtgcaatagcgtgatcttggtctactgcaccctccgcctctcaggttcaagtgattctcctgcctcagcctcccgagtagttgggactacaggtatgtgccaccacacccagctaatttttgtatttttattagagacagggtttcaccacgttggccaggatggtctcgatctcctgaccttgtgatctgcccacctcagcctcctaaagtgctgggattacaggtgtgagccaccgcgccccaccgcaaatatttatttataaaattgtattttcacgtatcgattactgttagcgttagataaatttattggattactcaaatgaatatttgctgaagtggttgcttaattggaaataagggttctgagtccctaacagtatttttgttaaaagattgtcatattgactaagccagtaggggtccctaaagtctttctgttttcgctttttgggtatcagtttttgtgaatgaacaaatgctgacaggatcttttctttttgccttgcgagatcttggtttcagaaatcaagtcacttctctgtttctatgaacacaacaatgcaaacctagaatacatgatttgagatgcaatatggtatagacttacgtgtctttacttttcaatattttatgttctttgtttctggccagtaaagattatgattgtattgtttgttttctgtttttttttgaggcagagtgtcgctgtgtcacccaggctggagcacaatggtgcaattttggctctgctcactgcaacctctgccttccgggttcaagtgattgtcgtgcctcagcctcccaagtagctgggattacaggctcccaccaccacacgtggctaatttttgtattttcagttgagacggggtttcaccatgttgcccaggctggtctcaaactcctggcctcaagcaatctgcccacctcagcctcccaaagtgctgaaattacaggcactagccactgtgcccaccttttttttttttttttaaagaaaaaaaagaaaagtctcactctgttgcccaggctggagtgcagtggcatgatcaaagctcactgcagcttcagcttcaaactcctgggctcaaggaattctcagcctgctgagtagctgggactataggcacatgccactagcctgaccatttctaccagttttgtctttgctaatacattctcctgtttttcaccaaaggaagtagtctatattccttgagctcccatggcttgttagtacttctcatattacccatcacatctacttgtactatagttattttgtatagtttatctttctgattaagttataagctctgtggaggcaggaatcagctcttctttttctccatatccttcagagtccctgggactatgtttcatacgaagtaagtgtctagtacatgtttgttgcactgaaatgacagtgagtatatgaattggccaggctggtctcaaaatcctggcctcaggtaatccgcccatctcagtatcccaaagtgctgggattacaggcgtgagccactgcacctggccgtgcaatgaatttttaaatgaaatattaagtatatagaaaagtttagagaataaactttcattgatttttcagctatttgttgattttttttcttcatgggaaatttaaacattatgaaagtttaatctttttactttctatgggtctatttagattttcttcttgagtgagttttggtagtttatctttctaagaatttgcttatttcatctaagttacctaacttgttgacatagagatgctcacagggtttccttatactactttttatttacataaagtcagtagtaatgtcccctctttcattcttgattttagtaatttgagtcttttctctttttttctcgggcaatgcagctaaaagtttgtcaattttgttgatattttcaaagaaccagcttttggtttcattgatttttctctattattctgccctctacttaatagtttctaccctaacctgtattatttccatctttctgcttgctttgttttgtttgcttttctttggaaggttaggttatgatttatcttttttatttttagaggcagagtcttgttctgtcacttacgttggagtgcagtggtgtgatcatagctcactgcagcctccaactcctggctcaaacaaaccttctgcctcagcctcccaggtaactaggaccacaggcacgccccaccatgccctgctatttattttattttattttatttttgagacggagtctccctctgtgcccaggctggagtgcagtggcgtgatctctgctcactgcaacctctgcctcttgggttcaagcgattctcctgcctcagcctcctgagtggctgggattacaggcacgtgccgccatgcccagctaatttttagtagagacagggtttcaccgtgttagccaggatggtcttgatctcctgacctcatgatctgcctgcctcagcctcccaaagtgctgggattacagtcgtgagccaccgcgccaggccttttttttttttttttctgatgcagtctcactctcttgcccaggctggagtgcggtggtgtgatctcggctcactgcaacctccgccgcccgggttcaagcagttctcctgtttcagcctcctgagtagttgggactacaggcgcacgccaccacgcccagctattttttgtatttttagtagaaatggggtttcaccatattgggcaggctggtcttgaactcctgacttcgtgatctgcccacctcaccctaccaaagtgctgggattcaggcatgagccaccatgcccagccatgccctactaatttttttttttttttttgagatggaatctcgctgtgtctctcaggctggagtgcagtggtgcaaattcagctcactgcaacctccgcctcccagattcaagtgattcttccacctcagcctcccgagtagctgggactacaggcgcgtgccaccacgcccggctaatttttgtatttttagtagagaggaagtttcaccatgttggtcaggctggtcttgaactcctgaccttgtgatctgcccacctcagcctcccaaagttctgagattacagaggtgagccaccacacccagccaccctgctaattttaaaacatttttagagccagggtgctgctttgttactcaggctggtctcaaactcctggcttccagcagtcctcccacctcagcctcccaaagtgctgggattacaggtgtgattcaccacacccagccttcttttctaatatagctgtttatagctatgaatttctctctaagcactgcttttcttggagcccatacgttttggtatatcttcgttttcattcattgcaaaaacattttctgatttcccttgtcatttcttctttgacttgttgcttatttaggagtgtgttgctttatttttgcatatttgtgaatgcacttacttttcaattttagaatcaacccatagtgctattacagaacacttatctgtaattacaaaatagaatgtgaatgttctcagccagacaatatgaaagaaaaggtacagctgatagaggtggggaagtagccatggagagagaaaagattgaagggcaaatgtcctcatttttacaaagtaggaagttaagggatacagtctgcggttgatggagcaggaaatgaaggtgtactgtattgtcatttttgtcataaattgggcaaaacacatatgtacggatctctaatagttttttgttttgttttgttttgttttttgagacagagtctcgctctgtcccccaggctggagtacagtggcgcgatctcggctcactgcaagctccgcctcccgggttcacgcctttctcctgcctcagcctaccaagtagctgggacttcaggcacccgccaccacgcccgactaattttttgtatttttttagtagagatggggtttcaccatgttagccaggatggtctcgatctcctgacgttgtgatccgcctgccttggccttccaaagtgctgggattacaggcgtgagccatcgcacccggccggatctataatagtttttaaaactatattaatatattaacttgaattggcaatttaaaaattgatcttcatggaatctctgaattagattatccttttttatgactttctaaagagaaatcatcctggtaattttatttgatattttctcttcccattgcacaccttgttttactaatatttcttttttctttatatatatttttttgccatcaagatcactgtggtaaggaatattattttgttgatttaatatttcttatttttcccaggctgaggcagctaaattagttccaatgggtttcaccactgcaactgaattccaccaaaggcggtcagagatcatacagattactactggctccaaagagcttgacaaactacttcaaggtgtagtaatcctttatcctgtgttgtgaactctagttaggaaagcttccaggttataaaacaaaactgaaatatttgtgtagcatttccttgttagataatgataaagagatagaggaaggccaggtgcagtggcttatgcctgtaatctcagcactttgggaggctgaggtgggcagatcacctgaggctgggagttcgagaccagcccagccaacatggagaaacctattaaaaatacaaaattagttgggcatggtggcacatgcctgtaatccctgtaggtgcacatgcctactcgggaggcagaggcaggagaatcacttgaacccggaagacggaggttgctgtgagccaagattgtgccactgcactccagcctgggtgacgagcaaaactctgtctcaaaaacaaagagagataaaggaagtatccacattgaagaggtaagactgctgcaaggtaggaccttatttataaaatactaaacttatctgcaaattaaataatttagtctccatttaatattgtgttaagagagtaagctccttttgcttaaggaggtaactgtaattataacctactctaccacagggttgaaaacctgatgactggttaaaacattccatgtttgaatactactcattgtgtacacactaatcttcaggacttcagggaaaactataaagcttttgaccttattatttatttttcgagacagggtctcactctgtcacccaggctggagtgcagtggcatggtctcagctcactgcaacctctgcttcctgggctcaagtgatcttctagcctcagtctccccaagctaggactatgatcatttaccacctggctaattttttttttttttttttttttttttgagtcggggcatcactcattatgttgcccaggctggtctcaaaatcctgagctcaagccatcctcctgcctcagcctcccaaagtgctgggattataggcttgagccaccttgcctggcccaatgtcagttttctttcccttttttttgagacagagtctcactctgttacccaggctggagtgcagtggcataatctcagctcactgcaacctccgcctcctgggttcaagtgattctcctgcctcagcctcccaagtagctgggactacaggcaagtgccaccatgcccagctaatttttgtatttttagtagagatgaggtttcaccacgttggctaggttggtctcgaactcctgacctcagatgatctacccgcctcagcctcccaaagtgctgggcttacaggcgtgagccatcatgcctggcccccaatgtcagttttctaatatcagtgctatactatcattatgcaagaggttaacactgcagaaggctaggtgcatagaaatttcgtatgtttttttttgttgttgttggtttgtttgtttgttttttaaagacagagtcttgctctgttgcccaggctagaatgcagtggcacaatctcggctcattgcaaccactgactcccaggtttgagcagttctcctgcctcagtctcctgagtagctgcaatgacaggcacccgccaccgtgcctggctaatttttgtatttttagtagagacgggatttcaccgtcttggccaggctggtctcaaagtcctgacctcctgatccatccacctcggcctcccaaagtgctgggattacaggcatgagccactgtgcccagcttttttttttttttttttttttgagatggggtcttgctatgtcaccccggctggagtgcagtggcatgatcttggctcactgccacttccgcccccaggttcaagctattcttctgcctccgcctcccgagtagctgggactacaggcatgcaccaccatgcccagctaatttttgtatttttagtagagacagggtttcaccatattgtgcccagcttttttttttttttttttgaggagtctcactttgtcacccaggctggagtgcagtggcgtgatctcggcttgctgcagcctccgcctcccaggttcaagtgattctcctgcttcagcctgctagtagctgggattacaggtgcccatcaccagttccagctaagttttgtatttttagtagacatgaggtttcaccatgttggccaggctggtctcgagctcctgacctcaggtgatcagcccgcctcggccccctaaagtgctgggattacaggtgtgagccaccgcacctggccttatttgcagctatctataaatctaattatttcaaaatacttttggtttatttgtttgtttgtttgtttgttttgaaacagggtctcactgtgtcacccaggctagagtgcactggcacgattttggctcactgcaacttctgcctcccaggctcaagtgatcctctcaccttagctcctgagtagctggtactacaggcatccgccaccatgcccggctaatttttgtagagacagggcttcaccatgttgcccaggctggtctcgaactcctgaactcaagcaatccacccacctaagcttcctaaagtgctgggattacaggcatgagccaccacggctagcctcaaaatacatttgtgaaaaattatcgcttgttggaaattgaatttttaacttacataaacatctttctgatgagctccaagaacatttctatgactacagtttctacatgtttgtattatgctaagagttatttcttatcgcttttttaggtggaattgagactggatctatcacagaaatgtttggagaattccgaactgggaagacccagatctgtcatacgctagctgtcacctgccaggtgagctgttggggctatagctaatcaaataagcaagcattacttcattcctgctatttgcaagcatctgttaggatggccataaaaggtactttctctgtcctcaagaatcttatagctgttaatagttagaagatagactcctacttcaaaatccttccatgtcatagaaacttccaaatcattgatctcctatcagatacgttaatttcaaatacttttgctaccaggccttttcctggctttacttgctactttttttttttttttttttttttgaggcagaatctcgctgtgtcgcccaggctgaagtacagtggtgtgatctcagctcactgcaacctcctctctggttcaagtgattctccttcatcaacctcccgagtacctgggattacaggcgcccaccagcatgcccggctaatttttgtgtttttagtagagagggggtttcaccatgttggccaggctcctcttgaactcctgatctcaagtgatccacccaccttggcctcccaagtgctggaattataggcgtaagccactgcgcccagccctccatcttcttcattagtctagattttatgattcatcattaaagtaattctcttgcagatagcctcagtttacatacccacttgaagagatgccaaccttagatgaaactcatctatcttctcagtgtctgtacccaaatagctgattatactggagaaaaatcgtatcatacagctgactgacttcactttaaattcaagatgacaggccaggcacggtggctcacgcctgtaatcccagtactttgggaggccgaggcgggtggatcacttgagatcaagagtttggctgggcgcggtgactcacgcctgtaatcccagcactttgggaggccgaggtgggcggatcacaaggtcaggagattgagaccatcctggctaacacagtgaaaccccatctctactaaaaatacaaaaaattagttgggcgtggtggcgggtgcctgtagtcccagctacttgggaggctgaggcaggagaatggcgtgaacccgggaggcacagcttgcagtgagccgagattgcgccactgcactccagcctgggcgacagagcgagactctgtctcaaaaaaaaaaaaaaaaaaaaaaaaaaaaagaagaagaaaaaaaaaagatcaggagttcaagaccagcctggccaacatggtgaaaccctgtctctactaaaaatacaaaaattagctgggcgtgttggcacgtgcctgtaatcccagttacttgggagactgaggcaggagaatcgcttgaacccggggggcagaggttgcagggagctgagatcgcaccattgcattccagcctggtcaaagaagcgagactctgtctcaaaaaaaaaaaaaaaaaaaaaaagaatgaaaaaaggaaaaaaattcaagatgacaaaactttagattaacattcaaaacttcttggcagtctactttctccatttaggtgtactttcccactgagttagacaggcatctcatatctcatacttcgtcttctgttatcagaactttatgctcctcttcaactctcattcttagccaaaaacctaacctgctctttgcatcaaatctacatttgtgcccatcttttcttatctcaggttacaattgagaaagtgtcccttttcttctcaaaggcccattctatcaatatgatttggttaccatctcctgccaccttctcaaggactctactccttccattttctcttgtacctctctatgagattatcctcatcagtatacaaatatgtctagtgtctcctccattaggaaaaaaccttccctggaccccttcagtttctttttcctttacttatgctcctattggtgggaagatttggaaatagacacagtaggttaaataattgcccaatacattgtatttaagtagcaaatactggactcaaaccagacttcagagatgatgttcttaaaacttcataagaggccagcatggtgtttcatgcctgtaatcccagtactttgggaagccaaagtgggaggattgcttgagaccaggaatttgagaccagcctgggcaacatagtgagaccctgtttctgagatgccatttctaaaaacaaacaaacaaaaacagacaattaaaaatattagcccagcatgatgatgtgtacctgtggtcctagctactcaggaggctgaggtggtagaatctcttgagcccaagaggtcgaggctccagtgactgggatcgtgccactgcatgttttctgctgtattgctagtgcctaaggcagtgtttggctctcagtaaacaataaatgcttgaatgagtggagataatagatgtccaaaaacatgcctgatatataaaatgaatgtcacagaggaaatgggttagctgtttaaggaatagaaaggggtaatttcaccctagagtgatcatggaatactttatggagaaaagattttggaccagacttctgaagaatgctaaatttgggaaggaaggaaattaaaagcatttaactgtatagaatgggatgaacagaggatgggaaggcataagttagaaggaaaagacaataaataagcaaggtcatttaactggtttagagtttgtgtagaaaagttgtaggagatgacccttaaaaagatacatcaaactgggcatgatagctcacacctgtaatcccagcactttgggaggccacggtgggtggatcgcttgagctcaggagtttgagaccagcctgggcaacatggcaagaccctatctctacaaataatataaaaattagccagacgtgggctgtgcctgtagtggcagctacttgggaggtggaggcgggagaatcgcttgagcccaggaggccaaggttgccatgagccaagattgtaccactgctctccagcctgggcaacagagcaagattttgtctccatctcaaaaaaaaaaaaaaaattaagatcctatttcagaaggttaagaagtttaaacttgattttatgaagagtaagcattagctggtcaggaaactaagatagtgacaataaagagaagtagggaaaagatgttgtaaagggcagcgcttgatgactgacaataaaaaatacacctcagcccaacaatgtattacagtaacttagtaaacctaaaaagtgtttgagaggggaagacagttttgttggaaacatgagtacaggtttagagatgacaggtttgaggtgacaaaccccgagtgaaaatttctagctgtattgagagatgtggaactaagtcacacagagaagtaaaaatggaatctggaaacgaaagatccatgagaaaggaagggagtaggatatagaagagaaagctaacaaactttcatcttttctgcaacttcaggcagtgtaatggggagccgtttttccttgtctaagtgagtcttaatgttctctggctttaaggatgtgctgcataagtggccagtccacaaagtatccttgaacctggcccatgcccatggaccaactcttctgttataatcttttgaagctttattataattttagttattttgaaaaacatggcattattttaatctagatagattatacccacttctgccatgggcacaacttactgttggagatcaaaacaactgaaacaaaatctgccttatatcagtgttacagaagaggcttcctagtgtttttctatcctcgggactcaactctgttgagtttttttttcttttcttttctttttttttttttttttttgagaaagagtcttgctctgttgcccaggctgtagtgcagtggtgtgatcttggcttgctgcaacctctgcctcccaggttcaagccattctcctgcctcagcctcccgaatagctgggattacaggcatgacggccaccacgtccagctaatttttgtatttttagtagagacgaggtttcaccatgttggccaggctggtctcaaactcctgacctcaagttaatctgcccgccttggcctcccaaagtgctgggattacaggagtgagccaccgtgcctggcccaagtttatttaaatttaacatcaagtaacctagcttgatagcctcccatttttcttattttcctttttttttttttttttatttgagacggagtctctgtcgcctaggcaggagtgcagtggcgcaatcttggctcactgcaacctccatctcctgggttcaagcagttctccagcctcagcctcccaaactgggattacaggtgcctgccacccaacacagctaattttttgtatttttagtagagacaaggtcttgctgtgttggccaggctggtcttgaactcctgacctcaggtgatccacccgcctcagcctcccaaagtgctgggattacaggtgtgagccaccatgcccggctttttgttgtcattttaattgtttattgctccactgatattttctttgcagaccaaaatgttacaatttttttttttttttttgaggcggagtctcattctgtcgcctgggctggagtgcagtggtgccatctctgctcactgcaagctccgcctcctgggttcacgccattttcctgcctcagcctcccgagtagctgggactacaggcgcccgccaccacgcctggctaattttttgtatttttagtagagacaggttttcaccgtattagccaggatggtctcgatctcctgaccttgtgatccgcccaccttggtctctcaaaatgctgggattacaggtgtgagccaccgtgcctggctggctgccatatgtcttatgagacagccaagctagcatgtcagtatcgagtagacctaatccattgttaactctcctcagaaataaattcttttttttttttttttttgagattgggtctcactatgttgcaccggctgttcttgaactcctgagcgcaagcaatcctccaacctcagcctcccacatagctgggattacaggtgaatgcctctgcacccagatcctcataatcattaggaagaaagagctgagggggaggggtggaggaggatgcttaggagaccttttatgataataagggaggaaacattgagaagaggaagagtaagttatagaagctatagctattgcgtgagctccattagaaatttgatagctaaagggaattagggctgtttaaaatgtcactcttacatccgtcatttgacatgatatgtgacctttttaaatagaaatgttttcccatgttttgacagggacttatgtagaataagtatttagactacagtacataatatctatagttgccatggcaactcagcatagcatgctgacactccaaagttgtacaaatagaatcctaatctgagaatgtttaagtagtcagataatgtctgtcaacaataaactaaagcaaaattctcaagtaaatatagcctgttaaaataacatttacagatggctgaacaactatatagatcgttgactttttttaaagaaaaagaatgctaattaattaataatagaaaagattacatttcatcagcctaagagctggaaccagggatatagagaggatgttagactattacttaaatctaaatattatctactctcatttgttttctcaatttaatgaagtaaaaccccattatatgttaggtctctctctaatagaaaagtcataaagttgagagctacagttaggttacaaaatgaattagcccatgcttgttcaaagtactgcagtagttttaaaattctgggccgggtatggtggctcatgcttgtaattccagcactttgggaggctgaggccggaggattgcttgaacccaggagttccagacaagactggggaatatggcgagatcccatttcaattaaaaaataaaaacagttctgagaagacaatttaacataagtaccagttttaaaagcacatgcccatgcgggcatggtggctcacgcctgtaatcccagcactttgggaggctgaggtggatggatcacaaggtcaggagttcaagaacagcctggccaagatggtgcaaccctgtctctactaaaaatacaaaaattagccaggcgtgggggtgggcgcctgtaatcccagctacttgggaggctgaggcagagaattgcttgaacctgggaagtggaggttgcagtgagctgagatcgtgccactgcactccagcctgggcaacagagtaagattctgtctcaaaaaaaaaccaaaaaccaaaaaaccacaaaacaaaaaaatcacataccctttgacagaaaatttgtcttacagaacatttcacatatatgcaaagataaatgtacaaataatttataccaaagcataattaaaatggtaaaagttagaaacatactgcatcactataaaatgagaagtgttaaattatgctcctaagcagttattaagaagagctaacctgatggtatcccaatccagtaacagaagatggctatgatggcactgggagggcaaggtagaaagggccaaataagctggagaacagagcatgcaatccatccccatgatcttaccctgggagcttgtccactatcctgttgtcagtctacctacctattcccaatcatctgtggcctttcctttgccaaggaagtctattcaattggaaaagaatcccctgtcatgttagcacttaatattacctggaggtaggagaaaggagaacttcgttcatcttatttcctggggacttagtccccagagtgttaatatttcctcctctccaagaaactgaggcagattctgctctctgtcctcttggccactggttccaagtctttctttaggcatgaccctcttttgttgtatatgtgtcctttgctccttccatggattcccatgatgtgagagattttatctgccaaatagtaacgtaatttttcccttccaaattaacaaagccttccgtaactgtatacactaaagtcagtgccctaaaggttgggaaaatcatgtcttcagagtgtaccgtgctaaacgctttacatgaattattttatttagtttttaaaacaatcccataaggtcggttttatttacattttacagaaaaggaaacaatattctcagtcacatagtaagtggaagaaccacttatataaaagaagtatatgaaaatgcatagaaaataatctgggaaattatttctgggagatggagagtggtgaagagctttcagttttttctccgccacttcctctttttttttttagacaaagtctcactctgtcacccaaactggagtgcagtggcatgatatcgctcactgcaccctccgcctcccaggttcaagtgattcttgtgccccagcctcccgagtagctgggattacaggtgtgcaccaccacgccccactaatttttgtatttttagtagagacagggtttcaccattttggccaggctggtctcgaactcctgacctcaggtgatccactcgctgggattacaggtgtgagcccccatgcctggcctctctacttctttttttttttttttttttttgagatggaatctcgctctgtcacccaggctggagtgtagtggcacgatctcggctcactgcaagctctgcctcccaggttcacgccattctcctgcctcagcctcccaagtagttgggactacaggtggccgccaccacgcccggctaattttttgtatttttagtagagacaaggttttaccatgttagccaggatggtctcggtctcctgacctcaggtgatccacctgcttcggcctcccaaagtgctgggattacaggcgttagccactgcgcctggcctccggccctctacttttatattgtttagatttttaatataagcatatagttgttttgtaatttcaaaaaaaaattctcaaagataagaaagaaaatttgggctgggtgcagtggctcacgcctcccagcactttgggaggccaaggtgggtgaatcaccttaggtcaggagttaaagaccagcctgaccaacgtggagaaaccccatttttactaaaaaatgcaaaattagccgggcgtggtggtgcatgcctgaaatcccagctacttgggaggctgagggaggagaatcccttgaacccgggaggcagaggttgtggtgaggcaagatcatgccattgcactccagcctgggcaacaagagcgaaactccgtctcagaaaaaaaagaaagaaaaaatttggttctcctaggcctttaacataaaatgttctaaaggattttcctcataatttaaatgggaattatgactccaaagtagatttctagagtagaaattaccctttagcatcattcacttaaactttgtagaaaaattcaaaggtatctggtatggaatgggtagtctaaagcagagatttccttgagtggctcataagacagttttcatggcatttcatttacttctcttttctttcctttttgttttctctttaaaattctttctacttatttttctgttttctccaattgttcattttaaacatcttgtttatactattggagtaaatatgtttttttcttctttcttgctcacactcgaaatttgctatagacactccgagggcattgactagtccctttagtacccctaaagaatgaactgctcaataaagtgaagtataagtttgatatagacatgctaaaattaactgggctttggatcatggcccattattgattaaagctaaggtaaatggtcttccaagtttctgtacttttgaattgatcagtcttgtgttggtatgcagttctagaattttattactggccaggtgtggtggctcacgcctgtaatcccagcactttaagaggccgaggcgggcagatcacttgagtccaggagttcaagaccagcctgggcaatgtggcaaaaccctatctataaaaaaatttaatcgggtgtggtggtgcacacctatggtctcagctatttgggaggtgagatgggaggatctccagagcccggaaggcagaggttgcagtgagccaagattgcaccactgcactccagcctgggcggcggagtgagaccctgtctccaaaacaaaaaaaggccaggtgcagtggctcgtgcctataatcccaacactttgggaggccaaggcaggcagatcacctgaggtcaggagttcaagaccagcctagccaacttggtgaaaccctgtttctactaaaaatacaaaaattagctgggcgtggtggcatggacctttaatctcaacaactcaggaggctgaggcaggagagttgcttgaacccaggaggtggaggttgcagtgaaccgagataacgccactgcactccagcctgggcaacagtgagactatcgcaagaaaaaaaaaaaaaagaagaaaagaattttattacctactttgggctatatttctaagcagtccagttctgacaggactagctgtatgtactgagacacaatcagctttacatatttttctagctgtatttctattaatatcagaagggaatgcctccttcctaccactgtcatttttaaatgtttttttccctttgccttggaggaattataaagatgtcatgaggagcttggtcagctgtatcagaaatacaatgttcatttctactgttgtttttgttctctatagcttcccattgaccggggtggaggtgaaggaaaggccatgtacattgacactgagggtacctttaggccagaacggctgctggcagtggctgagaggtaggttactggtttagataagagagactatggctacacttatcaatgtagtgattgccagggttagtttggccgaagaatgtctcttctataaccccacgtcccaaagttgtatgtgtggttcaaaagaatgacttccttagtagaaaaaggcattcttttttttttttttcttcagatggagtctcgctcttgtcacccaggctagagtgcggtggcgtgatctcaggtcactgcaacctctgcctcccgggttcaagcaactctcccacctcagccttcctagtagctgggattacaggcgcacaccaccacacccagctaattttttgtatttttagtagagatggggtttcaccatattggccaggctggtctcagactcctgacctcaggtgatccacctgccttgacttcccaaagtgctgggattacaggtgtgagccaccgcacccggccagaaaaaggcattctttagagttgctgtcagactggatttaaaaaaaaaaaatccaactatatgttttcttccagagaaaccctttagaaagtaaaagaatggagaaagatattgcatgcaaatagtaaccataagagacactgcgtggctatactaatatcagacaaagtacactttaaggcagacacattggctgggcgctgtggctcacgcctgtaatcccaacactttgggaggctgaagcgggtggatcacgaggtcaggagatcgaaaccatcctggctaacacagtgaaacctcgtctctattaaaaatacaaaaagttagccgggtgtgttggtgggtgcctgtagtcccagctactcgggaggctgaggcaggagaatggcctgaacccgggaggcggagcttgcagtgagccgagatcgcgccactgcactccagcctgggcgacagagcaagaatccgtctcaaaaaaaaaagacaaacacattatatacaaagaggaacattttataattaaaaggtcagtttgtcaggaagatataacagttgtaaagatacacacacgcctaacaacaaaaccccaaaataacatgaaacaaaaactgaattaaaggggaaaatagacaactcatcaataatagtaagggaccagtttttcattttcattaatggatacaggcttcaatatttcactctcaataatgaatataacatgtatcagaggccctgctaaagggcatctgtgaaaaacctacaggtagcatcatactaaatggtgctctgttacccaggctggaatgcagtggtgctatttcggctcactgcaacttccacctcttgggttcaagtgactctcctgcctcagccaaaaattagcctggctaatttttgtatttttagaagagacagggtttctccatgttggccaggctggtctcaaacctgacctcaagtgatctgcctgccttggcctcccaaaagtgctgggattacaggtgtgagccactgcacccggccttaatggtgaaattctgaatgcttttccccctaaagtcagtaacaaggcaaggatgcccactttcactatttacattcagcaatgtaccaaagattatagacagtgtagtcagacaagcagatgaaataaacggcatccagattggaatggaagaaggaaaactatttgctaatgacatggtgccatatgtagaaaatcctaaggaatccatccacaagaaaaactagaactaaataactgttcagcaaagttgcagaatacaatatcaatatacgaaaatccattgtatttgtatatactagacaataacaattcaaaagtaaaacttgaaaaaaaaacttcattcacagtagcaagaaaaagaataaaatacttaggaataaatttaacaaaagaaatgtaagatttgtacagcaaaaactctgaaacattactgagaaaaattgaagatttacataaagagaagcattccacatcatggatgggaaaactcaagattactaaaatggcattcttggccaggtactgtggtgcacacctgtaatcccaacactttgggaggccaaggtgggcggatcacctgaggtcaggagttcgagaccagtctggccagcatggcaaaaccctgtctctactaaaaatacaaaaattagccaggcatggtggcacactgcctgtagtctgagctacttgggagggtaaggaaggagaatcacttgaaccagggaggcagaagttgcagtgacctgagatcgcgccactgcactccagcctgggtgacaaagcgagactctatctcaagaaaaggcagttctcctcagattttatctatagattcaacccaatccttatcaaaattccagcaagctttttttgcagaaatttacaaagtaatcataatatttatggaacataacgtggaaatgcaaaggacccagaatagccgaaatgtctggaaaaaaaagaaaatttgaggtcttagactttttggtttaaattcttattataaagctacaataaccaagacaatatggtgatggcatatggataaatatggagagttcggaaatgaaacctttatggtcacttcatttttgacaaaggtaacaggcaatttttttaaaatttaaaattttttacaaatacacgtggtctcgctgtcttgccctggctggtctcgaactcctggcctcaggtgatcatccctactcagcctcccaaagtgttaggattacagatgtgagccactaaacctggctgacaaggcaatttaatgagggaaaaaatggtcttttcaataaacagtgctgatgtagatgaatttccaaatgcaaaataactttagacccttactatataccacacataaaaattaaaatagataacagtgtggtcattcctcaaaaaattaaacacagaatgaccatgtgatccagcagttccatttccagctatataaagaattgaaaacaggaactcagatacttggacagcgatgttcatagcagcattactcacaatagctttggaaataacccaatgtccattgacaaatgaatagataaaatgtacatacacacaatgaaatatcattttagccttaaaaggaagaaaacacattttttttcttagacctagtcctgcagataaaaaggtaggaaattctgacacatgctattaacatccactaaccttcagggcattatgctaagtgaaataatttagtcacaaaaggacaaaaactgaggccaggcgtggtggcttatgcctgtaatcccagcactttgggaggccgaggcaggtggatcaccttaggtcaggagtttgagaccagcctggccaacatggtgaatccccgtcactactaaaaatacaaaaaattagccaggtgtggtagcacagacctgtaatcccagctactctggcggctgaggcaggagaatcgcttgaacctgggaggtggaggttgcagtgtgccgagatcatgccattgcactatagcctgggcaacaagagcgaaactctggctcggggaaaaaaaaaaaaaaaaggacaaaaactgtatgattccactaacatgtggtacttcaaaatcaaagagacagaaagtagaatggtggttttctgggggtagggagactggggagttgttgtttaatggtacagtttcagtttgggatgatgaaaaagctctggagatgaatagtggtgatggttgcacagcagcatgaatgtccttaatgtgcctgaactgtatactttaaaatagttaaaatgctcaatttaatgttatatgtgtacgttttactatactgtttttagaagggtgatagtcctaaataagagcctaactataatttttcagagagaacatgggagaaaatcttagtgaccttggggtaggcaaagatttattagctacaacaccaaacacacagtccatgaaagaataaattgataatagagttagttttcacttcatcaaaattaaaaacttctgtgcttcaaaggacactatgaagcaagtgaaaagataacccaaagaatgtgagaaaatatttgcaaattacgtatctgataaatgtctagtatctagaatatataaagaactattataacccaacaataaaaagataacccagttgtttaaatgggcaaaggatttgaatagacatctctccaaagaggatatacaaatggttgatgagcacataaaaagatgctcaacatcattagtcatcaggaaaatgcaaattgaaaccatggtgagctaccacttcacacccactatgaaggctataataaaaaagatggtaacaaatactgggaggatgtagagaaactggaaccctcatatactgctggtgaaaatatacaacggtggtctctttgcaaaataggtggcttcttaaaaagttaaatataaatttaccatatgatgcagcaatttcactctagttatataccccaagagaaataaaaacatgtctatacaaagacttgtatgataatgtttatagtatcattataatagcccaaaatgttcatcagctggtaaatgaataaacaaaatttgttttctccatacaatgggatactcttcagcaataaaaaagaacttaagtactgatacgtgttaacaacatggatgaggtttcaaatatgctaaatgatagaagttaaacacaaaagaccacacaatgtatgattccatttatatgaaatttccagtaggggataatctaagggatagaagaattgtggttagtggcgataggaatgaggaataactgtgaatgaagttgagagattttttaggggtgatgaaaatgctctaaaattggattgtgttcatggttatacaactctgcaaattcactaaagctctcaatgaattttatacttacagcaggtcatttttgaggtatgttaattatacctgagtaaagctcgtgaagagtttgtaagtttctatatcaaataaagtttttaaatacatcctcaaaactgtttcacttcttttcctttgtctagggtcaaatgtggtaatttagtccctgccacacattttatggaaacccagtgataaaacaatttaattgtctgctgagatgtcagactcaagttggaacctgcctaaatgaggagaatattctctctcgttttataatcgaattatctttcccagcttataatttgagaactgcaacctattgaatgtataccactgaagcataaaattaggttggaatggtaattgcagctttttgtctctgcctacaaaattcctatgaaggaaaaggaattactcttttgcagtctgatcttagttttctgaggatgtatatacttaattgtgtcttccctctcaaaattgttttggcaatcatgtacagcattcatacttttaagtatactgttttagtagtttaaggattagcttttggacagagtcactaaaacattctcttgtaacataaataagtattcagataggatagatgacctagtagaatataggctatgaggacaagaactttgatttggtcacctattggatgcccaagcagtagagcaatgcattcaggatttgttaatgaatattttgctgacaaaaaattttttgttgtttgtttttttagagacgggtctcactctgcccccactagaatgcaatggtgcaatcatagctcactgcagcttctaactccagggctcaagcagtcccccctcctcagtgtagctgggattacaggcacacaccaccaagcccagctaatttttttatttctttttttttttttttttttttttgagacagagtctcgctctgtcgcccaggctggagtgctgtggtgcgatctcggctcacgcaagctccacctcccaggttcacgccattctcctgcctcaacctcccaagtagctgggactacaggcttccgccaccacacccggctaatttttttgtattttttaattttaattttttttaattttttttaatttttttttttttttttttttgagacagagtctcgctctgtcgcccaggccggactgcggactgcagtggcgcaatctcggctcactgcaagctccgcttcccgggtccacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcctggcctatttcttatttttgtagagatgaggtcttgctgtgttgcccaggctggtctcaaactcttggcctagagtgattctccctcctcggcctcccaaagtgctgagattacaggcaggcataagtgactgtgcctcgctgaaaaatatgtttacatagaaatttcattaatttgttttaatcaggtctctttatcaagaaaaaaattttataattgaattatatttctgagaatgtcacaaggcctccttaagctaataaaaatagccctctttcattcacaacaaaagagcccttactgattaatttttgccgtgccctgttgaagaatattagcccacatgcatgttactgtagctctggggttcccagaacatggtccccagaacagcagcattatcattacttgagaacttgttagaaatgcaaattgtctgatgggacttcagatctactgaatcagaaacaatcagatactcgggctagcaacctgttttaacaagctctccagggccagacacggtggctcacgcctgtaatcccaacactttgggaggccaagggagtggatcacctaaggtcaggagtttgagaccagcgtggcaacatggtgaaaccctgctctactaaaaatacaaaaactagctgggcatgttagcgggcacctgtaatcccagctactcgggaggctgaggcaggagaatcacttgaacccaggaggcggaggttgcagtgagccaggatcgtgccactgtactccagactgggcgacagagtgagactccatctcaaaaaaacaaaacaacaaaaaaaaatgcaagctctccaggtaatctgatgcttgctaaagtttgaaaaccatgaccacaattgctagcctttcttgaaagtctgaagtactgtgaaagaatgacagaactcctttgagatgagcttagtttttcaaacttatatgttaagaataacctgaggtatttgttaaatatacagattaccaggctcttccctgataattgtaattcattgagtctaggttaggcccaggaattttttttttttttttttgagacggagtttcactcttgtctcccaggctgccaggctggagtacagtggcgtgatattggctcactgcaacctccgcctctcgggttcaagcgattctcctgcctcagcctcccaagtacctgggattacatgcgtgcaccaccacacccatctaatttttgtattttttaagtagagatgggttttcgccttgttggcaaggctagtctcgaactcctgacctcaagtgatccgcctgccttggcctcccaaggtgctgagattacaggcatgagtcaccacagcctgcccaggaatttgttttctaacgggtgttccaggttattatctttaaggaagttcaagaaacactatgaaagaggatgctatggccgggcgcggtggctcatgcctgtaatcccagcactttgggaggccgaggcgggtggatcacaaggtcaggagatcgagaccatcctggctaacatggtgaaaccccgtctctactaaaaataaaaaaattagccaggcgtggtagcgggtgcctgtagtcccagctactcgggaggctgaggcaggagaatggcgtgaacctgggaggcggaacttgcaatgagccgagatcgtgccactgcactccagcctgggcgacagagtgagactccgtctcaaaaaaaaaaaaaaaagaggatggtatttccagccaacttgtcccaagctgtgggaattccatgtcctgcttctggagcctaagcacagaggttcccatagttttttttgtgagtgccgctgagagaaaagctaggataactctttattctggtaaaccttctctgtttttatagcaaatagataatctccctttcttttttaatttttaatttttttttaattttataaatagagatggggttttgccatgttgcccaggctggtctcaaactcctgagctcaagcaatcctccccactcagcctcccagagtgctgggattacaagcatgagccaccgtgcccagccttttctccctttctgatagtagattatatcagtgtatttttttgttcgtttgtttgtttgtttttgagacagagtcttgctctgtcacccaggatggagtgcagtggtgcgatctcggctcactgcaacctctgcctcccggtttcaagcgattctcctgcctcagcctcccaagtagctgagaagcagggattacaggcgcctgcaaccaacccggctacattttgtatttttagtagagatggtgtttcaccatgtagtctaggctggtctcaaactcctgatctcaagtgatctgcccacatcagcctcccaaattgctgggattacaggtgtgagccactgcgcccagccatatcagtgtttcttgaggcagaactagaagacttgtgcagtaaagtacttacacctgttacatcttttttttttcaccatacattcatgatctaaatagagaaaacttatatctcttcattcttgttttatttggtcaggatcgtaaggtgtaactctatcctaatgccatctgtttatcctcatgacagaatcgtgaacctagaacataatcatagcacactgggttttatgtaaacattctctttttttttttttttttgagatggaatctcactctgtcacccagtctggtgtgcaatggtatgatctcgactcactgcaacttctgtctcccgggttcaagcgattcttctgcctcagcctcccaagtagctgggattacaggtgcctgccaccacgcccggctaatttttgtatttttagtagagatggggttttgccatgttgaccaggctggtctccgactcctgacatcaggtgatccacctgcctcggcatcccaaagtgctaggattacaggcgtgagccaccgcacctggccctcaaagaataggtttgatttaggtcaggcgtggtggctcacgcctgtagtcccagtattttgggaggccaaggtgggcggattatgagatcaggaggtcaagaccagcctgatcaatatggtgaaaccctgtctctactaaaaataaaaatattagctatgcatggtgctgcatagctccatgctactttggaggctgaggcaggagaatcgcgtgaacccaggaggtggaggttgcaatgagatcacgccgctgcactccagcctgggtgacagagcaagactccgtctcaaagaaaaaaaaaaaagaatggatttgatttatcccaaagacttgccaggtagagctccagagtagttgggtgctatcatctctctgcttatagtttgcctgaacttcttaatagaaagggaaatacattctttggtcctgaaactactgtcagtaccacttcttccctacctattcaggtaatttaagtgtcagaaacaaattgctcatctgcctgagttctgtgtgcagcctaaaaatgttctctcctctctcataggtatggtctctctggcagtgatgtcctggataatgtagcatatgctcgagcgttcaacacagaccaccagacccagctcctttatcaagcatcagccatgatggtagaatctaggtatgtgttcagtataagacaccaaatatgttcttaagagtccttccctgaatcttgtaatggctatttggccagattgatagtagtttgaattagaaatgaggaggtttaagtataattcctgtgttgacactcttgctttgtagtttaggtcaagtcactattaaaaatgaaaccataatctacttgaacttgctggaaatcttgttaaacggtgcctcagatgttagtactgtgcaaatattttaataaaacatctatatacaggccgggcgcggtggctcaagcctgtaatcccagcactttgggaggccaaggcgggtggatcacaaggtcaggagatcgagaacatcctggctaacacggtgaatccgtctctactaaaaaaatacaaaaaaattagctgggtgtggtggcgggcgcctgtagtcccagctactccggaggctgaagcaggagaatggagtgaacccgggaggcagagcttgcagtgagccaagaatgccccactgcactccagcctgggcgacagagctagactccatctcaaaaaaaaaaaaaaaaaaaaaaaaatctgtatacaggaaaaactatgaatatgagattttagggtggtaaggaagggaccagaatctgacacaggctagaaataggcttcagagaatccttgtttcctgtaggtatgcactgcttattgtagacagtgccaccgccctttacagaacagactactcgggtcgaggtgagctttcagccaggcagatgcacttggccaggtttctgcggatgcttctgcgactcgctgatgaggtaagttgtgggatagggacagagaatgcctactttcagtggctgtgaattccaggagccttgctaggaggctaagacatcagtgcctgagatcatcaagctcttaggaagaagagagacattagttattcgttattttgtgggggaaagtggtggcagcattaaggcttttggagtgtctatggccacaaaattgacatttatcctttccccatcagtttggtgtagcagtggtaatcactaatcaggtggtagctcaagtggatggagcagcgatgtttgctgctgatcccaaaaaacctattggaggaaatatcatcgcccatgcatcaacaaccaggtaaggtgttgatgggatcagttcttcttttcggaatgtcatattaactgtgaagacatgaagatataacattttcatttaagccctgttaaagctactgttgtatagacacttaggaactcttgctaatctaattaacatgctctcgttggtatagatgttttagttcataaaagaattaaaaacccacaagtgtggaagaatgaatatgagtaattgatatgcctctcccctgttatttaaaaaatgtttgggctgggcacagtggctcacactggtaatcccaacactttgggaggccaaggtgataggatggtttgaggccaggaattcgacactagtaagggcaacaaagtgaggcctctgtctctacaaaaaaaagtagctggtgtggtggcgtgtgcctgtagtcttagctacccaggagactgaggcaggaggatcagttgagcataggaattcgaggctgtattgagctatgatcacacatcactgcactccagcctggcaaaagagcaggacactgtcttgaaaaaattttttttctttttttttttttttttttgagatggagtctcgctgtgtcacccaggctggagtgcagtggcacgatctcggctcactgcaagctccgcctcccgggttcacaccattctcctgcctcagcctcccgaatagctgggactacaggcacccgccaccacacctggctaatttttttgtatttttagtagagatggggtttcacagtgttagccaggatggtctcgatctcctgacctcgtgatctgcccaactcagcctcccaaagtgctgggattacaggcgtgagccaccatgcccggcctaaatttttctttttttaatgtttgtttcaatatggacaatccactgagaggggccagggcaaaaatggattctgccaggttggaaatgcactaaggaaaacagtacagaaacattcccagggtccttctaggaagaatatatgtctaaaaaattttcagctctgttacaaagtcaggaacggaattgtttaattataataaattggtgctttggtctgtgtctttgggtcagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacca

SEQ ID NO: 94 - DNA, 863340 bp, Homo Sapiens
gttgctttgcggcgttttccgcggggaaactgtgtaaagggtggggaaacttgaaagttggatgctgcagacccggtactggaaagtttcatgtggggtgccgttgtggggaagtggggttcgctcattatttcctgctccttccctaggctcgtgggtttcgatattgggggagcggagattttctcttgggtgctggtcacgcccccttaagactcgggatcgtcactaagaaccccgctgtgaattgggggagcttcgggccttcttttggtggggaatgcttggaagctgctcattgttggaaaaagctctttttaggggattctgggtgatgtttccgcctgttgctgcccatcttcctccccagccccttcccgcttcgggcagcctgtcattaggggaagttgagggactctcccacttcaggtggtgttggagagcgtggaatctggagtccggtccctggattcgaatgcgagcttcacaccaattgtcagctgtttaactttgcccaagtttctcaactagttacctcagtatccttatctgtaaagtgaggtaaaatatccgaagcctttggaacagtgtggcacgtaataagggctcaataaatattagctaatattgttcctaaacagttgttgaacatctaacatgaagaattttcttttcttggtggtaaggaggacagggttcattctccagggttgaccgtctcccctcatgtgcaatacacatacgtgctttcgcgcacacatacaccgcaggaatttacgtgctccggtgggggcaaacaaacttgcaagccataatagtattttgataagattatcgaatagatatgtgcgaagttgatgagaacattggagaggaaaagacttgactctggggaaggttttgtggagggaagtcagggagacaggatgcgtgacctaccaatacacataccatgtggctggagggcagatcatgtgagagtcattaaatgatgattgctgaccttaagtactatgtgccacgcactccccgagtcctttaacctccactacagtcatatgaagtagtaaattcatatgactgtaaaacaagggttttaaggaaattaagacactgagaggtgaagtaactgccaggaaggataggaactgaacgttgcaatgtgatgtatgagtgagaaggaagtgagggaccaatttttgatgtttttctctgcgaccctaagaagtttggaatttatcctgtggtctaccagtcccatgggaagtgttaaaggataatcgtgactttttaggaagctactcaaggcaggattgtgacactgatctgacttttgcaggcgaatttggggcttcttcctgtctgcttccatagcacttttaaatagcaattgtaatgcttactgcatggctgtagttatttgtgtgtacctctcttttcatctcaactatgagtattcaaaggggagggaatatgcttaaatgattcttgtaccccagacctcagcagggtgtgtatttaaatgcctgtggaaggagtaaattaaggaacaaatgaatggagtggccagaaacaatatgcaatagtccaggcaagtgatgggagtggccctattaaggcagaaatggcagaattggttgttgttaaagtccttgtagtttagaatttatagttttttgtttgtttgttttttgtttttgatagggtctcagtctgttccccaggctagagtgcagtggcatgaccacagctcactgcaggctcgacctcctgggctcaggtgatcctctcatctcagcctcctgggtagctaggactactacaggtgtgcggcacaatgcccagctaatttttgtatttttttgtggagacaggttctctctatgttgcccaggctggtctcaaactcctgggctcaagcaatttgcctgccttagcctcccaaagtgctgggattgtaggcgtgagctaccttgtgtggcctatggttcttttctttctccttctttttttttttaaattgaatttatcagtctaaatggtgtcattacttgaaactacctgatctgaaaagacactaggcaatattatagcaggtatcacttggttttctactgggggaaacaagtcattgctaacaaattcccatggagagaaatgaggaggatgtatttttgtttgtgagaggtgtgtatgtatgtatattgtgtgtgcgtgtgtgtgtgtgtgagagagagagattgattcagtctgattcagagaatttaggtgttaaatagaaatttgggccatggtattggaaataaacaaatatatacattctcagtatacatatattttcattccaaaatgttacttcttttctgataactatattgctttattccttggatccatgaagagttcctgtttcagttcgttccagaggatacttctttaccatctcaatgagatatacagcttctcctttgtatgcattaagagactcacagtaattcttttttagctctgtgaagataaatctttcatgagcctcatttacccctagcaaggtacaatagtgaaatttaactgcatgtgagaatataagcagctagtgtaataaagaacattttgggccaggtctgatcgctcatgcctgtaatcccagcactttaggaggtcaaggcgagaggatcacttgagcccaggagttcgagaccagcttgggcaacatggcaaaaccctgtctctacaaaaaatacaaaaattgggcaggcatggtgtcgaccctgtctctacaaaaaatacaaaaattagccagacatggtggtgcacgcttgtggtcccagctacttgggaggctgaggtaggaggattgcttgagcccaggagggggaggttgcagtgagctgagatcgagccactgcactccagctggggtgacagagccagacctgtctcgctctctctctctctctctatatatatatttaaaaagaacattttaatactgcagtgataaaatctcatttgattcagaaggtgtgctctgactcctagaaaaaggaagagttaaatatgattatggacttgcagtagagtgtaatggttaagaggataggtttcagaattagactgcctggattcaaattctggatcagttatttatgttttctggtgacaatggactagctaacttttccaggctttagttttctcatatgtaaaaaaggggccaataatctactttccttctagggctattgagaagattaaatgtgataatttagataagttttggaacagtgcctggtatgtggtaggtgctccataaatatacctattgccgttacagtgcaatgtaaattgttacagtgcaatagactttctagtagttctgtttggaaatatgccttgaaagttaattacatttccaaataaaatttatacatgcattgaacattttaagatgctctacaaatgtgaagtggtactatattcatgtagtaaatatcaattaattgtgtgaaattatatttgaggttgccttgtagattttctatgtgcctgtttgacgaacaattgtccctcctatttaaaacatttaaaaaggttctatagcattcctttatcagtaatatttttaacacaatatgtttcattttgcatatggagaaacttgaggaatttttaattttgttttggatagcctattcactatcacttatgttatattctgttgtttttttcatggttcttcttttctttgctggatctggaggcatgggtagcaagaaactaaaacgagtgggtttatcacaagagctgtgtgaccgtctgagtagacatcagatccttacctgtcaggtaaattttatttaacatttttattgataagttttatgcacaagttaactttataccttaatacctcttaaacttgaaatatgaaaatgtaggcttacaaaaaaaagataaatgatggtgcttttccataggctaattgtaaatatcaagcctccttgggtgcatttccaactgctatttcatttacccaaatttagtatttttgcattttgaggggaaagtggtcacggcataaggtgaagtaacagctttactgttttatagttacatgagaaataggactcaaatgaggagatactattcaacatgtatcatttctcttaaaagcaaaagaaattaatagaccattttcttattgatggagcatgagaaatatatagagcggatcttgcatttttaagcaaggtggtgaagcaaatcctccttagcagggtaaataagatttaaaggttttggttggttgtttttgttctttgttgtttttgagactaggttctcatgctgccccagctgatcttgaactcctggccttaagcaatcctccagcctcaactcccagctagctgggattacaggcacacaccactgtgcctggctagatttaaggttttatcttaggattttatcctttttttgtttgtttgtttagagtcagtgtctcactctgttgcccaggctggagtacagtggtgccatatcggctcactgcaatctcctcctccccggttcaagtgattctcctgcttccatctcctgagtagctgggattacaggcacatgccaccacacccagctaatttttggatttttagtagaaacggggtttcaccatgttggccaggctagtctcaaattcctgatctcaagtgatccgcctccctcagcctcccaaagtgctagcattacagacatgagccaccgtgcctggcctgattttatctttaataagacattttcacagagcattctgcaattttttttttgaattgctttctgtgttaaagataacatcggttcctttgttatacatttaattatttgcatatttatactcggaaacattcttaaaagtatgaaatttgttatttcatcctatagtcagtttcattctttttcaactacgaaatattatctctgagtgaacttctagcttagaaagaaactctttcggccgggcacggtggctcacacctgtaatcccagcactttgggaggccgaggtgggcagatcatgaggtcaggagttcgagactagcctggccaatatggtgaactcttgtctctactaaaaataaaaaaaattagccaggcatggtagtgagtgcctgtagtcccagctactcaggagtctcaggcagaagaatcgcttgaacccaggaggtggaggttgcagtgagccgagatcgtgccactgcactccagcctgggcgacagagcaaaactcttgtctcaaaaaaaaaaaaaaaaaaaaaaaaaaaaaggaaagaaactctttcaacctgacactttctgggcatatatttatacccaaattctttttggcacaagtgtagcgctcatacgcacctggattggatgctggtgctatgtgatattatttggtgtatcctctggtatatgccaactaaacaggataattagaagataagtttgtgtcattacaacttttagttaaggcatatttatggggaaaatactacaatgaatgtataaatctttgatctgcgataaattatacttttgtctacataagcagtatcaattgaaggtttccttttaactctagtatctttgttacacatatatgtttaaaatactctctttatgtttctttaggactttttatgtctttccccactggagcttatgaaggtgactggtctgagttatcgaggtgtccatgaacttctatgtatggtcagcagggcctgtgccccaaagatgcaaacggtatatttatattttattatgatttgattatgaatgattcctcatctcattaaacatgtttttttagggatgaggcacatgcagaaatagagatgagtacctcaaaaatactgagttttctactatagaagttagttctctaaggaaaatacatgtgaaaattttttttttcttttttgagacgctctgttgcccaggctggagggcagttgcacgatctcggctcactgtagcctctgcctcctgggttcaagcgattctcctgcctcagcctcctgagtagctgggattacaggcacggtgctaccaagccaacttatttttatattattagtagagatgggatttcaccttattggccaggctggtctcaaacttctgacctcaagtgatctgcttgcgtcgacctcccaaagtcctgggattacaggcgtgagccaccgtgcctagcctatgtgtgaaaaatttatgtagtttataaactcatgggagacaatttctaaatatgggaattagggagcaacagaaagtttttatttttttttctatagccaatagcagtagttcaaaaggtcatctttctctgattgattaggtagtatttgatggcctcatagttaaattataatcttaattttagaatgcccctttctttgatatactgacctttaccatcatcacttgctctagatcataaagtacacataattgtacttgtagttgcttattgattgaataaaaggtaattaaaaatttatcctttactcttaagaaaatttgaagtcttttacaaaagccctcatcaaattgtacattttttcagactttttgtgtcatgactgtagcttttcaaaatgtagatttggagcatgatagaaatatcttgttttctcacagtaagagtttcctaaaattctgttcggtgctttgcaaatgtatttatttatgtggactgtaagtttcttaccttactgccttatattgaaatttactgaacactgaacaatgaagtacaattctctgaagaaggggagaaggaaggaatgttagtgtcactggaaacttctaaaaacaatgaacagatatttgaacaacagatattttctttcttttttttttttttgagatgaggtctgtctctatttctctggctggagtacggtggtgtgatctcggctcagtgcagcctccgcctcctgggctcaagccatcctcccaccgcagcctcccgagtggctgggactacaggtgcacaccaccatgcccaactacgttttgtgttttttgtagagatggggttttgccacatagcctagactgttcttgaacttatgagctcaagtgatcctcccgcctcggcctccccaagtgctgggattacatcagccactgtgcctggccaaacaacagatattttcttttgttcagatttagcttgtgatctgaggaaaatattttaaagacaggatagtcagaaggagaatcagaactggagttagaaactggcattagtcttagctttatcattgatttcattgcttgaacagctttcttttatgggagaaaacagaagttaaaatactatgcaatgattctgtgactagattcaaattaacttgttattattttgaaggttgtaaagcaccagaaaaacctttaatttgtcatctgtcattctaattagtcaatatccatggcatatttcccgttaataaatagagagcatggtcccgaaattcaactttaatttctacttccatcactaccttcagctgccatcttaatacaattccaaatacagttcaagaaaccatctttctcctatggtttacattcattcttgtagcattccttatatttcagcactgccctaaacactggcttagttttttttttttccaacttttattgtaagttccggggtacatgtgcaggatgtgcaggtttgttacataggtaaatgtgtgccatggtggtttgctgtatggatcatcctatcacctaggtattaagctcagcgtccattagctattcttcctgaagctctccctctcccccacaacctcgcaacaggccccaatgtgtgttgttcccttccgtgtgtccatgtgtccatgtgttctcatcgttcagctcccacttataagtgagaacacacagtttttggttttctgttcttgcattagtttgctgaggatgatggcttccaactccatccatgcccctgcaaaggacataatctcattcctttttatggctgcacagtattccattgtgtatacgtaccacattttctttattcagtctatcattgatgggcatttgggttgatttcatgtctttgctattgtgaatagtgctgcaatgaacatatgtgtgcatgtatatttataatagaatgatttgtattcctttgggtatatacctggtaacggcattgctggttcaaatggtatttctgcctctaggtctttgaggaattgccacactgtcttccacgatggttgaattaatttacactcccaccaacagtgtaaaagcattcctattagtctgcaacctcaccagcatctgttgtttcttgactttttagtaattgccattctgattggtgtgagatggtatctcattgtgattttgatgtgcatttctctaatgatcagtgatgttgagctttttttttctatgtttgttggctgcatgaatgtcttcttttgaaaagtatctgttcatgttcttagcccactttttaatggggttgtttggttttttttttcttgtaaatttgtttaagttccttatagagtctggatattagacctttgtcggatggatagattgaaaaaattttctcccattttctaccatgatagtttcttttgctatgcagaagctctttagtttaattagatcccacttgtcaattttgcttttgttccaattacttttggcatttttgtcatgatatctttgcttgtgcctatgttctgaatggtattgcctagattttcttcaaggttttgttttttttcctatagttttggattttacattcaagtctttaatccattttgagtcaatttttgtgtaaagtgtaaggaaggggtccagtttcagtttcctcatatggctagtcagttctcccagcatcatttgttaaataggcaatcctttccccattgcttgtttttatcaggtttgttgaagataagatggttgtaggtgtgcggtcttatttctgagttcttctgttccattggtctatgtgtctgtttttgtatcagtaccatactgttttggttactagagtcttgtagtatagtttgaagttggatagcatgatgcctgcagcttcattctttttgctttggattgtcttggctatacaggctcctttttggtttcatatgaattttaaaatagctttttaaaattctgtgaagaatgtgaatggtagtttaatgggaatagcattgaatctataaattactttgggcaatatggccattttcatgatattgattcttcctatccatgagcatagaatgtttttccatttgtttgtgtcctctctgatttcttggagcagtggtttgtagttctgcttgaagaggtccttcacatcccttgttagctatatttattgctaggtattttcttttctttctttcttttttttttttgagacagagtcttgctctgtcgccgaggctggagtgcagtggcacaatcttggctcactgcaagctctgcctcctgggttcacgccattctcctgcctcagcctcccaagtagctgggactacagatgcccacctccacgcctggctaagtttttgtatttttagtagagacggggtttcaccatgttagccaggatggtctcgatctcctgacctcatgatccgcccgcctcggcctcccaaagtgctgggattacaggcgtgagccactgtgcccggcccagtattttattttctttgtagcaattgtgaatggagttcattcataatttggctctctgcttgcctgttgttggtgcattggcttagttttagttcatttcttcaggaaattttttttgctcatttattcagtcatttattcttttgacctgtatttactgaatgtcaagcatgtattaggtactttgtcaggcaccaaggctatcatggtgaacaagtttatacagtccagccctcttgtagtttacagtctagtgggggaagccagacattaaaatattaattcagaaataattagttaattataatagtgctaaatcctatgaaggaaaagcataaggtactttgaaactttataatagggattacttagtttgggggtcaggaggacccttgcaaggaagcaatactttagctaaaacatgaaagatgaataggtgagagataggcaaaggagctgggaagggagatgggcagggaagagttattgggcgttgggtataacagatgcaaaggccctgggaagtgaaggagaatggggcttgcgtgagtgggtcataacaacgaagaagagagtggtaagagatgaagccagagaagtaagcaggagtcagattattagggctttgatttggactttattccaagagcaatggaaactcataaaagggtatactgtaatatgtgttttaaaaaaaatcagtcttggacatggacaagtgattgaaaaggagcaataaaatattcacgaagattagttaggtacctattactgtattccaaacaaaaagtgatggtgacttatattattaatgcagaggttatagtgttgattaatatgacagatatttaggagggataatttttgtttttttttgagacagagtctcgcactgttgcccaggctggagtgcagtggtgcgatcttggctcactgcaatctctgccttctgggttccagcaattcttgtgcctaagcctcctcagtagctgggactacagacatgcaccatcacacctggctaatttttgtatttttagtagagatggggttttgccattgtccaggctggtctcaaactgctggcctcaagcaatccacccacctcagcctcccagtgtgctgggattacagatgtgagccactgtgctgagcctaggagagagaattaatgggatttggtgattgtttggctgaggtggtggtgaagtataggaaaatgtcagagatgattctctgacttttgctttgagaaactgagtggtaccatttcctgagatcaggaatactggaagaggagcaggtttgagggaggcagatcatagattcaatttagtacttgtgtaatttttttttttttgagatggagtttcgctcttgtcacccaggctggagtgcaatggtgagatctcggcccaggctcccacgttcaagtgattctcctgcgttagcctcccgagtagctgggattacaggcacccaccactatgcccggttaattttttatatttttagtagagacggtttcagcatgttggccaggctggtctcgaactcgtgacctcaggtgatccacctgcctcagcctcccaaagtgccgggattacaggcgtgaaccaccgcccccggccagtacttgtctaatttaagatgtttataaaacatttagtgaagatgggaaataggcagttaaatatatggacctggactttgaaggcgaggcatgcacgtgggagtcattggtgtaaatatgatagttaaagctatcagaatggatgagtgattgcctataaagtgcatacagtaagacgataagtgtacttaagcctgaaacctgagtgatgccaacagttacaggtcagattagatgataatgagtctgagaagaagcagccaccgaagtagaagaaaaattggtagtgtcatatcacaaaactcttctttgtctcatttatatacatactacttttctgaagttttgttctgttagttcattttattcctttttttgagatggagttttgctcttgttgcccaggctggagtgcagtggcgtgatcttggctcaccgcaacctccgcctcccgggttcaagtgatgatcctgcctcagccccctgagtagctgggattacaggcatgtgctaccatgcccagctaattttttttttttgtatttttagtagagatggggtttctccatgtttgtcagcctggtctggaactccggacctcaggtgatacgccggcctcggcctcccaaaatgctgggattacaggcgtgagccaccacacccagctgattattctttttttgacttaccgaatctattattctagaaattacacttaaaattgtaagtgaagtgctttaattttgacagattgggctgcctttgcatgtttgagaaagtatccccacatgcatccacgttgcctgatgataggttatagaaaaaaatgtctacgtaaggatgccgactgaaatatttcttatatcaaaaaattggaaacaataataataggaaggagataaattatattacatttatgttagggaatattatgtaggcactaaaatctttaaaaaatatttgtttgtttattgatttttacagaggcaaggtcttgctatgatgcccaggctggtcttgaaatcctggctgcaagtgatcctcctgccttagcctcccaaagtgctgggattacaggcatgagccatcatgcccagccaataatttttaataacaggagaaatgcacaggatataaatggttagtgaaaaaagcaggctacaaaattgtatatagtatacatgccaattttataaaaatgaccgttataaaggtatttggtgtatattgttaataatggttatctcaggattgtggaattttttactgttctgttttctttaactttttttttcattccaaatttgctttaggtatgttatgttctttaggaaaaaagcagcaacagttcttgtttgtccccttgcagtaatatctggcaattctcttagtctcagtttttttaccatttgcgaaatggagataattatacctgtgtgtaaatgaaataatgtatgtaaagtacttaatacagcacatagtagatgtgcaacagatgttcattagcttcctgtccttgccttttccttactgttcatgattcctgaatcacagcaatatctaagaggagctgatgttatttgctccatatcctagcatagtgactggacagtgccctggagcaggcaaaactaaactgaaatgtaaagcagaccattaacaaagggaggttgtcaaaagcccttaaaagaataaaaggaacattagaaaataaacatcttttaaaaatcaggtaaaattttaatatcccagaagattaataaaagtaattaaaaaaacaattttccttatagagtattaacttttgtagttctaaatacatcagaatgatcaaaaccaacaaatgaaatcaccagaattctttgtataatttcttgtggacaaacacaacaccaaggataagaaaggagaatttcgggccaggtgcagtggctcacacctgtaatcccagcactttgggaggccgaagtggtcaggtcacttgagggcaggagttcgagaccagcctggccaacatggcaaaaccccgtctctactaaaaatacaaaaattagccgggtctggtggcaggcacctgtaatcccagttacttgggaggctgaggcaggagaattgcttgaacccaggaagtggaggttgtagtgagctgagatcgcatcactgcactccagcctgggtgacagagtgagactctgtcttgaacaaaaaaaaggagaatttcagaattgtattatattggaaaaacttcagatatgtagtgtttctccccttgttcacagggaatatgtttcaagaccctcagtggatgtttgaaaatttggatagtactaaactctatgtatactatgttttttggatctgataactgagatgataactgagatactgactaatgggcagggagtgtctacagtgtgtatacacttggcaaagggatgattcacatccaggtgggatgatgtgagatttcaccatgctactcagacctgtgtgcaatttaaaacttatgaattatttctggaattatccatttaatattttcagatcaatgttgaccaggggtaactgaaacatgggaagtgaaaccgtggataagggggactgttgtactgtgtacctgggtttagatatagttgctagtaccaaaagtttttatccccactactattaccttcttctagctaccattatttttctttggaatgactgtaacgtcttcctgacagatctcccagcttcaagctgttcttcacaaactaatctgagtatgtctttgaaattataatttgttgtattagtttcctgtggcagttctaatacaaatcacaccctgggtggcttcagacaacagaaatttattctcttacagttttggagttcagaggttcaaaattaaggtgtaggcagagctgcattctctccagaggttctaggggattatccgttccttgcctctttcagcttttggtggccattaacattccttggcttgtggctgcttctctctctataccatcttcacataaccttttcctgtgtgtattgaattccctctgcctctcttattagtgtgggtatttagggtccatctggataatccatgattatcccttcatctcaagagctttaacttaatcacatctgcaaacacccattttgcaaataaggtaatattcacagacaggttctggagatttgatttggatatccaggggtgggggtggggggtcatttctcagcctaccacaccttccttcacactgttcttcacaaacgaacccaagtttgaaataacttgttcatgtcactcctttttgcatcttcaacagagctgtttatggttaggcccctgcttacttctctagcctcattgcttgctgtgctacacccacactccatctttcaaccattctaaatgaactgtatatttacagtttgtgttagtccctgtttcctctcttgcttcttgacctttctttgtacattctgtcctctttggcaggaatagtcaaatttcctttgcttacctaacagctctttcagattttagcacgggcatccagcaattccattaagtttccaaaatctgtatcagttatactttccctattacaatatctcttattaattgtgttgtaattgcctggtttctagtcctaatttcatagtccctggttgacttcataagactgtgagggcaacgtctctctctttctgttatgtcatatccccataatctagcacagtccctggcacagagtaaatatttgttgaacaaataaataatagaagggaaaaggatggattagggttaaaattgctaaaatttagagaattaaagttggtttatgtttttgaatatatatagaggttgaaaaaaaacttaatcattttcttgtttaggcttatgggataaaagcacaaaggtctgctgatttctcaccagcattcttatctactaccctttctgctttggacgaagccctgcatggtggtgtggcttgtggatccctcacagaggtaaaggaaaaatttttcgtaccttcttccattgacctataaccttcagagctagggaaaaagtttagttaaaaaacataaattatttctggaacggtaatctgaattaaattataagtacttcaaggatatggttctccactcagtacttagtgtggttgttctgcaaacagaggtgttaaaaacaaaatccttgctgactgattaaaatctacttaggttgctgtttcattgagttaacttagaaagtgataaatattgctgggtgtgtttatatatgtgttatatatataatgcatacatatatgttatatatacatacatgcatacatacatttatatgtacacacgtcacatatatgtaatatatacacatatgtcatatatgtaatatgtatgcacataaataacattatatattttatatatatgattatatcatgcctgtaatcccagcactttgagcaacaaggcaagaccctgtctttaccaaaaaaaaaataaaaaaaacccagaaaccatttagccatatgtggtggtgcatgcttatggtcctagctactcaggaggctgaccttgagccagggaggtcaaggctagagtgagccatggtcacaccactgcattccagcctgggtgacagagcaagaccctgtctcaaaaaaaagaaagtggtaaatattatgaaataatattatgaaacaattgggggaattaaaaaaggatcactccttataaattaggaaggacaatttgaaattttattaacatatggaaaaattatagtattaaactaaagtgagctgtttttactttctgttatagataaaatttcttttaggaagtgataggttattggattagttaatactgttggataacaaattatcccaaaactaagtggcttaaaacaataaactttggttatttcttagtttctttgtgagtggcttagctcagcattgttggtgagggatgcagtcatctgaagcttggtaggggctgtaggatctgtttctgaggggcccacttacatgactggcaaatgggtgctggtggttggcaggaggccacagtgcctcaccaggtaggctctccacaggcttcttgagtcttatgacatgatggctgacttcccccaggtgagtggtcttgaagaaggcaagatggaagtggtgatatctttggcaacctagctttggaagttacacaccactacttctgccacttttcgtcattagaagtgagtcattaagtcaagcctacatttaaggaaagggaaattagcctcttttttttttttttttgagacagagtcttgctctgttgcccaggctgaagtgcagtggcacaatcttggcttactgcaacctctgcctcccaggttcaagtgagtagctgggattgcaggcatgtatcaccatgcctggctaattttttgtatttttactagagatggggtttcaccatgttgtccaggctggtctcaaactcctggcctcaggtgatccacccacctgggcctcccaaagtgctgggattacaggtgtgagccactacacctggccaaccttttggaggaagaagtgtcaggaatttgaggacattttaaaaccactgcagttattttccttgaaaactgcttacaatgtggtgacttcatagacaatgtttatcaatacactcctgaggacttcttgcttgaaagttctaggggcataaatactttcaggaaacttctaaacaagaacagattattttcttacattctgatagtcataatttaactgtggattttttttccttggagatagggaccctgttttagatactatattttatttcctgtcttccaagagagatttaaagatttatatgagcaacacctagcagatgcctattaaatagttggtaaataaatgcgtgaattagttattaataaaaatgcacacacacacatacacacacacacacgcacacacacacacatcctcttcttttggaatatactgccaccaggtggtgccagaatcacatgattttacataaactttttgggctgaagttccacttgcttaaacaaggtttattacagtgtgatccacagtcataaacttacttatttaaatagcaaaaacattgaacttaaggaagattaactgggaaattctttttactttttaagttttagaataatttttaatactttttcacttagcttttattaattattttttaaaatccaaacagaagttacaagccttttaggtgttttgttgttatctaattggctgacttggaataggaatataaatactttgactccttagtaggggcaaattctctcctttctgttctagctacaggtagcttcttcaatcttttttgttttttgtttttcaactgagtacagggagtatatcaaattatcctcaaacagagttttttttgcttttattacaatttttaattgatacaataattgtatatatttatggggtacagtgtgatattctgatatgtgtgtgcaatgtataatgatcaaatcaggtaattggcatatccatcacttcaagcatttatcattttttgtgtgtgttcggaacatccaaaagcccctcttctagctatttgaaaatatataataaattgttgtaaattatagtttacctaaggtgctatagaaaactaagacttattcctcctgtcttgctataattttgtaactgctaaccaacctttggctgtctccctctaaccatctcagcctctaataaccactattctactctccacttctatgagatcaatttttttagcttctacatgtgagtgagaacatgcaaggtttgtctttctgtgtctgacattttactcaacataatgaccttgagttccatccatgttgttagagatgacagaatctcattcttttttatggctgaaatagtactccattgcatgtatgtaccacatatttatccatttgtctgctgatggacacttaggttgattccatctcttgggtactgtgaatagtgctgcaataaaaatgggagcgtagattgacatactgatttcatactgtgtatcatacatgcgcatgcacatacacacatgtggaggtaagagagagctagcaaaacgataaagtaaattgggcaaaatgttaacggtgggtggatgtgggaaaagaatgcatatatatattctgtattgtttttatttatttttaatttatttttattttaaattaaaaaaaaagatacatggtctagctgtgtcacctaggctggagtgcagtggcacaaccatagctcactgcagcttcaaactcctgggctgaaatgatcctccttcctcagcctcccaagtagctaggactacaggtgtgcaccaccatgcctggctaattttttaaaatgttttgtagagatgagggcttgctatgttgcccagactggtcttgaactcctgacctcaagtgatcctttctgccctggcctcccaacgtgttgggattacaggtgtgagctactgcgcctggccttctgtttttattaataccattttcctgtaagtttaaaattatttctagataaaaaagtaaaaaaaaaaaaacctgtgatgtttgctgtaagtagatatccttgatcagaaataaagaactttcctccatttcctagctaaaatactaatttggtgttacattttatcaaaaacttttttttctgcattgattgaaatgattgtattatttttcatctttggtctaatagcatggtgagaaacatttaatagatttttctgatgttaaactactattgcatttttgggacaagttcaacttggtcatgatatattatctttttttataaactgttggattcagtttgctaatatttaagatttttcaatatttaggatggatattcagctgtaattttccttttagtagtgtctttgtctgaattagtatttatcttatactagtttggtagaatggattatggaatatctctttttttaatattctgcaatagtttgcctatgatgggaattatttgttccttgaagatttggtagaacttgtctgaaaaattgtctgatcttgatatttttccttctgagaagattttttaaaaattcaattcctttaatgattataggactactcagattttctatttcttcttgattagttacagtgaatgagatttttaggaatttgtccattttctttatgttttcaaatttattataataaagttattcattacaatcttccagctcttaaatctggttttacatgtggtttttgtccccctttccatttctgatattacttactttgttttatttctccctctcttttaaaaaaaatcttgtcagaagtttgagtatgtatgtcatcattttaaagaactctgcattttgttgttctttgttggtcttctctattatttcttcatcttctacctcctttatttctgccattttcttattatctccttttatttaatttttttgtggggttattctttgcttctaacttcttaaattagatatttaatctattaattttcagtttttctttttactctgaccttttaagactgaatttttcttgaagcattctattttgagatatagtatttccattttcattctgttctagaagtatttaaacattcccatcacaattgcttctttgactcatgtatcatttggaattttaaaatatctaaattacttaattaaaaaaatttattttaattacattattaatctaattgcatttttgtcagataactttgcatgatattgattttttgaagttccctgagacatcttttaaggttaaatatgtgatgaactttgataaatgttgcacgtgtgcttgaaaagaatgattattctctaataattgggtgccctattttattttaggttcagggggtatatgtacaggtttgttacattggtatattgcgtgatgctgaggtttggggtacgatttataccatctctcagctactgaacatagtccccaataagtagtttttttagcctttttccctgctcccttcttcctccttctaataatctccagtgttgattgttcccatctttgtgtccatgtatacccaatgtttagctcccacttataagtgagaacatgcagtctttggttttctgttcctgtgttaattcacttaggataatgaccaagagctgcatccatgttgctgcaaaggacatgattttgttctttttatggctgtgtagtagtccatggtatatatttaccacattttctttatctactctaccatggatgggcacttaggttgattccatgtctttgctattgtggatactgtggcagtgaacatacgagtgcatatgtctttttggtagagtgatttattttcctttgggtatatatccagcaatgagattgctggctcaaatggtagctctgttttaagttctttgggagatctccaaactcctttgcacagtgattgaactaatttatatttccacctacagtgtataagcattccattttctctgcaccctttccagcatctattattttttgactttttttttttttttgggacagagtctcattctgttgcccagcccggagggcagtggcacttttggctcactgcaacctctgcctcccaggttcaagtgattctcgtgcctcagcctcctgagtagctgggattacaggtgtgtgctaccatgcccagctaattttattttttagtagagatggggtttcaccatgttggccaggctggtctcaaactcctggcctcaagtgatccgcccacctcagcctcccaaattgctgagattataggcatgagccactgtgcctggccattttgacttcttaataatagccattctggctggtgtgagatggtatctcattgtggttttgatttgcatttctctaatgattagggatgttgagcattttatatttgatggccacatgtatgtcttcttttgagaagtgtctgttcatgtcctttacccacttttaatggggtcattttttgcttgttgatttgtttaagttccttatagaatctggatattagacctttgtcacatgcctagtttgtgaatattttctcctattctgtagggcgtccatttattctgttgatagtttcttttgctgtgcagaagctctttagttaggtaccacttgtcaatttttgtttttgttacaatatttttgaggtcttagccattagttctttgccaaggctgatgtccagaatggattttccttggttttcttctaggatttttatgggttgggtcttagatttaaattgttgatccatcttgagttaatttttgtaaatggtaaaaggtaggggtccagtttaattattctgcatatggctagctggtaatctcagcagcatttattgaataggaagtcctttccccatttttttattttcgttgactttgtcaaagatcagaggttgtaagtgtgtggtttcatttctgggttctctattctgttccattgatcactatgtctgtttttgtaccagtaccatgccgttttggttgctatagtttgaagtcaggtagtgtgatgcctctagctttgttctctttgcttaggattcccttggcttttcagactcttaacttcccatatgaatgttagaatagttttttctaattctgtgaaaaatgacattggtaatttgaatctgtacattgctttgggaaatatgccattttaacggtattgattcttcaaatccatgagtatggaatgttttttcatttgtttgtatcatctatgatttcttgtagcagtgttttgtagttctccttccaaagatcgttcacctccttggttagatgtattcctagatattttattttttttgtgtagctattgtaaatgggattgtattcttgacttggctctcagctggaatgttattggtgtatagaaaagctactgatttttgtgcattgattttgtagccttcaactttactaaagtcatttatcagttctgggagccttttggagcagcagtctttagggttttctaggtatagaatcatattgtcagtgaagagagatgattttgctttttcttttctattttgatgccttttatttctttccctttttgagatggagtctcactctgtcgcctaggctggagtgcagtggcacaatcttggttcactgcaacctcacctcctcaccttctcttgcctcagcctttcaagtagctgggactataggcgtgcactaccactcccagctaatttttatatttttagtagagatggggtttcaccatattggccaagctggtcttgaactcctgacctcaagtgatctgcctgtctaggcctcccaaaattctgggattacaggcatgtgccaccgtgcccagccttatttctttctcttgcctgattgctctggctaggacttcctgtactatgttgaataggagtggtgagactgggcatccttatcttgttctagttctcccaaattttgcctgtttagaatgatgttggctgtgggtttgtcataaatgggtcttagtattttgaggtatgttcatttcgatgcctagtctgttgagggtttttatcatgaaggggtgttggattatgttgacagctttttctgtgtctatggagatgatcatatggtttttactttaaatctgtttatgttgtgaataacatttattgatttacatatgttgaactagccctgcgtctcaggaataaagcttacttaatcatgatgtattaactttttgatgtgttgctggattcagtttgctcatattttcttgcagatttttgcatccatgttcatcagggatattgacctgatgctttctttttttttttctttttttaaaattttattattattatactttaagttttagggtacatgtgcacaacatgcaggtttgttacatatgtatacatgtgccatgttggtgtgctgcaccaactggtcattttgcattaggtatatctcctaatgctgtccctccccccctcccccacaatgctgtcttttacattgtgtctctgccagattttggtgtcaggctgatactggtcttatagaatgagttattgaggagtccctcttcctcagttttttggaacattgtcagtaggaatggtataagtgcttctttgtacatctggtagaattaggccgtgaacatgtctggtcctgggatttttctgcttggtaggctttttgttacttaattcaatttcggacctcattattggtctgttcattagtttaatttctttctggttcaattttgggaggttgcatgtttccaggaatttatgcatttcttctaggttttctagttagtgtacatagaggcgtttgtagtagttctctgagggttttttgtatttctgtggggtcgatggaatatcacctttgtcatttctgattgtttatttggatctttttttttcttattagtctagctagcagtttatcttatatattctttcaaggaacaaactccttgattctttgatctttttaattatttttttttttgcatctcaattttgttcagttcagctctgattttggttatttcttatcttctgctagctttggggttggtttgctcttgcttctctgtttcctctaggttagatgttaggttatttacttgagaacttctgaactttctgatatgggcttttaacagtataaactttcctcttaacactgttgtagctgtgtcccagagattctggtatgttgtatctttattctcattagtttcaaagaatttcttgatttctgccttaatttcattgtttacccaaaagtcactcaggagcaggttgtttatttccatgtaattgtatggttttaagtgattttcttagtattgatttctatttttattgtgttatggtccaagagtgtgattggtatgattgcagtttttttttttaatttgttgactattgttttatggttgattgtgtggtcagtgttagaacatgtaccctgtacagatgaaaataatgtatattctgctgtttttgggtggggagttctgtagatgtctattaggttcatttggtcaagtgttgagttcaggtcttgaatttattagttttctgtcttaatgatctgtcttataatgtcagtggggtgttgaagtctcacactattattatgcagtctcttcataagtctttaagaacttgctttatgaacctgggtgctcctatgtttgctgcatatataggataattaggtctttttgttgaattgaatgctttaccattatgtagtgcccttgtcttttatatatatattatatatatatattttttttattatagtttaagttctagggtacatgtgcacagcgtgcaggtttgttacatatgtatacatgtgccatgttggtgtgctgcacccattaactcgtcatttacattaggtatatctactaatgctatccttccccgctccccccaccccacaacaggccccagtgtgtgatgttccccttcaaaaatgatgagttcatgtcctttgtagggacgtggatgaagctggaaaccatttttgtctttttttatctttagtggtttaaagtcggctttgtctgttataatagcaacccctacttttttctattttctgtttgcttggtagatttttctctatccctttattttgagcttatgggtgtcattgcatgtgaggtgggtctcttgaagatggcacaccattgggtcttgactctttgtccaacttgccactctgtgccttataattggggcatttagcttgtttacattcaacgttaatattgacatgtggatttgatattgtcatcatgttgttagccggttattatgcagacttgtttgtgttgttgctttatagtggcaatggtctatgtacttaagtgtgtttttgtagtggctggtgatggtctttcctttttatatttaacactcccttcaggacctctcgtaaggcaggtctaatggtaacaaattcccttagcatttgtttgtctgaaaaggatcttatttctcctttgcttagtttggctgcatatgaaattcttggttggggctgggtgtggtggctcacgcctgtaatcctagcactttgggaggctgaggcaggtggattgcttgagcccaggagtttgagaccagccggggcaatatgatgaaaccctgtctctacaaaaaatgctaaaattagccgggtgtggtggcatgtgcctgtagtcccagctactcaggaggctgaggtgggaggactgcttgggcccaggaggtcattgctgcagtgagccatgatcatgccactgcactccagcctgggtgacagagtgaaaccctgtcacatatacacacacacaaaaaaacacacacacgaaattcatgattggaatttctttaccttaagaatgttgaatatagtcctccaatctcttccagcttgcagagtttctgctgaaaggttcactgttcgcctgatggagtttcttttgtaggtgacttgccccttccctctagctgcctttaacatttttttccttcattttgactttgatgaatctgatgactgtgtcctggggatgatcattttggatagtatctcacagaagttctctgcatttcttgaatttgaattcaggcccccagctttgttctctgggcccttcaggttaggaaccttctgtgctggaggagcccaggtgttcttggatctctggccacaacactgatgtgtggtgccagccaaattgcgttgttggggtggtggcagtgggatctgtgcttgttcacatgtaccaacagcagctgcgttatggtgggatgcacactccatggcttggatggggtgctggtgggtgcggcgctgccagcctctgtgtgcatattcatactggtggtggtgttggcgcatggggtagtgcggtgctggcaggtacagggctgccagtctccatgtgtgtgttcgtgctggtggcagtgtggggggtggcgtgtgggttgctgtcctccgtatgcgcgtttgcagtggcaatggccacgcagtggtggggttacactctacaccacagctgtggcatagtgggatgcatatgcacatgggtgccagcgatggaggggaggtgaggtctacccacacgtgtgccagcaaaacggtagggcaggtgggggcgtggccgagtgcatgttcctgctggcaaagcagcacagaggaggctgcagtcagtggtggtctggtgtgcctcagtggaggctgctctactggagctcttgatggtcagcattatctgccagtgaaggagctatgatgtaggccccctggaggcacctcagttgggcatccgagggtacactgcaagtgtgctccaccaggttgggaccctgggagaggccagcagacaaggggtgctttgattggactggctccatttcacatgcaagaccaccatgatctgttcagatttgacagttctcctaaggctaaagtctcctaggagagcatggtgagccttgggagatggacaaccctggttgtgctccactgcagacattactgcaccaaaccctctgggttccacactgcattcctacccctaccacctctctaagcacctctcccagccagctcaggtgtccacaccctggggtcgtggggtctcctgctgctaggatttcagaggtctgtggtgagaggggtttgtttttcacctcttcaactcaccccttcctcaggagtccttgagggccagaagtaagtcttggtgtgtgatagcccaatgcagggttcccagtttcttctttcttcagcccagcatctatatcctccctccatccattctcattgccttccctccaaagatctcagaatgtgccagtcttcccaaagtcccagtcacttggtggcatgtgttcctcctggctgcgtctagttggccatcttgccccagggtcttctctctaattttaggcatttattttcttctgctagttttggggttggtttgttcttttttttttttttttttttttctaattccattaggtgcaaagttaaattgttaatttgaaatctttctaacctcttgatgaagaaatttagtgttataaactttcctcttaatactgctttagctgcctcccagagattttgggaagttgtgttcctattttcattaatatcaaataattttttgacttccgccttaatttcttgttcacccaggagttattcaggagcaagttgtgtcctttctatatttgcgtagttttgagagatcttcttgatattcattttaatttttttggcactgtggtctgatagtgtgcttgatgtgatttcgatttttaaaaaaatttattgacacttactttatgaccaaacatgtggttgctcttagagtatgtttcttgtacagttgagaagaatgtatattctgtggttggtgtgtggatcgttctatagatatctgttaggtttaattggtcaagtgtcaagtttaagtccagagtttctttgttatttttctgccttgatgatctttctgtcactgtcagtggggtgttgaagcccccccccatttttgtgtggttgtctaagtctttttatcagtcaagaagaacttgttttatgaatctgggtgctccaatgtttgatgggtatatatttaggatagttaaatcttcctgttggattgtacacttttttgttgttgttgttaagatggagtctcagtctgtcaccaggctggagtgcagtggcacgatctctgctcactccaaactccgactccttggttcaagtgattcttctgcctcagcctcccgagtagctgggattacaggcacgtgccaccacaacccaactaatttttgtatttttagtagagatggggtttcaccatgtcggccaggatggtctcaatctcctgacctcatgatctccctgctttggcctcccaaagtgctgggattacaggcgtgagccaccacgcctggctggattgtaccctttatcactgtgtaatacccttctacgtctttcttagtcgttatggtttaaagtctgttttatctggtataagaatagtgacttctgcttgttttccatttgcctgctagctctttcttcatccctttttactttgagcctgtgggattacatgtgagatgggtctcttgaagacagcagatggttgagtcttgtctttttttttctagcttaccattctgtgtcttttaagtggggtgtttagaacacttaacattgaagtttagtaatgacatatgagactttgatcctgtcattgtgttgttggctggttgttatgtagacttgattgcgtagttactttatagtgtctgtgggctatgtacttaagtgtgtttttgtggtagcaggtgtcgttcttaccattccatgtttagcatttcctgaaggacctcttataaggctgttctagttgaaacaaattccctcagtgttttcttgtctgagaagacgagataaatttatttatttttcacttatgaagcttagtttgtgggatatgaaattatttgttggtatttcttttctacactgaaaataggtccccactctcttctggcttgcagtttctgctgagatgtctggtgctagcctgatggggttccttctgtccatgcattaccattctctcttgcttccttcaagacttttttcttttgcattgacctcgttgaatgtctgtgtgcctttgggatggccattatgttgtctggatttcttgtacctggatatctacatctctagcaatattagggaaattttcttgaattattccatcaagtatgttttccaggttgtcaactttttctcctctctcaggaatgccagtaattcataggtttggttgctttacgtaatcccacacttctcaaagactttgttcattttataaaattctttattctttctttctttttttttctttttcctttgagatggagttttgctcttgttgccccagctggagtgcaatggcgcaaactcgactcactgcaaccttcacctcccgggttcaagcaattctcctgcctcagcctcccaagtagctgggattacaggcatgcgccaccacacccagctaattttatattattttagtagagatgggttttcaccatgttggtcaggctgatctcaaactcctgatctcaggtgatcctcccacctcagcctcccaaagcactgggattacaggcgtgagccactgcacctggcctaaaattgttttttcttgacttttgtctatatgtgttagtttgaaatatcagttgtaattatttttttctgcttggtctagtctgttgataaaattttcaacagcttggcaatcataaagtgaagttttcagttccagaagctctaattgattcctttttaagatgtttatctcctttttcatttcctggattgttttattagattctttgtgttgattttcagtcttttcttttatatctttgagtttcttccaatccatgctttgaattatttatctgacatttctgagtttccattttggttggggacctttcctagagagctactgtgattctttggtggtgttacaaaaattggatttttctggtgccagcattcttatgttgcttccttctcatttgtaggtgttggcacttctaaatttttgttttttgagacaggttctcactcttttgcacaggctgaagtacagtgaatcatgtcccactgtagcctcgacctcccaggctgaagcaatcctcccacctcagccttccaagtagctgggactataggcgtgtgccatcatgcctggctaattttttaattatttgtatagacagtgtcccaccgtcgtcttgaactcctgggctcaagcaatcctcctgctttggcctccagggttggagtgctgggatggattacagacatgagtcaccgtgcctggctggcacttcaaatttttgtagatattttcatgcaggtagggttttctttccctttcttttcttgtattattattgttttttccccctttccttcccccactcactaaagggtgtgacttaagagtatgtcgagtagggtcttttgtctttgtttccatggccttctgttctggcagcaggttgtatattgggctgtggagttcaacctacgggccagtagatgatgcttacgggtgagagtcagctgtggtggaagcagacagttatgtacttggtatttgtttactgtgaagaactctctgttgttccaggtgataggctagactgtggagggctgcataccatgtacttcctattttacgggagtgctggggacatagctgggtagagtggataacctggcttgtccacaaatacccctatgtcaaatgtagaagtgtagtccccaaccctgatgagggtggctaggaaaagctcccagtgaattgtgccacagtctctgtgggggtttggggtgctacacaagccccttctagatagactggaatgtagattgttgcccagtcacacccttgttctagagctcttgactcctggatcagacacacactgcagcctatctccagaccaccatgtggttgagagccttaggaaatgtctaatttttgactctccaggggagtggtttttggggcagaacttcatcacttagcttaatataggtagctgtgtggctcctctgctctccaatgtgatgactcttcttcatttaagagcggggttgggggactccttctttgggcctctgcaggggtgtgttggttttggtggtgttggctggttgcgtcggttcaacctcaggcaatgggagatgtggtaaagtactagcaaaattggaatagggtagggagatctgtaagtccctagttagtccctagatggctggctggacttcctctatgagtcttgatggggctggattgttggggagcctcaggtcctggctgtgatgggaaggggtgagggctgatatctgggtgaggggctaaactctcaggcagggcacttaggcggtgggagccctagggaagatcacaggtctatgggggtaaggttttcgacagggctttgggccatgactgaaatgctcatgtaggggtcggctatgtgcagtagaagccagaaggcagcagtcctggttggggagtgggcagtggaggaagggggtcatgtggaaagcattctggccacctctctgaagggtagctgctggcactggagtttctctccccagcctgggggcagcaggggtggccacggcagaggacctgttcagttgcctttgggagtgatggtgatggggggtgtacctgggaagagggaatggggagcaggttgggtactcctctctgctgatggaggtgcttgaaagcacctttgttccctccctagcctagaagtagcaaggatgggtactgcagcagctgcagtggcagagggcctgtcagttgcctttggaagctccaccctagagaaacagagctgctactcactgaagtgattatgtgggggtaggggtgcctgtgctggcggcccaagtcaggaggccctgccctgtaaggagcagcaggggctgggcctctgagagcaaagagtctggccacctttcctgaaggcagctgcatcctgctggaggtctacttactctcaaggcagctgcatcctgctggaggtctacttactctcaggctcttcactccctccccagcctgagagcagcaggagcaaggacctgacagaggcagttgcagtgggcctgtcagttacctccgggagctctgacccagtgaaatacagagccagagccgtgaccgactgaccagagtgctcagttggtggtggagtgggcgtgctgggggcccaggccagtggccttgcctggcaaggaacagcagaggcagggcctgcagtctgactgctcctaaactccatggatatggcttctatcctagagctacgcgaaaaaacctggcctcccttggtgggactataacagctggcaccagggaactcggggatccaaggttggtggggatccccgactccatgtggggttgagcttccaagaagtcttccttacatggcttatatggctgggaagttggtcctggctgttggcagttctttgcgatgtgaacctttccataggactgcttgagtgtcttcatgacacaacagctgactttctgcagagtatgtgatccaagagtacagggtagaaatgacaatttctttttaagacaaagccttggaagttacataccatcatttctgcagtattctattagtcacagacaaacctgatacaatgtgggaggagactacagaaaggcatggataacaaaggtgagcatcattgagtcttagaggccgcctaccactgatatatgcatgtgtgtaaacatatgtacgcatgcatgtgtgtatgtgtataattaaaaaaaaaactttatgaccattctgttctcagaaatgttgtagtaggcagaatttcttaaatggcctctcaaagatgttctgccctaatccctggaacctttgaatatgatgagatgtcactcccatgattattatatgttatatggtatagttgactttaagatggggagattatttggatctaatcatatgagcccttagaagtagtgagctttctctggctgttaaaaaggggaaggaagaaaagcttaaaacccaagaaggactcaggatgccattgctgccttgaaggtggaggggccatgattaaaggaatgtaggcagcctctagaagcagtgagtggccctgagataagagcaagaaaggaacctcagacctagagctgcagagaaatagatttttgccaacagcttgaatgaacttggaagttgattcttactcccaacctccagataagagtccagctcagctgagatcttgatttcaaccttgtaagaccttaagcagagaacctagccaaccctatctggacttctgacctgattgtctctgatttatcctctgctgcttctgctttaggaatgaatagcacttctctacttccacttttcatcttggtgttgtaactgaatatataagtatacccagattcagtgacattcacataagtcaaaactgacttgcagtgacataataaatggatgctgttcaagctgccaagtttgtggtaatttgttatgaagcagtagagaactaataaaatacaggtgtcagtgaaggtgcctaattaactgcattgcacagtctttgtttctggttaaaaggtcaagcctagtgtcctagatagatgtcagatagatctggtgggtgggtggggtaaggcaactgattgaatgaacttagagtggatctggagattgagagagtaagaatcaatctggaaatattttgctgtcatttttatagtttctctttcctgactttaacttaaaaatttcctaggttatttatcatcagttttgacttacgtgaatgtcactgaatctgtgtatgcttacatattcagttacaacaccaacatgaaaagtggaagtagagaagtgctattcattcttaaagcagaagcagcagaggagaaatcagagacaccaactctgcggacctgctgaaggaagtgaactacagggcattgttccattccctgagaacagcaaacaccttaaagtttgtattatgtggagatcaaatcagttcggtagccttctcatatgagataatatagatcagtgttcctcattcattttttcattattgtctcctaagaagcctttttaacaattttttcttaaccacaccctccaatgaagtttttctaccacacatatactgtatatctgtttttgtactgtataaatatctgtgctttatacataaaagagtaaaatcttccccttcctccaaaacaacttttacccttggggttaatattacccatgctgagaatgcataagatagatgctattgtgaataggtaaaattaaagttatatttaaagatacaggtgaggtgcagtggctcacgcctgtaatcccagcactttgggaggccgagatgggcagatcacttgaggccaggagtttgagaccagcctgcccaacatggtaaaaccccatctttaccaaaaatacaaaaattagctgggtgtggtggcatgcgcctgttgtgccagctacttgggaggctgaggcatgagaatcatttgaatccaggaggcagaagttgcagtgagctgagattgcactactgcactccagcctgggcaacagagtaaggctccgtctcaaaaaaaaaaaaaagtattcagagatatcatcaaaaaaggtattttcagctaggtgtggtggctcatgcctgtaatcccagcactttgggaggctgaagcagaaggatcgcttgaggccaggagtttgagaccagcctgagtaacatagcaagaccctagctctacaaaaagtaaaaaaaaaaaaaattaggtgtggtggtgcatgcctatagtcccagctacttaggagactgaggcaggaggatcacttgagccaggagttcaaacctgcagtgggctatgcttgtgccactgcacttcagcctggggtgagatcctgtatcttaaaaaactattattttcatactgtaatataatctagagtacaggaccagagaactcagttcaacacagagagatgtaatatctgcatagttattatgcctggcaaagtttttgtatttttagtagagatggggtttcaccatgttagccaggatggtctcgatctcctgacctcatgatccacctgccttggcctcccaaagtgctgggattacaggcatgaaccaccgcgcctggccagcatcttagttttttcttggaacaattactattatagttcttttttttttgagacagagtcttgctctgttgcacaggctggagtgcagtggtgcgatctcggctcaatgtaagctccgcctcccgggttcatgccattctcctgcctcagcctccccagcagctgggattacaggtgcccgccaccacgcttggctaatttttttttttttgtatttttagtagagacggggtttcactgtgttagtagccaggatggtctggatctcctgacctcgtgattcgcccaccttggcctcccaaagtgctgggattataggcttgagccaccgcacccggcctattatagttctttttataattggcaggattagctgtggcctacatgatcacaggaaataataaggcaggggttgtaaactcaaatgcctataagcacgagccatgtaacagaagtacatgaaacagttaagtgtaagacatagatatttattagttgattttagctgctgacaacagcagcaaacatttatttttttgctcatgggtctccatgtctgcaaaggtggatcctgtcttcttcaggctgcagtgaggttcagatgtgccccacaagttgtaacagcagcaggaaaaccagagagagatttcaaatggatgttccttgagtacagtctgctgacattcatttatcctgccctatgttttgaaaggcagataactaggcctctgttctaatacagacatttagcatatgcggttgattggaccattgttcccaattcttcacttactctctaatttagaaataaacattctgctctgtaatggtttactagagtcttttatgtggcacatgttcaataactgctgttaaatgaatgattatatcccttaatactgtttgatttttgttaatggtggaacttggggtacttgtcatttccattccctcctgctttttctgctcttttcccatccctactcttcctctctcccttcccatttacttccaaaacggcagctgtcaatatgaaaaaggagggagtggtagagagaatccaagacataaactcttccacatgttggtgtaaagtaatttaagatcaaggtttctttcacaaggcaaaatgcaatgcaacctggcctttctgagattctttttttttttccttttttatggttttggctttaggatttagaatgttagttattttaaaaatgaattttgtaggtctgaagacctactcatatttctacataattgttgagcaaacggagacaagtagttagatgctggaggtcattaaaaaatattttttaatgaagcttttttaaaacatgctcactggtttcagatcagagccaggcatccttaaattgtcttctgccaggtattggcttggcagattaccctgtccagttgccctcatcttgaatgtgaggagagttaacttgataagattttaggtcctaactggaccagattttacattcctctcagccatgaaaagtttaagatgagcaggcttcatttttactttagtacaattagaccttttcttgggaacaattctctttcctcttcaaaccaattattaacattttcttccttgctgatatttgagtgatattcactactgactttttttttttttagttcttttacatttctcaagcaggttgttgaaactttggctctaactatatgaagtgaattgtttttttactggtgttttcgctgtgtaaatattgtattcagtctgagtttacaagaagcaaataacttagcctattctggtttggcatgttttctctttctaaccaccattggggctgaagctgggaactgaacacaacttgaaattttgtggtttgggtgctagaattcagagctagactatctgaagctaaaaattattaatgttgaaatgttttcacccactaaataaacctgaaaaaaaatgaaatgtaactccaggcagcccataaaatcgcatatggtataatttttttgagtctaggaagagatgaaaaaaatttgtgagcaggatctgagattgttaaaaaaaattagaaattgtttattatggtttaaagtaaatgctactatccaaactctaatccaaactcaacaaacaaacccagaaatctcttactgttattcacatgatgttttattttctccaagactatactgaatcagtacataaaaataatgaagtagggaaaatgccagttgcccttgtttaacttttcagctattttttacatgttttctttaaagatagaatagtaaagtaatactttacattttcaaggtacttgatacttcactgaatatttccaaatatatcatcttaattaaaataatggcttgtttcacccttttaaaaatcacaaagcattgaacagttttcagctcattaaatctgagaacatatccaaaacttggcacatggatagtatgtatagaaaggctagtcctttttcctctgctagttagcactctaatgatattaatgatggaagatttttctcagcccctttgctggacttatgacaggggtatcccatttactcggcccaccatgctcaacctcttgcgggagggagcacgtgagtgagtgagtgcgggatctggctggctgttccaggcacttgcaggagcaagcttcatgtgctggtatgagtgagcaagtgcgggatctggccagcacagctcggagtgccagcaggagcaagctctgtgtgggatccgcggccagaccaggcatgagctagcgagtgtgggatccggccagccactctgggagctgccaggagcaaactccatgaagggcccgtggaggcacccaggtaagggtgcctgtgaccccgaatccccagagtgggtgttacagtactctcttagttctgccctctgcggacggtggtgtgttagcagctcagttggccccttacctcgttatgtggggcagttgccctctgctggtgagggcaaagggccagcgtgacagccttctgggtacccgcacttggtgggtccctgtctggcatccaagaagaatgaggtcagttggacaattgacggatggtgaaggcagataattttattgagcgatgaaaatgactctccgtggagaggatagctagagaggggacaggaagggcaggtcatcttccctaaagttgggtcatctcttccccgaagtccagctgtcttacccaaagtctggccatctcccttaaattccggctgtctccggtattgattgagtttgggttctttataggtacagaatggggagtgcatgctgattggtttgcaattatgcaaaaaattttaaagcaaagacaccactcaaaggtgggcgagacagtgtggaaaacgaattaggaaagggtaggtatacgtaaaataggtgaagggtgaggatcagtccagaggaaagcgtgccaaacaggaagacaagttctcactctggtccagggatttaacatatagcttggctttcaggctttgaactgtatccggcttggaggtggggtttcaccggatacctggccctaccctatctgcctaggcatttcactgcctcctgtcgctatcattagtaagcataagcatttctttatttcaagatccactttcaacttttactgacagaagtttcccttgccctgatatctggtgactaatttgatccatgttgtttttgaaaatgaagaaagttccataaaaatgtttagagctctgaatttagactagcattctccaaagcagggtatgtaaaatgtttcattaggttgtgggaagaaaatattaaaacttttattgtttcaatctaacaaatgaaatttaccttaattaacatttaatcaatggatcaacactgacatcctcacttggtctgggtgtcagactgttgggtatcagttatagtgcatgaggaaagcatgcaggggttgacagaggccccttgcttgttattttcaacatactgggatgaattataagtctgcatatatctagttaggtggatttatggatttaacaaaatcaaagttcacaaaacagataaatggcaagaaagattcctgcaaagaaactaaattgtgtgcaatactaataatgagagtggaagtgagccacacacatgtataggtcagagcggatgcttctcctatgagacattaatgttgaagtaaaaatcaacaacaatctaatctcagctgagaagatgtccagaaaaagtgaaattataagcaagacaatttgatagatggaattgtatccactattgttaacaaagaaacactttctgatattttattcccttgaaatactggctaacaatagtaggaagccatcataattaatgaacatgtgggacaggaagttaaactgacaaaagtttttccatgacatttaaagttatgtgacacataactcagtatctagaaaaatgtcattaaaataaataatagatatttaaaagcatcttttgtgttttcttaacagcaaaagaccaaatacagtacattattagtaacattagggacacacttgttcataaaatggatgaaataaaacataggaaacaatatggcaacaagttaaatgaatttttttttttgagcgaagttttgctcttgttgcccaggctggagtgcaatgacgcgatctcggctcactgcaacctccacctcccaggttcgtgcgattctcctgtctcagcctcccgaggagctgggattacaggcatgcaccaccacgcctggctaattttttgtatttttagtagagacgaggtttctccatgttggtcagactggtctcgaacttccgacctcaggtgatctgcccacctcggcctcccaaagtgctgggattacaagcatgagtcaccgcacccggccttaaatgaactctttcatgaacaaatactttgagaagttgcatagaaatctttgaagatgatttgaatcattgagaacttaaattatttaatgtgagaggatgctatatatttgaagtacagatgtttctaacaaggctcagattatcatagtagctatattttgtttcaataatgaaatacatgaagaactaatttcattttgtgccattaaaataaagatgtatcagggaagatatattcttgaaaataagtgactttatgaatacaaaacaatgtatatgagagaatttcctgggataacgatagtgttttgactttgtaagagtttaggttgcatacatgtatgcacttgttcaagtttatgaaatggtagacttataatttgcacatttcattgcatgtagaatttactgcaaaaggaaaaaaaggaataatacatgttaaattctagttaatgctatgcatgctggactgttgggggaaactatattaatgtgtttgacttactttgaaatgcattaaaaaaaccctaagatggattggtgaatggattaatcatacagaaagcatacagtatagtcatagtatagtataacaaatacagtaaaaattttaaatgcagagtctaagtggtgggtatatggatggtccctgtaaaagtctttcaacttttctgttgcatcatccttaggtaatctatagcaacacataggttgatgtcagatatgcaaagagagtatttcagtatggtattaatgttgttaatttttcttaaaatctgactgttaggctgggcatgttggctcatgcctgtaatcctagtactttgggaggccaaggtgagaggattactttagctcaggagttcaagaccatcctgggcaacatagtgagaccttgccactacaaaaaataaaaaattacctgggtatggtgatgtgtgcctgtagttccagccgcttgagtggtggaggtgggaggattgcttgagccctgaaggcagaggctgcagtgagccgtgatcatggcactgcactccagcctgggtgacagagcgagaccctgtcacaaaccaaaacaaaaaaacaaaaaatcctaactgttgtatagaatccctagtgtactctataatgagatgagaagtgaccatgagaatcatttgaatcacaagagcatctctgattatcttacagcaaagactgtaaaagaatcattgaacttaaaagatgggttagctgggcatggtggctcatgcctgtaatctcagcactttgagaggctgaggtgggtggatggcttgagtcctggagttcaagaccagcctgggcaacatggtgaaacccagtctctatgaaaaaaaaagctgggcatgtgtgaatttgaggccacttgcagtaagttatgttcatgccactgcactccagcctgggcaacagagtgagaacctgtctttaaaaaaaaaaaaaaaaagatgggtgaagcatgtttttttaaatgaaaagacaagagatgtcaaatttgctgacccttttttgtatgacaagtgactatgtaatctgcattgcagattaaacaccaagcaaccaaccaatcaatgcaacactgttacttcatttcttcaaggtaaaggtaatgttttaacaaggagtgaaaatgtaactgccttttctaaaggctgggataaaaacacagaatgtttttaaaatcactgtttggaatatttcttttatcatgtgatttttgttgtcaaagatatgtgtgtcttatgaaaatttatctgcactcttaaaaaatacttggaaaaatattttgtatactcttcaaaaatgttacaaatagagtttcagtcagtgggggggaagggggaataggggaaggagagatgttggtaaaagggtctcaagtttgttagacagtaggaataaattttggtgatttattttacagcatggtaactatagttagtaataatgttgtatatttcaaattgctagaagagtagattttaaatgttcccaccaaaaaaaagataagtatatgaagtgatagatatgttaattagcttgatttaaccattctacagtgtactataaacatatttcaaaatatcatcatattgaactccataaatatatattattatttatcaattaaaaatattaaaacaagcaaaacccatgatacatatctggtggcaaatgagtatcgtggtagaaattcatcaaactgctcagatgtgatttgtgtacttttctggctgatggtcatacttcagtaaaactaaataaatgtaagcaaaaaaaaaaaaaagtttcagtgggtttttaaaccagttgttaaaaatgttaaaatgtgacatgttttgattcgtctgcaagaacaatcaattgacgtgaaggaagatcaataaaaacttttgcataattgatggaaggtattgaaaaatgcaagtagtaatttagttaagtccaacaaatgatgtatttctttaatttcaatccttgcatctttgtaattatccccttctcagcttacaattaagtactgaaataagtggaacttaggacctgacatttcaatcaccgaatcacaaaatatttacattattattttttaaagatacaatttggcttattattttcattattatcattgctctacttaaaatggtaagcttttatgagagcaaacagatcttttatataagtaataaatattataaaatgatttttaatgtttataatttttaattcatactttgtgtgtgttttatactctataggacatattagtaaaatagtatgttcataataaatatgcatatattggagggctgtactaaattttgttttgattgctttttttggctggtttgttggggtatgtggtcaaataagtttggagaactctctttactgatctctcataatctggcaagctattattgacaggagtaattatttattcttaaagtctaaatgatcattgtaaagattataaaccagcatatagttttaaatatgggaattttttttttttttttttttttttgagacatggtcttgctttgttgctctggctggtctagaactcctgggctcaagtgattctcttgcctcagcctctgggattacaggcgtgtgctaaacatttgtgttttaaggttgaactttgataaatgaagtttacctttagaccaaattctgaaacagtggttctcaaagtatataataacatcagcattacctgggaacttactagcgatgtaaattctcaggccatgacccagacctactgaaccagaaatgctggttaacaagctttccaggtgattctgatgctcactcaaatctgagaaccacatatctagatgatttagactcatgaatcactcctacttatttcttcctacttcataatgtatctgagacagtttctttattgtatgtcttagttttagcccagacttttttccctctcttagatttttttttcttttcccttcctctcctctccccttcctctcaatgttaaaaaaaaagttctttagtgttattttcacaaagaaatagtgcattggttctaaaaatttgggcgccacaactaatgtgacaaatagcatgtgtttaaaggagatatttctaaacattttcaaattaattttgttaactactgtattagttcattctcacattgctataaagaactacctgagactgggtaatttatgaagaagagaggtgtaatcgactcacagttctgcaggcttaacaggaggcatggttgggaggcctcaggaaacttacaggggaagcaagcacatcttattatggcagaacaggagagagagagagacagacagagacatcttactatggcggaacaggagagagagagacatcttactatggcagaacaggagagagagagagagagaaagagaaagtgccacacacatttaaaccatcagatcttgtgagaactcactatcatgagaacagcaagagggaaactgccaccatgatctaatcacctcccaccaggccccctcctccagtactggggattacaattcaacctgagatttggatggggacacagagccaaactacttctagttacacttgaatatggatataattaatttcctattatttcctgtctatactcttttgatttcaacttttataatctcaaaatagttttctgccaatgaagatttcaaaacagacatttcaaagtaggaatcacctaaactcaacagttgtttataaagcaataaatttgctttatttctctttctacacacatatatgcacacacatacacatttttatttgctgaactgtttgaaaataaattgtgtacatcagtacccttcacccctaaatactcttaaaaatatggattaaagtagcccttaatgggactagtgcaacattgttttgaaatgctaatttttaacaaatgctcaaccatttattaaagactcttaaatattttaaggtcctattataaatatcttcatgaggaaaaggtatagaatgccaagttatgatggtataaatgagtgaatgtttcagcctttctcaactagaagtttctcatctgaactacaaaatacagtggatgatttgagtgactattttctcaattcctccaaggatggtacataactagtgccaattcagatgcagaggggagaagttaattcattccatacaatggatgtcttgggcttaattctctcctgggaacccaggttagttggactgcatatatggcaaagtcttaaaaggattttgctttgactggcttgtgatgtttatctaaaaaactttttttttttttttttttttttttttttttttttttttagattacaggtccaccaggttgtggaaaaactcagttttgtataatgatgagcattttggctacattacccaccaacatgggaggattagaaggagctgtggtgtacattgacacagagtctgcatttagtgctgaaaggtatgagattttattttctattataatgttttacttttgtaacttatatacagcatgaaacatttacacataggttaacatttaccacccctcccccttgccttttttttttttttgagatggagtcttgctctgttgccgggctggagtgcagtggcacgatctgggctcatggcaatctccacctcttgggttcaagcgattctcctgcctcagcctcccgagtagctgagactacaggtatgcaccaccacacctggctaattattctatttttagtagagacagggtttcaccatgttggccaagctggtattgaacttctggcctcaagtgatctgcccaccttggcctcccaaagtgctgggattataggcgtgagccactgtgcctggctttttttttttttttttttttgagatggagtctctctctgtcgcccaggttggagttcagtggcaggatctcagctcactgcaacctccgcctcccgggttcaagcgattctcctgtctcagcctcctgagtagctgggattacaggcgccctaccaccaggcctagctaatttttgtatttttagtagagacagtgtttcaccttattggccagactgctcttgaactcctgaccttgtgatccgcctgccttggcctcccaaagtgccgggattacaggtgtgagccactgcgcctggcctaaattggtctttttataaatgtatcccagtagtaaatgaataaggaatgatagaatatcaccaaattacaaactctgacaatctaatggatctaggcatttaacatcacaaaaagatgacgagtcactggggtactttctgatggaagaacaatcaaatttgaatgtgatcaaggcttcagatccagccaccaatttacaacctagctagagaagagaggaacacatcaaactgctctagaaaatgcaattagcagaatccaaactgtgggaaataacagaacaaacaacttggtttctgtaacaaataaattgtaagattaaaaaatagttggaaggggaacctttggattaaaacagatttaaaagccttattgatcaattgctgtgtgattaacttatttggatcttgacttaaataaatggttaaaaaaaagaacagaagaataaacattgagactactggaaatttgaacatgaaaatatatttgagattaaagctggtaaagactggttcactcaaattgtccaagtactctttaaaatgccaatgactagccttcgactaacaagccaagtaggtattaaatagccagttatgtcataaatagctaatgttcaaatagctcttacaaaggtcctggggaatttgggtaaagaattcaaagattaagattatttttataacagcagttcagttcactgtaatggatttctgctttctttgcaccacatacaaaacagagtttaggatgtcttcttaaggaggaaactgttgcatgttattttattaccagtattacagttcagagcagtgtaaaaaccttatcaatgaattgggtgatatcagcatacatacagaagactagcaggtgacttgtctgcattttccaaatgaatttgtggagagtcttatgttttttgtctttgcatagagccttaattatttactttttgaatcccccatatttacttatttctccttcatatctttttctgccaatgtgcatgttggtatttacatcagaggcaggttggaaaatgaagaggtaatattttagctcctttgttggaattacgttgcatagttcacaaggagctcttatgaaggtcatttgagaataggggttgaactttatattgtatttggttttttattccattctccacaaggcttaaaatgagtgatcatctggctcacacatggaatggattttgaggtctggtgatagggccaagtagaataaaaaatatgaatgctctccgatatatatgccagatttggcattcttatactaccttctagtttgtcatggtgggtcatagaatggaactggccctgtagtgtctgatcacatttcattcattctgttacaggacagcttaacccctatttggaattatcaggaaaggttggccaatcggttaggaaagcttactgctgcagataactgagtatccaaagaacagtagcttaaacaaaaagaggtttatttctctcatataacaagacctgagtaggtggttgctggcactgggtcactcaggtctcagtgatgacagagagacctagggcatgcacattttcagacatcggattcattctgtgctcaagtcagtgtgaagaaaaagggccagctatatcttttatcaggaaagtgtacttttattcataatatctgcctcctcccatctgtggatttcctttttgttgcctgtagtcctcttgtagatttctcactgagtcacctctatatgtaaaaagaggctgggaaagtgaggggagaagatcgtcgtaacaatcatgatgagttgtctggttaatattgctgcctgaataaaactggggctctcatagcgaggaagaagtggaaatggatattggattggtaattaacagtttctgtcccagccccagctgtttctggacttagagaagaggtaaggcagggaaatatgagacgcaaaaaggactatgttgtagctctgtatgtgttcacattgtctccactttgtgcttgcaaagctagccggctaaccagcacaaatgagaaagtgtttaaaggattaatatgatgaaggattaaaggattcacatatatagaatttagggtacgtgagaaaaagttgaaaataatttcttcctataaatatctagatatctttttactaagaaggagagagaaatcaaaggaggaataaatacaaactacttaggtttaaaatgtattaaagagggaggagccaagatggccgaataggaacagctctggtctacagctcccagcatgagcgacgcagaagatgggtgatttctgcatttccatctgaggtaccgggttcatctcactagggagtgccaaacagtgggcgcaggtcagtgggtgcccgcaccacatgcaagccgaagcagggcgaggcattgcctcactcgggaagcgcaaggggtcagggagttccctttccgagtcaaagaaaggggtgacagacggcacctggaaaatcgggtcactcccacccgaatactgtgcttttccgacgggcttaaaaaacagagcatcaggagattatatcccgcacctggctcagagggtcctacgcccatggagtctcactgattgctagcacagcagtctgagatcaaactgcaaggcggcagcgaggctcagggaggggcacccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacataaatgtccctgtctgacagctttgaagagagcagtggttctcccagcacgcagctggagatctgagaacgggcagactgcctcctcaagtgggtccctgacccctgacccccgagcagcctaactgggaggcatccctcagcaggggcagactgacacctcacacggccgggtactccagcagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctgaaaagcagagcgactttcctcctccaaaggaacgcagttcctcaccagcaacggaacaaagctggatggagaatgactttgacgagctgagagaagaaggcttcagatgatcaaattactccgagctacgggaggacattcaaaccaaaggcaaagaagttgaaaactttgaaaaaaatttagaagaatgtataactagaataaccaagacagggaagtgcttaaaggagctgatggagctgaaaaccaaggctcgagaactatgtgaagaatgcagaagcctcaggagccgatgcaatcaactggaagaaagggtatcagcgatggaagatgaaaggaatgaaatgaagcaagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaagccaacattcagattcaggaaatacagagaacgccacaaagatactcctcaagaagagcaactccaagacacataattgtcagattcaccaaagttgaaatgaaggaaaaaatgttaagcgcagccagagagaaaggtcgggttaccctcaaagggaagcccatcagactaacagcagatctcttggcagaaactctacaagccagaagagagtgggggccaacattcaacattcttaaagaaaagaattttcaacccagaatttcatatccagccaaacaagcttcataagtgaaggagaaataaaatactttacagacaagcaaatgctgagagattttgtcaccaccaggtctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggttggaggaagatctaccaagcaaatggaaaacaaaaaaaggcaggggttgcaatccgaatctctgataaaacagactttaaaccaacaaagatcaaaagagacaaagaaggccgttacataatggtaaagggatcaattcaacaagaagagctaactatcctaaatatatatgcacccaatacaggagcacccagattcataatgcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgagtgactactgggtacataacgaaatgaaggcagaaataaagatgttctttgaaaccaacgagaacaaagacacaacataccagaatctctgggacgcatttaaagcagtgtgtagagggaaatttatagcactaaatgcccacaagagaaagcaggaaagatccaaaattgacagcctaacatcacaattaaaggaactagaaaagcaagagcaaacacattcaaaagctagcagaaggcaggaaataactaaaatcagagcagaactgaaggaaatagagacacaaaaaacccttcaaaaaattgatgaatccaggagctggttttttgaaaggatcagcaaaattgatagaccgctagcaagactaataaagaaaaaaagagagaagaatcaaatagatgcaataaaaaatgataaaggggatatcatcaccgatcccacagaaatacaaactaccatcagagaatactacaaacacctctatgcaaataaactagaaaatctagaagaaatggataaacttctggacacatacactctcccaagactaaaccaggaagaagctgaatctctgaatagaccaataacagggtctgaaattgtggcagtaatcaatagcttaccaaccaaaaagagtccaggactaaatggattcacagccgaattctaccagaggtacaaggaggaactggtaccattccttctgaaactattccaatcaatagaaaaagagggaatcctccctaactgattttatgaggccagcatcatcctgataccaaagccgggcagagacacaaccaaaaaagagaattttagaccaatatccttgatgaacattgatgcaaaaatcctcaataaaatactggcaaaccgaatccagcaacacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaagaggcctttgacaaaattcaacagcccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccacttctatttaacatagtgttggaagttctggtcagggcaattaggcaggagaaggaaataaagggtattcaattaggaaaagaggaagtcaaattgtccctgtttgcagacgacatgattgtatatctagaaaaccccattgtctcagccgaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcacgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctgagccaaaagaacaaggctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatatagaaagctgaaactggatgccttccttacaccttatacaaaaatcaattcaagatggattaaagacttaaatgtaagacctaaaaccataaaaaccctagaagaaaacctaggcattaccattcaggacataggcatgggcaaggacttcatgtctaaaacacttaaagcaatggcaacaaaagccaaaattgacaaatgggatctaattaaactaaagagcttctgcacagcaaaagaaactaccatcagagtgaacaggcaacctaaaaaatgggagaaaattttcgcaacctactcgtctgacaaagggctaatatccagaatctacaatgaactcaaacaatttacaagaaaaaaacaaacaaccccatcaaaaagtgggcgaaggacatgaacagacacttctcaaaagaagacatttatgcagccaaaaacacatgaaaaaatgctcaccatcactggccatcagagaaatgcaactcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatccaattactgggtatatacccaagggactataaatcatgctgctataaagacacatgcacacgtatgtttattgtggcattattcacaatagcaaagacttggaaccaacccaaatgtccaacaatgatagactggattaagaaagcgtggcacatatacaccatggaatactatgcagccataaaaaatgatgagttcatgtcctttgtagggacatggatgaaattggaaatcatcattctcagtaaactatcacaagaacaaaaaaccagacactgcatattctcactcataggtgggaattgaacaatgagaacacatggacacaggaaggggaacatcacactctggggactgttgtggggtagggggaggggggagggatagcattgggagatatacctaatgctagatgacgagttagtgggtgcagcgcagcagcatggcacatgtatacatatgtaactaacctgcacattgtgcacatataccctaaaacttaaagtataataataataaattaattaattaaaaaaatgtattaaagaaaacaagaagaaaacccaggagatgatatacttaaaagcactttggaaaggtcagttctatttttagaagcaatgcactaaccaatttattttacatgtcttttagaagatagtaatctaaaatagttgttaatcatgcttgttcatcatagactgcaattgtatctccagactatttaacaattttaacaggtttgttgaacccacagcccgtgggccgcatacagcccaggatggctttgaatgtggcccaacaaattcataaactttcttaaagcgttatgactttttttgtgatttttttttttaaagcccatcagctatcattagtgttagtgtattttatatgtggccctagacaattctttttcttcctctggggcccaaggatatcaaagttggacacccttgaattagataattgtgtagcctggcgctaaccagactgagttacagggactgccttggggagaggggaatgctattcaggcaaagatctagatcctcttctgattgatccagagaagatctgctgtttttttgttgtttttttttaacctactggacttctgcttaagatctcatatagtcttaggcaccatatgcttgtatataccttgagaatgtagataaatagattaatccagtgacccatccccatattctagtctatgaaaattttggcaaccatgagaattccagtttacatgaactgaattaacaatatattgtccgtattagagacagttacaaaaagatggaactgtgggttaagaataaaaaatgaaggtaatatggatggcaaatagtaatagaagtattgaaataatgtttttggagaaataaaatggataaaggaaagtaaagttgggtcttagaactgcaaattgaaggggatcaataagcatgtgagaaaaactgagggatgtagggaagtaagagatgagagccaggactctggaaggtgggaacctgaggaggtaggatataggactggaattttaggaggtagaagtggatattcctgagttgtaatgaaatcagaaaagctttgaaaattgggaagacaattagtccagcaagggaggaagacattaatcaaataatcactaaaatgtgaaattgtaaatattataacttagtatacaaaggagaggtacttgtattggtagtgtgtgggagcaatggctaagcttagatctgaggaagctgctgtatttggtgtgcatgtcacctctcagggtgccaagttccccacagatagttatctttaacacctagcaaactacagtcatgtgctacataacaacatttcagtcgaggatggattgcatataagatggtggttgcataagattataataccataatttttctgtatcttattaaagtttagatacaaagatatttgtcactgtgttacaattgcctacaatattcagtacagtaacactctgcacaggtttgtagcctaggagcaataggctataccatatagcctcagtgtgtagtaggctatactatctaggtttgtagaagtacactttatgatgttcgcacaatagtgaaattgcctaatgacacatttctcagtacatatccccattattatgcgccatacagctgtatttagagtgtcattctttctggatttgtatataaaattggaggcatagcagggagtggtagtggccagccatgactcaggctgattctgaaggtaataccagtgtggtcttaagaccattgacatattgacatatttgcttgttggtataaatttggaatctttgacccagaaagaaacaataggggagataaattccctcttaatcatttttttgagatagtttcatgacactgggtaggttttcctcagttcagttccagctgccttatcatttgtgaatctaggtgaattagtggggagggagatcctgaaaagtttctcagatagaaagtagaattagtcataagtacttattactgtaacaaaggtttggaatattctggaatctgtaatgaattaatagattcatatcattatattcagtaatatatattgaatgatgaatgaacagagatatagtacgtatgtacaagaagctttgagaagcaataagcctacattttagcatatttatgatgctacattttaactaagattttggaaaactttttacattaagcgtatgttttatttcaagttggcatgtggtcactaatgaaaagcttttatttttccttttatataagagctatgaagtcacatagggaactaataattttgtacagggttttgctccttaattgacatatgccttttgattctggaactgattacgaaagaagtctatctgtatccatgagcagttaactctttccagaattggaatctttaaagtgcattgtagctatcaggtccaaattaaggcatagatagtcacttgccaggtgagatttgatggcaaaagaaaaactaaaatgtggcctagaacttctttttcttttaaaagaggagcacttctaaccattttctgaggcattctaccacagtaaatcctttgattgtgggattgatagttagcattatttgtgtatcagaaatgagtcgttctggcagtgggacattgagagtggatgtagggttaggctaagttagatgatatggaaggggaagttgggaagtcggtggtgttttacctcaggacatctccactagcaattgatatgcaaatgattcatccagggagggaggagattttagaaataaagctcttaataggttttcagggatattgttttggggtttgatggactaagagtataaaggtagcttttctgacagcatggccctttagaatggtactacctccattttatgaattagtagttatcagttgagggagtaaggcagacagtttcccctttagtaggtattttgggaatttgtaggggggtgcaagaagaaattttttttttacagtaataaatagatgtggtccagggatgctagccattctgtaatgtgagggtcattaagactgataatgctataaataatattttataaattagagcattttgcagcatgatataattgacattcatctcagttgatgcatacagcagcactgtcaggtaaggagcggggtattatgatcttcattttagaaataagcaaaatgggactcagaaaccatgtgatttgcccaagatcatatggctaataagatagctgagaggtgaactcatatcctctttccactgaactgtggttggaaaaaatgattgactccgagaaaagatccaagtagtgttttcattcattcattcagtaatgcctgtttgacatttgggctttctgtctatgaatctatctttatcccatttcccattgggcttctagtctttttattcttgatttgcagaagctttttgtgtgtcttctagatattgtttgtcagttttacacattgaaaatatctcctcctgctctgttatctgtcatctttgtagtgtcctttattgaagagaaatttataatttaaaaaaatttattagagacgaggtttcactcaggctagagtgcagtggcacaatcatagctcactgctgtctcgacttactgggtacaagggatccccttgctttagcctcccaaatagctgggactgtagacgtgtgctaccacgcctggctaattaaaaaaatttttttgtagagctggggtctcaccatcttgcccaaactggtctcaaactcctgggctcaagcagccctcctgcttccgcctcccaaactgcttgaattccaagcataagccgccatgcctggccagaaatttgtaaatttgaagttgttgcctaatggtattggttttcagatcttaattaacaagttttcccccactattagttatcaagatattgtcttacagttttttcctaatatagttatagttttatcttttatgtcaatatctttaatccatcagaaatccattaaggatatattttaaatttttgtataaactgccacattctcctctagaaatattttacataattgtatctcaaccaatagtactttgagagccttcatcactgtttttagtttctttaattttgtcatacttgcgggaaaaaagtgatagctcattgttttaactattgtgaaccaacatcttttcatatattcattgtccatttatatttctttggcaaattacctagaaatacactttgtccattttttcttattgatatatataaatactttgtgtattatggatatttatgtttatatgatttttttcctgggctataattctataatttatctttcaactttggttatgctatcttttgttatctatgatttctttggtggttgatctttcagattttgctttatggctgtagtttttaaagttttaattttcagggcccttaaactctaggtggattatatcaattgatatttatcatattaggaatttaaactggaaaatttaaagaatatttaactattatctattatgcagtaagtccattacatggtatgtgtttttttgtgtgtttgtttttgtttttgagatggagtctcactgtcgccgggcttgagtgcagtggtgtgatcttggttcactataacctccacttcctgggttcaagcgattctccttactcagcctcccgaatagttgcaattacaggtgcccaccagtgcgcctgccaccatgcctggctaatttttgaatttttaaattaaagacggggtttcgccatgttggccaggctggtctcgaactcctgacctcaagtgatctgttcatctcagcctcccaaagtcctgggattacaggcgtgagccactgtgcctggccattacatgttagcatattgtaccaaacagggctccattaggaaaatagaaccagtagaacatatattaagagagttattgcaaagaattggcatatgcagatgtggagttgtctgaaatccatagggcaggctgttggaaagggcaggctagaactctcaggcaagggcctaagctgtagtccataggtggaatttcatctttttaaaggaagtctcagctctgctgttaaggcttttcaagtgattgaattagcccacccagattatgtaggataatctctagtacttaaagtcatctgtttatggacattaatgacatctacaaaatcctttcataacaatgcatagattagtgtttgattgaataacaggagactgtggactagccaagttgacacaaaactgactgtcatatattttttgtttgttttttgttttttttttaagagacagggcctcgctctgtcacccaggctggagtgcagtgacatgatcatagttcactgtaacctccagctcccggacttaagagagcctcctgcctcagcctcctgagtagctgggactacagatgtgagccactgcacctggactttacatgtattttttatggaaaataaatacatttttgactaaaaaaagtgaaaaaagagtggcgttgttttatgtttttgcaaatctctttagtgtctgacttaatagaagacagcctgattctaatatctgcttctgcattcagtctgttgcactctgttgttttggttgagatatgaagatctggccttatactggttatagttggaaagggaggaatattttaatagtctcttcagataattaaagatatgcttctttgatactacaccaggaattgagtaatagttgcttagaggttagttgtgatatagaatctgaaaccatattattgcattttttctacagttacattaaaatctattcatctgtcttaggctcttaatggatatttacctatgcatgattttgtaatattatgcatttatcactcagaaaatattggttcactgtcttatggagttctaaatgttgacacattttattactcaatataaaaaaatttcattagtatctccactgatctgaacaaaaagtatttaagtattgggatgcagtcaaactcatggtagcagatgtaagttttttaggaatctgatttttcattaaaagcttgaattttatcattggcaataaatattgccacttgtttttcttgaagtgtcgggcttactttgctcattttgagaaaacgtctaccaaatacttaagtcagaaaaaccataacttatctatcaatcattctttcaagtaaaaatggtctcccatggaaaaagtgacttcttagtctgagaacccaattgtacagatgtttttccttgagacaatggttgtacttcagaatgtagtagaagtgcttctattttgtcaaacagaatattaaaaatatgtctgtgttctaataaaactctattgacaaaaacaggcaatgggccatagtgcacagtttgacaacccctgctttatttaactccttgagcaaatgtagaagattaataatagccgttttgaggtttttatccatgaatgccatcatatatataattttttaaatctgtttttattgactgatttttctcctggtaatggatcttttcctcttcctttacttgtctggtaatttttcaattcgatgttaaacattgtaaattttacgttgttggtgggtgctggattttaacatatgtttttcaagagtgttaggttttgttttaaggtacattttagtattagtttgatccttttgcaggttgcttttctatgttgttatggaaaaatcccaggtacagtcatgcttcgcttaacaattgggatatgttctgagaaatgcattgttaggcaatttcattgttgtatgaacaccctacagtgtacttacatgcacctagatggtatagcctactgcgcacctagactatatggtatagcctattgcttctaggctatgaacctgtacagcatgttactgtattgaataggcaattacaacacaatggtaagtatttgtgtatctaaacaaaggaaaggtattgtaaaaatatactatataagcttatgggaccactgttgtataagtgatgcatcattgactgaaatgtcgttatgcagcacatgactgtggttttttattctgaaacttatttagcttcactactaaggtaaaatccttctgaaaattctgcccaatgcccagtgtataataaggtctctttattcttcaccttgtgtaaacccgaactgttctcaccctgtgtgggcactaggaagtgttcagtctgatactttctggtggttctttcctcaacctcaagtagtttcccttcacacatgtgcagattagttctcaagtggccctctctgcagatctttgcagtgctcactctgcacacctgcttcctctctggtactctgccccataagttctagccaccttagctttcccaaactccgatccccatctcctcaactcaggttgtctaccaggctctgtttactttccctttcttgtgttgcagcctggaaactgcctctggagcaaactgaggtgattgtaagctcattgtgtttgtttcctttctctcaaggattacagtctcaagctttctattgttcagtacctgaaaactcttatttcatgtattctgtctgattttctacttattattttagtgcaattcatgtaccagttaatcctttgtgggctaaagtggaaatcccttctttcattctctcttgagttcactctatccaggcttaagtttccagctctataatgcaactgatttaaaaaattttatccaacccaatagcagcattcgaaagagttgatcactcactttttcttgaaaagctctcttcccttgactttttatttttttagacaggttctcacctaactctgtcacccaggctggagtacagtggtgctatcatggttcactgcagctttgacccctcagactcaagcaatcctctcacctcagcctctcgagtagctgggaccacaggcatatgccaccatgcccagctaattttttaatttttagtacagataaggttttggtatgttgccctggttggtcttaaacttctgggctcaagagatcctcctgccttggcctcctaaagtgttgggattataggcatgagccaccatgcccagcccacttggcttcttggaactattctctcttcttttacacctaccttcttggtcacctcctcctctcagtcccttttgctggatcctcctcatcattttaacttctaggctttggggaatcccagaactcagtcctaggaccttttctcttctatatctgtactcaatccctaatatcatctggtcttatgatctttaaaatcttttataggctgtaactcctattgatatctgaattctgagctttcccatgaacttcagattcatattcatttgcgtaatgacatggaacttggataggtttacatacatggatttcctgatatgtccaaaactgcatttttgtttcccccatgaaggaaataaaacatgcaaataacaccaataaccaaaacctttatgtgaatcttgtcttttctgcttcaataaagttgtgattccattcttctagacactcacccaattagtcaagaaattctttctttttttttttgagacggagcctcactctgttgcctaggctgagtgcagtggcgtgatcttggctcactgcaacctccatctcccagattcaagcgattctcttgcttcagcctcccgagtagctgggattacaggcgcccgtcaccacacctggctaatttttgtatttttagtagagacggggttttgccatgttggccaggctggtcttgaactcctgacctcaggtgatccgcctgccttggcctcccagggtgctgggattgcaggcgtgagccaccgtgcccggccaagaaattctttcagctcctcttttgaactatatcttgagtctagttacttctcatcacttgacctgttacttccctgggtgaggtcactaccagctcttaactggtcactaccagctcttatctgtgctagctgatctccttgctttcattcttgcccaagcctcttctccattgggcagttagagcagtccttttaaaaaaagaagtcagatcatgttgttcctgcttctaggcttcctattttgctaaataaaagctaaaaaaaaaaaataccactttagcaaaaaaaaaaaaaacaaaaaccacagacctaaaggtcttatgtgatcttggccttggctagctctttgttttcttttattctccctcttactctctgtgttccagatactttagtctctttgttgtttctcagacacaccaggcatctttccacatgtaagcttttgcacttgttataattctctattcttgtgtgctgtttcactgggtatccacatggttcattttcttatctcttttaagcttttgctcaaatgtcaccttattaataaggctttgtcagttcacctgacataaaatataaaatagcgctagccccacctgtcacattctattctctcatcctgcttcattttcctctacagccttattacctcatatataatatatatttatttgtttgtcttcctcagtagaatttaaaccctatgaggtaagggcttttctttttcttttggtagtggtggttgttcattgccatattctcagcacccagaacagtgcctggcatatagtaggtcctcaataaatatttgttgaatgaatggatcttagtgctcattttgaaaagaatgctttttataaacagatatccactagatggcattattttcaaactttatgtaattaatgtctgggagcaaatgataggttattttctgttttttgccctaaacaaaaaagatctttgcaatgaagattgtcacaagaagttactaggatgaatgtgaggcatgtcgaatattgcatttatatttggtttttgatttatatatttttagatgtttattataaaataaaaaacatttagagaaacaaaattacagcatattggtgtgtaaatgatccatttaatacagttatttagcatggtaactgtgaacaaaggttgttcatgtctatccattgaccaccattccttttgtgaggccttcagcaatggcaaagcagcagtaagttccagagcctttcattactgaagccactagtggaaatccagaaaattgtcagctgttcagttcttgttgctaatgagctaggtactctcaatctggttcctaatcaactgggcattcaaattttgaaaaatttccatgtttctagaagatgttgccagacctatcctgttaaaaactggtaggttctaagtgccagagatttttagctgacttctctgaccagcactaaactcagcaaatagtttccctaatcaaaaatttacacttttcccccaaaccctcaggatttggctgctctgcctgtgccaatgccatctcatttcttgatttcctcccttacctcatttccttcttccatttcaatccctgtgcctctcttaagctcttttcctggatggttatttgatccattttattctcactcttcacacctcttttggtactattccttattcatgaagtattttttcctcttcctgttcaacttagctatgtatatttttcttttcaaattgttcaaaaatacacttaaaaacagttgttgaagttctctcttctcttttcctgttttgggcttttctcttttatttctgatcatagcaaatgtaaggacttgttttggttatgtttttaaagttcccagcttcttctcagaactctaactatttagaaatgaaaacactgttcttttgtacttttgagtctctaaatggaaaacaaaatataggatgctttttgagtttacagcctctcctcccagttcccctgggatggctaagtactagggctgataaaatgtcatttcatttaaaatgaaatgtgatggttaaactcaaaacatttaaaatgaaatgagatggttaaactcaaagacttatatttttaacatttttaaccataaatatgagaaatttctagtaatgctttccatatcttataatatgaatgatggcattttaacttgtcactctcttgtgtttggcctactgcatgtattaaactggctttgaggccagaattcagtgtttagaaaatcatgttttgtttactaagaaagtattggaacattaatttatttgggccataatttaaaggaattattgcatagcattaatttgcatgaattgtttcaattgagaaagtgtatttttctggaatgagacatgaagacttactgatatctattataatacaatataccatatttgttcaaatatacttatttcattcaagaaaatgaaagcattcttatttagtaaacatatcttatagctgctactctaaatatcacttacaaaaaacatatttaatcccagaaagataaatctcaagagacattgttgtttgctcaagattagatgagatccaacagcccttgctggttgcatgctctgactgctaacctctgttagtgcttacaaaagagagcttaattctaaatctgtatattaagccattttgcttatacctgctctattgataaggcttaggagtttctcaagtaaaattaattagagattcagcaatgtggctttaagtagaattgactgttttcgtttgtgctatttttttcacccacagactggttgaaatagcagaatcccgttttcccagatattttaacactgaagaaaagttacttttgacaagtagtaaagttcatctttatcgggaactcacctgtgatgaagttctacaaaggtatgctgctttagattttgattttttagtaatgcgttgaaggtttatgttttatcttttatgtttcagcttctaagtgaaaaaagtctttataggttagaattatgtggagtaactttttcagtgttcttctttgttatagccttttggttgaagtctttcttgaaaaacaaaaaaaattaaatgaataaaatgttctgtatttaattaattaagtggtgtattatttatctattgtttcattaacaaattgtctcacagtttagtagcttaaaacagcaaatacatattatttcacatagtttctgagggttaagtgtctgggagtagcttagctgggtgtttctggctcaatgtcgctcaagaggttatagtcaagctggtggccagggctgcagttatcttaaggcttgactggagctggagtacctgcttccaagctccctaatatagttgttggaagccctctgtttcttgctggcagtgggcaagagacctttgttccttaccgtctgggcctctccataaatcacaacatagcaagttgctttcctcagagtaagtgacctgagagactgggcaagtgaaagagtacccaagatggaagctgtagtcttttataacccacactcagaaataaggtaccatgatcttgtcatatgcttgtggtcatacagatcaagtctggcacactgtgggagggacctatacaaggatgcaaaataccaagaggagggagtaagtgtgggccattttgcagactggctaccacaagtagttttaccccagaattggagcgttaacattatcttaggagaatcaaggaattctgaaactacacagaaacagtttgctctgtttccagaaaagtatgatatgtctacaagttaggtttactgaattcttgcaaatcattactgtaacttaggaaagaatagtttattgtttttaagttgcttagcctttgcaatacctttatttatttattttatcttaaatttattgactattttataaattcttcttttataggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagtaagtttttctttttttctcttttttcttttcctttcttttgtttcttttatattacattcactgacttatggtatcaaataataaaattagaggaaaatgtaaaacagatgactttttaaaggtagtacagtctaattgctatagcaaacatcgccatcatcttaaattagctcatctgctgagattattttattattttaataatttgagtctggagtagatttaaacgatgtttttaaaagttcctatagtccctccttttcttccttctcattgtttactctttgtgtgtgctttgtatcacatttctcacactgcagtaaatataaagtagtaaaacttcatgaaattgcctagatctatttctatataattaaaaaaaatactgcagttgttgttagttttgttttaagtattttaggtttagatactgtgttattgtgttcagcgctgttttgtgtacaataggatttggtttgcttcaaatggtcagaggtcaaccattaagagatgttggaatgatagtaatgaaagtgtcagtaagaaaaccttgaaagattatttgtggcatggctttttgtagcgggcattgtgatcagaaatctgaagatgacaggctattacaagggcttgtgatgtgtaacctgcaagacgtaagtgtgtactaagttacactcccatctgcagtgtgtcagggagttttagtcgttgttccacagcctcatcaacattcaggcttctcaattttagtcatgcttcatctcaagaaaagatagttccttaaactgagataaaatttggttatgattttataatttttagatttgtttttggaaaattaaaatcttggatctttgcaacataaagaatatgtataaataatataaactatcacacagcctttgaggtttataaaaccaaggaagaagtcaagggagaaaatatgacattcaaaaagttctgcatactttaatggctttttagtttatattttgaattaaagtcaagtgctgttaagtttgtcttgggtgatgttcatcttttacattttattgtagttggttaaaatgataaattcaaatttatatttttcctgatcaaggagaataagggaactttgaaatactgtataaagatacttgattgaatagaaagttatgtatatagttggccctctgtatctgtgggttctgcatccatggattcaaccaactaaagataggagatatttgaaaaagcaatgggtgtggtagtgtgcccctgcagtctcagctactcaagaggctgaggtgggaggatcacttaggcgcaggaggttgaggttgcattgagccatgttcatgtcactgcacttcagcctgggagacagagtgagaccctctctctaaaaatatatatatatatttgaaagaaaagaaaaggatagttgtctttgtactgaacatgtacagacttttttcttgtcatgattccctatagttaagcagagatttacatagcatgtacattgtattgggtattataagtaatgtaaagttgatttaaagtataccagagaatgtacatagattatgtgcaaacactgcaccattttatatgagggacttgagcatccgtggattatggtatctgcagaggagtcctggaaccaatcccccatggatacagggggatgactatatattcttattttattattaattcatactgttgcttgacttaattccgtgcaaaataaaattcactttttaaatgttgtgtttgtttgcttttaagtagtaactgtaggctaatgcttttcagtttttcctaaggtgatttattttcccaagtgagaaaggggcactgcttttctttgtttttaatagaaccctctgaaaaaataggtactgaatatcccatttctatgcctttggctttgtttctctatttagaaataaatgcagattatactatgtacttatataactgtgatatctgttttttgtgacaattaagattgtaagattggttttaaaaggattttgaaaaatatttcctttagaaaatgttggaattttcctagctaaattgatacatttaaatggaaaatctctcacacaggtccgagatttaattaaaaaaaaaaaaaggaaatcatgaacttttacacatttatactgtactttgaacaggcaccatagtactgttcaaattaattatgtcaatttaatatgttatatatgataatttgctaaattaaattattgcttgctatatatataagcttacctcacagattgtcttgaaatatgtatataaatataaatatataaaaataaaaaatatatataataaaaatatataaatatataaaatgtgattattcagcttttccccccctttctctatttgaactagtactagaaaacctcgtcttttgggaagggtgacatcatttggcccttatgtgcgcatgaatgcatttaagttttaagtatgctgttgcttttttctacgttagtccctgagaattaaagaggaattaatcgatatcacttgattgaaaacagatgtattaatatctttcagaagttttcaattataagatggctttactaatattttgaggctatcactgaaatgaaaacataaaattaaaaaattttcacagagaattttatagacctttgagtatgttcagactgcagttttgagaaacagttgtagaagtctggtagaatcttttctcctgaagtttatggaggaggtgtaagtgatactctgccattgggatggaagatgcggaacctttgtctttttaaagtgttcacactagtattgaaaaaacagtaggctctgaagctgtttagagatactggataaaagtaaccgaaaaaaatttaaatactgctttataaaataaattgtggttatggctatttatgttgactttatcattgacttctaattaccacgtacagaatagttattatacgtattgtaaattatgtatcagattaaaataataggatgtttttgccagaaaggaccttaaagaaaatttagtttggccccttcattttacagatgacaatgaatccgaaaagtgacctgatttgctccaggacactcaacataggaaaggacaaacagtgggtagaatgagagatcttttagctgccagtttggggatttttttttttccacagcagaattttctttttttctgagacatacagaattacggtggactgtaaacttctttttatttatttattattattattatactttaagttttagggtacatgtgcacaatgtgcaggttagttacatatgtatacatgtgccatgctggtgcgctgcacccactaactcgtcatctagcattaggtatatctcccagtgctatccctcccccctccccccaccccacaacagtccccagagtgtaaacttcttaatgacaggattatattttctgtttctctgatttccaggacctagcactgtggataactaatatttaggaggtaacagctaatgaaagtacaattaaggtttatgaaaatagtcttaccatatgtatgtcatatttacattcattggaatatttttctttatcttttaaaacataatttgaatttttttatgcttgctgctgaaattcttatgtttttgtttttaaattgacctttgtagtatgccatcttagttgtattctttttatttattttccattccagagttttataagttgttggaataaaagaaaatgaaaatgcattgcttagataacaggactttcaccttttgaaaattctttggaaatgctttttactggtatttccaaggtctacatttttactttttcagagaattcaacaaatcaatttcagttgttatatgaataatattgaacttttttgtctccccttaatcttcttctacttccttcatttcttgatattgtacaaatgttttctggtgtaaggggaggagtaccagttaacactatttacaaaagaggtttatggagataaatttggatatattattaaatattctaagagggaaatgccttattttcattgaaagttgttgttaaaatccaaattattttactaagatgtgcttataatccgtttttctgtggccatctgtgttcttgattacatgccttttgagaatatccattgctctaatttattgcttatcaaggtttttggaatattagtgattatttttatgtttaaagctgcttagacaaatgaatcaaaatatgtgcattttaaattttgctattttaaagacagttttaaatcattaacaaatggaaagaatttgttctggttttaaagtggacatataacaaggttaaattttttattattatttgagacaagcacaaatttttttttcctctttttaatggtgaacttcatgtgggcctggatttatttatttatttatttattttacaccatgagctgttccattatgccaagtgggtttaatttatgcaggattataccttgtcttagatactaataaatattcaaaatagaaaaataagaaactaggccacttcatttaaaataattaaggttttattaattataaattgggaatattgtgtttataactggtgagataagaggaaaaagaatgtatgtacccaaattcgacatttatttttatcttaaacataaatattcagaactgtcacttttgtgaaagcctgatgaagtcactctgattgtaaagtaggaatcctagacccttgatgtagacatagatatgccattaaaactgcagtcctgttttgctgtgtgtaacattgttgtatcacttttctagaaatgtaatttttggtttactcttattactttcatatttttactgaaaacaagcaccacaggacttctgaggtaagaaaagtcctttacaggatttttcttttccataaatgcttactgttggctcactcacatttgaaatcagattgttcttaaacctatcctatgttcattcaggtccctgaaactcacagtctagactaaacctttatcagttagtgaaaataattctagaaaaagtgtatctttcttttatgtagctctttatgacttctgaaactttgtttttattgtttctagcaaaaacctagaaacaacttaaaagttagtaagtaggtgattggctaaattaatgttgacatatccatacaatattatattgtgccactgttacaatgaatggtttagcccagaaatggattcataggttatgcaggcaagggttaattcagctagcatgggttactcatatccagccattcccaaaaaaggcctcttttcaggactgcccttgcctggctcctgggagatgagtgctgggccctgggaatactctgcctagtaagggtgttatatgcctgaggacttgagccacaggtactggtttgatcagattgtttatgcaaacagtgtgatttatggtgaagcctatttttctctggggatctggggactacaatctaaatagctgaggtcatctgcatgcaggcattgcatgcctagtgactgaccctcaatagaaatgctggacattaaggcttgagtgaactttcctggttgacattactttgcatgtgttgtcacacattgttgctaggacaattaagcacatgcatgcgactccactgggagaggacacctggaatcttgcacctggtttctcctggactttgcttatgctccttttctgtttgctcattttgatctgtatcctttttctgtaataagccataactgtgaatataacagcttttgagtcctgtgagtccttctagtaaatcattgagccagaaggtaatcatggggaaccttgacatgcaggggtgctaatagatatgtacaagagtatctatggcagcttaatttgtaattgctcaaaactggcaagatgtattgtagttaatagtattggcatcagtcttaatacattggctttgataattatggtttgtaagatggtgatattaggagaagctgggtgaagggcatttgggaactctaccctttctgcaactttttggtaaatctaaaattgtttcaaaataaaaagttaaaaaaagaaaaggaggtcaggtgtgctggatcacacctgaaatcccagcatttgggaagctaaggcaggaggatcacttggccaggagctagagaccagactgtgcaacatagcaagacctcatcttctcacacacacagacacagacacacacacacacacacacacacacacacacacacacacacaaaaaaaaacaattagctgggtgtggtgctacacacctgtagtcacagctacttgggaggctggggcgggaggatggcttgaacccaggagttcaaggctgcaatgagctatgaacatgccactgcattccagcctgggcgacagagcaagaccctgtctcaaaataaataaataaatagaaataaataaataaatgaaaaggagagtagggcgggttttatgagtagaagttggctctgggtagtcataaagaaatggcactggctgtatttggagaaggggacttgattttgatgcactggttctcttctatttagtcatctggtcccatacatattatctaatacctcttcaatttaaaccctgctcttcatctttcagcacatcctcttggctccgctttcgaaatacattcagtatctgattactttctaccaccttcattgccatcatcttggttcctggaggctaaaagtactggctttggagttagacgttggtttgaatcttagctccactatttgctaattttatgaccttgaataagtatttatcccagctctaacctttcgtttccatgtttgaaaaatgaggataacaatatctgactcatagggctgtgagtattaaatgagataatgtctgtaatgttcttcacaatgtttggcatattcagtaaaaagtagcctttaattattaattttactagttacctcgttccagatgcctggtgtattttatctctttcctcctaaaatattttttaacaaggctgcaagtgcctcagaaggaagaatcatgtcttattcactattgtatccccctctgtctgtcttactggtggatgctgttactgcctgaaccctcctttatctggttaacttacacttattttttggatctcagactctttttgtctttccttttcgattccacctacagcacttgtgtccaaaactccatgctaggaacaatgggataataaagatgaataaaacatagtatttgcccttaaggcttctacaaataaggtaattgtagaggcaaatcgctctctgtgatataatggagaataaaataagtatcttgtctactgttcctttcctgtttcttaaaatatgtaagtagcttgtaagtaacttctctgtctgtcctttgtttgggactatagattacacagagggaattaaagggaggtagtagagaccttcatagtctctcgggtaaaccctttatcatgtctagctttggtccttaaatgtcccattctttttttctttttattttttgagacaaggtctctctctttcccaggcaggagtgcaatggcgtggtcatagcttactgcagctatgccgagttctagtgatcctcctgcctcaacctcccaaatatctgggactagaggcatgtaccaccatgcctagctaatttttttgatttttagtagagacaggtcttgctatgttgcccaggctggtcttgaactcctgggctgaagcagtctgcccactgtggcctcctaaagttctaggattataggcatgagccactgtgcctggccagggttccattcttatttagaaagtcagtgctcttttggagactgataggtagtggttaaattcataaagcacatgcataattctaaagttgtatgctaagaaaacattggaaatgaaggccagttgtagctcttagtctttagcgttactttacgtatgttacacagtaccttgatttgttgtagaattttctaactgaagatcttaaggttgtagctgagtggcaatcttgttttccagtgagtacagggatgcagagaatgaggtgatttatgtaagattgcttaaggagtcatttggataattgaataatatcacttgccgcttccatcctgggttgttattgtagtatcttaatgggtctgcttctctcttttctgtatcggtaatagtacatatgggtacataccattgctacatcattttcccaaagtgtatttctgatcacatccctcctatgctcagaagcattgtatggtaccatgatgcttatagaattaagccactagactataagcagtatgggggcagagaaactatttgttttgtccacagttgtatcctttgaagctaggacaatgtatggcacataatatatgctctaattaatatttattgaatgattaagtcttagtttaggatatgatataatatttaaagttctcttccttctggctccaacctactcctcccatgttgtcatttctcttctgtgcaggctgctggtatactaccccgagacctctctatggctttttagctgtggatgtcctcttctttcatctcttcctttctaaatttttttctttcctatctgagctctcaagttctgtctctcctctgagatttttgtatcactgttttagccccagttaattctaccttcttttgtagtacacatggtcttaacttctaattggaactttaattatgtatttgccttgcagtgtcacttaaatatttgcatgtatatatctgagctcctcagttatattataaagccccctgaaaacagaattatgttcttatgcatcctccatagctgcctatattgaatagtgtcatatattgagtaggtgtccaatatatatttgtagaatgatgtatcacactttttctagttaggcaatttttgaaatgcatgtctaattagatgcctacttcaattcttacactacttaaagggaaaacattctaacattcattctaaaaattgaaaagatactgggaaactaaaacttaagtgtctcccctgcacccctttaaaactgaatgtagaagatttgttgataatttgacagctctgtacctttaatttagtatgatgcatgaacttctgtgagacatcaaccaagattttatacgaagagctgtgatcatcaaggtgggaatttaacatcagtgctctgtacacatagtattactgtaatgccttctttagaagtttaacaacgtcaggtgatattctatgttatgatttttaacttatcaaaggaaagcattgtagagaaattagatcatctcttgaatagaatctgataactgctcactgtttaattaaattcaaataaacagtttgaaatagaatattggctgtatgagagtttggtcaaaggatattttcttgagtttttcaaagacaaaatttgtttttttggttgatatttttacatatcctttgcgtttcttgaatgtagttcacttagttaatacagtacagttaatacagttaccttccaagtaaagctggagggaaaatactttctgataagaaaatatatttcaaataataaaacagtatgatactagcataaaacagatatatagaccaatggaacagaatagagagcccagaaataaacctgcgcatgtgtggtcaattgatctttgacacaggtatcaagaatacacaagggggaaaggacagcctcttcaataaacggtgtcaggaaaactcgatattcacatgcacaagaatgagattgggcccttattttataccatacacaaaaaataaattcaaatggactaaagacttaaacataagacctaaaaactaaaaactcttagaagagaacatagaggaaaagctttgtgacagcagccttggcaatgatttattggatatgacaacaaatgcacaggtaacaaaagcaaaaatagacaaatggaactatgccaaacttaaaagcttctgcatagcaaaggaaataagaaaaggaacaaacaactcacgaaataggagaaaatatttggaaaccacaaatctgatgataaagggttaatatccaaaatatataaataactccaaaactcaatagtaaaacaagaacaagcaagcaaacaagagacaatacaattaaaaaatgggcaaaagaactgaatagaaatttctcaaaagaagacatacatatggttcacaggtataagattcacaaagttactaatcataagggaaatggaaatcaaaaccacaataagataacactcacatcgcttaatacggttattatttaaaaacccacaaaagatagtaggagtgggcaggatgtgaagaaaagagaacccttgttcactttttttttttttttgagatggagtttcgctcttgctacccagtctggagtgcaatggcgccatctcagctcactgcaacctctgcctcctgggttcaagtgattttcctgtctcagtctcccaagtacctgggattacaggcatgtgccaccacgcccagctaatttttttgtatttttagtagagatgaggtttcaccatgttggtcaggctgatctcgaactcctgacctcaggtgatccatccacctcagcctcccaaagtgctgggattataggcatgagccaccatgcctggtcccttgttcacttttggtgggaatgtaaattggtgtagctacctgctatggaaaacagtttggaggtttctcaaaacattaaagataggactaccatatgatccagcagtcttatttctggccatatatccaaaggaattaaaatcaggatctcaagtaaatatctgaattcctatgttcattgtaggattattcccaatagctaagtcatggaagcaatctaaatgtccatccatggatgaatggaaaaagaaaatgtcatatacacacacaatgatatattatttagccttaaataaaaaagaaggaaatactactatctgtgacaacatggatgaacctggaagacattacgctaaatgagataagccagacagagaagaacaaagaatacatgatcccacttttactagtatatggaatctaaaatagtcaaactcatagagcaaagagtagaatggtgattgccaggggctgagaggaggaggaaacagggaggtattggtgaaagggtaaaagttttagttacacaagatgataagtcctggagacacagtgcctatagtgaacagtaatgtatacttaagcatttgttgaaaggtagatcttacattgtgttcttatcccatacactgtataaataaagagcacaggtggaaacttttagaagtaatggatgtgtttatggcattgaccgtagtgatggtttcacagtgtacattctccaagttgtatgcattaaacatacacagttttgtatatgtcaaacaaataaaaagccagaaaacaactttaattttcctagttagaatgttttccctttattgaatataagaattcaagaggcacttaattaactttgtaagattaaaaatatttcccaaacatttaagaatctatgtaaaacataacagctgtggtttaaaggttttattatcttccaatacaagtaacaaaatgtaaattagaggatattaaaaattatgtatttttcacttgaacattgtttcctaccccttttttgacttctgtttatctttgatattgaaagataaatattcttgttgattttacatctctattaatttagattcttttttttctttttttgagtcagagttttgctctgttgcccaggctggagtgcagtggcatgatcttggctcactgcaacctccgcctcccgggctcatgctattctcctgcctcagcctcccgagtagctgggactataggcacccgccaccacgcccggctaatttttttttttttatatttttagtagagacggggtttcaccatgttagccaggatggtcttgatctcctgacctcgtgatctgcccaccttggcctcccaaagtgctgggattacaggtgtgagccaccacacccggcctagattattttaatgttgactcagtttctgctgggaaatatcttcttaaaagtgaaacatttgcattagattatagcttttttaaccttaaggctattttgatggttataggagagaaaagtatgtatggctagacagagagcaatagttctttttgtattaccattaatggtttgaacctaagctccttttaaaattaaattttgattataaacatttgggctttgaagtcccttttaagatcagggtccttatttattgtctcagagtttgtgttaattgttttactggaaaaaataagtagtcattgacattgaaaaaatttctacaggtttgaaatgctgttaagaagaaatagctacatcttattgataactactttttttgtttcgggttctgtagtgagtacattttaaacattttccatttcatattctaaataagtttgtgaggtaggttatactattccctttttatagttgaagaaattgaggcttatagaggttaaataactttaccagagtcacttggctagtaagtggaagggcttgagtttgaatccagatatgtgtgattacaatgcatgtgttcttattcataatggaacactgcctcctaatgcagtagtcaaaattattctattcccttgctgcttatcatactaaaaacttttcaatacttattgtttcctctaagcctttttcaatggaaagtctctaattttgctttatgctttgattgctgcttgtaagtgtaaccacagtgttgcttctgtattagtgttatcagtatttaaagtaagagaaatatttgattatttgcagctttgattgctttttcacaaacatgcaaatcacacatgtaatgttaagagtataattaatgccttttatgtgccagtgaatatactgaagacttgtaggttttctgaacaatattctcagaattggcaaacttgtagcttaagtcttgtaataaggatgctgtcttaggaaaataatttcaaaatacttgcactttagacctctcttggggaacacatgaagtaaggctgcttcctaagattctgctttgaggttttatgaagacacaatacatgctgttactggacagaagacattttagtttcatgacattgccaaatgtatctcgtaaaattcactgttcatgaatttaattaaaagttcttaggagcttaaaacttaaagtaggtattttagactcatgactcaaaggatcttctttcagtttgtgtgtgtgtgtgtgtgtgtgtgtgtcatacacacacacacacacacataaatatatatatttgaaggagttacagttctaaactaaactggaataaagtaatgcccatagttattaagtactaaagtacagtattttaaagaaatgttgaaattgttataatatgaagtttcttagtgcccctagcttacagccactaaagttagttttatatctgataccatattgtaatgaatttacttttttgttctgtatgatctttagcttagtttactgggttgcccaataacatgggattgacctgcctgctaaccttgtgttggagtctgcttagtccctagttcagctaggtccaagtttttgtctcatgaccaagaagaataaggcttgcagccactggagagtaaatagagtagaatttattaagcgaaaggaaagctcttagcaaagagaggggacctgaaagcaggttgccagaaataggactgagttctgggtcttttatgtggcaagagcaaggaagccttctgtgggttctgcccaaaatgggagggctaaagttccctcctaaggatgttgcatctgtgcatgcctggggttgactccatcttagttattacccgtgagtgcctaagcgaaagccacaggggtactaaaaccacaatgcgaatgtcatgttaatggcattataatgagttgggccaagttaaggacatttaggttgacttattgcgcctgtgcctaagttgggatggtcccttctgagcaacatcctggcatgagggtaagttcttaatcatatttcttctcattagctacagggacagtgcaggtgcagtcctgtgggtatttttccactccgaagaccctccctctctatctgcctaaactgcctcctctgtcacttggaaatggcagtttactgttgaacaatagacctctccttatgcttttctcttccagtctttgggaatcacactctgaagattaaacatttcactgagacagcatgacgcagtagaaggtacccagaatcacaatacagttcacagtaacaaagatatggaatcaaccaaagtggatgattggatgaggaaagtgtagtatatatacacaatggaatactattcagccataaaaagaatgaaataatgtcttttgcagcaacatggatcaaactggaggccattatcttatgtgaaataagctagacacaaaaagacaaataccacatataagtgggagtgaaataatgtgtacccatggatgtagagtgtggaatgatagacagtggagactgggaagggtgggagggggttggatgatgagaaattacttaattggtacaatgtatgttattccagtgatggatacctggaaagtcctgacttcatcactatgcaatatatccatgtaacaaaattacactgtatcccatacatttatataaatgaaatgaaaaatgaaagaaaataggagtttaagtaccatatgtgttacaactagctgtgcaatcctggacgagtcagttctcatttctgagcctcagtatccctatctgtagaaagtggctaaaagttgctacctcataaggcttaatattattactaataatattaatagatgaatagtaatatatttccgattactaaactttatagaggtttttataatttataagcactttcatatataataattttatagggatgtatatttatctatatttctgaaaggactttgtaaattctgaagcactacgtaacttgttagttgatagttccataaccagctaaatctgatttagtgactgtttttatccttagttatttgaacaatgaatcagaattttctaagctcagataatgcacttaactcaatttgttcagctaaaataaaagttttggaatgttttttaactagtgttaagatttgttttaaaattagattgtaacgacatctggcttttatattattatttaaagatgtagaaatggtgatgtagtaaaaatcatgagtggttagtagttgggggctagtgtcatttttaggagttgcagtgatgaactctatccactaaatttagtgatggatcagtgtagttcttttaaaataaatatttagtactttatgtttacagaggaccctgcaattattagttagcttataccaatatttattgctatataaagggctgggcaagtgcctataatggccacctttggagaggatttacaggcacctttgagaaaacttcttttttttttgaagatggagtcttgctctgtcacccaggctggagtgcagtggtgtgatctcggctcactgtgacctccacctcctggattcaggcaattctcttgcctaagcctcctgagtagctgggattacaggctcccaccaccatgccctttttaacagctaatttttgtatttttaggagagatagggtttcaccatgttgaccaggctggttttaaactcctgacctcaaatgatctgcccacctctgcctcccaaagtgctgggattacaggcgtgagccaccgcgcctggcctgagaaaacttctaactctgagtttagttggtttgtctgtatactgtcaggaatctgcaaagcttatttgatcgtttatttgtaccagcattttccctgagaagttattctgaaaaatactctctctcaaaatgataaaaaccttttctgtgcatttgtttcagaatcttaccgcttctaggacctagaacttctttctgaagtgtaacctaaatatttgccttaagaagttaaataactaatatttttagtgtaaccaccatttaaggcatttaaaaaaaatgaaatagtctgctttcaagactcttgtttctattatggatataaaacatatttttaaaaagatcaacattataaggtagtagatagtaagtattaattaggtgtttgtggcagatactgttagttgcctacccaaaacttatttccattttcaccttgttaatagaaccctaatcgtgttttggtagctgtgtgcccagcctcagttcatgacagtcatgttttctgatttcccaacttcttctacaactgaggatagccatgtgatcgagttctggacagtgttacctgtttagctctccattttttttctttccaacttttatttaaggttcagggggtacatgtgcaggtttgttatgtgggtaaattgcatgttgtgggggtttggtgttcagattatttcattacccaggtaataagcatagtacccagtaggtagtttttcagtgcataccctcctcccaccagccaccctcaagtaggcccccgtatctatggtttccttctttgtattcatgaggactcagtgttgagcttctacttacaagtgaggacatgcagtatttggttttctgttcctgcattaattagcctaggataatggcctccagctccatccatgttgctgcaaaggacatgatttattcttttttaatggctgcatagtatttcatggtatatatgtaccacattttctttatctcgttcaccgttagtgggcatttaggttgattccatgtctttgctattgtgaatagtgctgtgatggacatatgtgtgcttgtgtctttatggtagaatccttatattcctttggttatatacctagtagtaggattgctaggttgaacgatagttctaagttcttcgaaagattgccaaactactttccacaatggctaaacttattaacattcctaccaacagtgtataagcattcccttttctctgcaaccttgctagcatctattattttttgagtttttaataatagctattctgactggtgtgagatggtatctcattttgattttagtatacatttctctaatgattaggaatgttgactttttttttttttttttttgagatggagtcttgctctgttgccaggctggtgtgcagaggtgcgatctcggctcactgcaatctctgcctcccaggttcaagtgattctcctgcctcaggctcccacgtagctgctaagcatgccaccacacccagctaatttttgtatttttttcatatgccttttgattgtgtgtttgtcttcttttgagaaatgtctgtttatgtcctttgcccatttttaatggatctgtttgtttttacttgttaatttcctcaaattctctatagattctggatattagatctctgttaagatacatagtttgcaaatattttctccctttaggttatctgtttattctgtttatagtttcttttgttgtaacagatctctttcatttaactagatcctatttgtcagtttttttttttttcaattgcttttggagcctttgtcatgaaatctttgccatcacctatgtccagaatagtgtttcctaggttttcttctatggtttttgtagttttaagttttatatttaagtctttaggccatcttgagttggtttctgtatatggtaaaaggaaggaatctaatttcagtcttctgcatatggctagccagttatcccagcaccatttatttaatagagaattcagtaaatgctgctgggattacttgttttcataaactttatcaaagatcagatggttgtaggtatgtggctttatttctgggttttctaacctgttctgttgttctgtgtgtctgctttggaccagtaccatgctgttttggttactgtagtcttgtaatatactttgaagttgggtagtgtgatgcttctggctgtgttataatatttttgcttaggattgctttggcttttcaggttctatatgaattttagaataggtttttttccaattctgtgaaaaatgttggtagtttgatagaaatagcattgaatctgtaaattgctttgggcagtatagccattttaacaatattgattctttcaatccatgagcatggaatgtttttccatttgtttgtgtcatctctgacttctttcagcagtgttttgtaattcttgttgtagagatttttcacctccctggttagctgtgttcctaggtactttttttgtgtgtgtggctattgtgaataggattgcattattgatttgactctcagcttggctgttgttggtgtatagaaatgctactgatttttgtacattgattttgttttctgaaactttgctcaagtcatttatcagatctaggaacatttgggcagagattataaggctttctaggtataaaatcatatcacctgcaaagagagatttcctctcttcctgtctggatgccgtttatttctttatcttgtctaattgctctggctagaacttccagtataggagtggtaagtgtgggcatccttgccttgttccaggtctcaaggggaatgcttcaagcttttgattatttggtaggatattagctgtgggtttgtcatagatgagtcttcttattctgcggtatgtttcttcagtacctagtttattgagggtttttagcacaaaaggatgttgaattttattgaaagccttttctgtgtctgttgagttgatcatgtggtttttgtttttagttttgtttatgtgatgaaccacgtttattgatttgcatgttgagccaaccttgcatctcaggaataaagcctggttgattaggtagatgagctttttgatttgctgctggatttggtttgcttgtattttgttgaggatttttgcatctatgtttatcagggatattggcctgaagctttcttttttcattgtgtctctgccaagtattggtatcagcatgatcctggcctcatacagtgagttaggagggagtccttccttctggatttttgggaatagtttcagtaggattggtatcagcttatttttttacatcaggtgggctttggatttgaatcaatctggtccagggttttttctggctggtaggctttttattactgattcaatttcacaatttgttagttgtctgtttagggtttcaatttcttcctggttcaatcttgggttgttttatattttcaggaaattatccatttcttctaggttttttagtttgtgcacatagtgatatttgtaataatctctgagggttttgtgtatttctgtggggttgctggtaatgtcccctttgtgtgttgtgattgtgtttatttgaatattctctcttctttcccttccttccttccttctttctttctttttttcttttttgacgaaatttcagtcttgttgcccaggctggagtgcaatggcaccatctcagctcaccacaacctctgcctcctgggttcaagcgattctcctgcctcagcctcctgagtagctgggattacaggcatgtgctaccatacccggctaattttgtatttttagtaaagacagggtttctccatgttggtcaggctggtcttgaagtcccgacctgaggtgatctgcccatcttggcctcccaaagttctgggattacaggtgtgagccactgtgcctggccctggatcttctctcttttacttattagtctacctagtggtctatcaatcttattcatttttttcaaagggccagcttttggttttgttgatcttttgtatggtttttcgtgactcaatttcattcaattcagctctgatttcagttatttcttgtcttctgctagcttcggagttggtatgctcttgtttttttggtttctctaggtgtgatgttaggttgttaatttgagatttttctatgctttagttctctactgctgcttaatattttgttataaaatatagtaccttaaaacaacaattataatttattatatctcatggtttgtgtgggtgagtaattcagataaggacttgtttctgctccatgatgtctgaggcctcagctagaagactcaaagactgaggctggagtcatatgaaagcttgttcatgccattttttagttaatgcttgtacctgctgggggtccagctggaacattcacatgtggttttaatattatcactgggtttttttatgaccctgcctccggagttatttagcatcacttctgctgtactctattagacaagactgttaaaaatctcctcctagacttacagggagagaatatgtccccttctgtcagttggaggagcatgtatcatgttgtagaaagaaagtattaaacagaataaatatattgaggtggtcatctttagaaaatacagcttactacagcatttaagggaaggtttattgttggggggctgtggcgctgttgggcagtgatgttttaggcatgatcctttgttgcttattccttcttcatgcctcaaaggagcagcaaccatcttgtgcccataaggtgataaatcaaccgctaaggattttgacatcattggaagtcagtcctggatgatccatttccaggcttctttttttcctgtgtggaaaaaaatacctatttgtttaaattactatattaaggattttgttttttaaaaccaatcataatccccaaatgtcatggttgtcaactttgaggatacataggaatcacctgtggggcttgttaagatacagattgcttggccccatgttagagtttctgattcactaggtctggcataggctcaagaagctggatttgtaacaggctctctggtgttgtcaatgctgtggtcttgggactgaggtatgggctttgagacttcagagaagagtgggtggctagggctgaccttaagggaaaggtggaacttgggaaaaatagatgagatttagacaggattagggaagcaattccaagtattacaaatggtatcaacaaaaaacatgatagcagaaaaagtgtacttttttgttttttaggatttctgtgagtaaattagcttacttggagcaggagttttgtttttttttttttaactgaggatgggagattaggttaaagggaaaataaggactggattaaggtccttggaagccagagagacatttgtttttttattttgtagctagttaggaactgctagaagttttcatagagagtagtgtggccacagcagtatgctagcagacacctatgtttggtggtggtagtggagtgcatttagttattaaacaaatttaaacaaatggttcttgagcatttgtgatgtcttggactcagttctatgaactgggaatacaaaggtaaataagacgtggatcctgccatcaaagagcacggtctagtgcaggaattctcagagtgtgggtgagtacccctgggggtccctgagaccttttcaaggagaaaagattaaaagtattttcataataatattaataattctaagaattctgagacactgtttacttttttgtcattctctttcattagtgtacaagtttttcagaggctttgtaacataggatgtcatcattgctcatatagctaatggaatacaagcttgtgtattaaaacttttgttttaatttcttaattataacttggtaaatactgatagacataaccccctaaacaaaagctctttggaatcttcagtaatttttttaagaggtagagtcgtgaagccataaagtttgaaaactgctgttccagagaatagattggaggagaaaacacatgaaaaacaaaagactaacactctagatgtgaggtaataagagcttaaactagagttataacaaatgaaaagtggaggaagagatattttgtagacactgaagagtggaaaaattgataatacctagtgtaaattatggtgtgggaaaacggatactgctagtgaacatgtaaattagtaccagccttttggaggaacaatttgacaaaacttattgcagactttaaaaatgaatctttcctgtgacttattctgtacttatcataaggaaacaaataagaatatatctttgcggttttgtttgtagtatcagtaaaaatttataagaagcctaagtatcagaggagtttgattaaataaattattacatcaattcaataaaatgctgtgtagtcactaaaaataatgatgtgggtgaatatttaatgtaaaaaattatatacttttttgttgttgttttgttttggattttttgagagagggtctctgttgcacaggctggagtagcgtagcacgaacatggctcactgcagccttcacctcctgggcttaagccagggactacaggcacacaccacacacctggctaacttttttaaaaaagttttttttaaagatgcggtctcaccatattgtccagactggtcttgaactcctgggctcaagccatcctcccatcttggccttccaaagtgttgggattacaggcatgagccaccacatgtggccaaaaaatactttttataaatacctcagttgcataatgttttctccattatcaacttgacaggcctttgtttaaggtttacggttataagtacttatttgtgtaaaatttaagatctatcaatatgtctaatttttcagaaatttttttcttcaacattttagcctttggcccattttcaaattgtatgtaggccaaggcatacacagtggacattgtgcagctgcgtatacgaatatagccaacattaagaggtcccttgcaataatgctgtttcagaaaggatgtttactgttcttttgaacatagttttcttgtttctgctttaacttataaatatttctcgggaggctgaggcaggagaatggcgtgaacccaggaggcggagcttgcagtgagccgagatcgcgccactgcactccagcctgggcgacagagcgagactctgtctcaaaaaaaaaaaaaaaaaaaaaaaaaaaaaaaaaaaaatatttaaataaaaataatgtttcactgaagaaattgtaaaagtgaactatatgttaaaaataatctaggaaactaaattactgctattccactttgcagtttgatattgctcattttttgactcgtaaagtcagtgtcgatgccttttaactttttttttaaaattttactggatttgtattttaccatatttgtgcagtgactttgattaggtaccaattgaattcagattaaaaagcataaacctacatctgaagatagcctagtataatttatattgtgcatcgttctgattttgaaataataattctcctttacaacgttagggctgaataaaagatagaatccttatgaaatagtgagcccaatgtcattttttttttttttgagtcagagtcttgctctgttgcccagactgtagtgcagtggcacaatcttggctcactgcaacctccgcctcccaggttcaagcatttctcttgcctcagcctcctgagtagctgggaccacaggcatgctccaccacacccggctaatttttgtatatgtatttttagtaaagacgaggtgtcactgtgttggccaggctggtctcaaactcctggcctcaagtgatccacccatctgtgcctcccaaagttctaggattacagatgtgagccaccgtgcccagccccagtctcattttggaaatagagcagagacagatggaaaactgttagcccttggtgatgttattgagcagtgttatctgtgggtttccagatgtgttaatatatgtattttcttattaagtcctttgcattgaaatggtggtgcatggactggcagcattagcattacctatgagtttgttggaaatgaggaattttagactgtaccctagttcaattgaatcaaaatccattttaataggatccccagataagtcatatgcacacaaaagctggagaagtattattttacaccactttgagttggatttttatttactcgcaactggatgcatcctgatatgacattctggagttgttgtttgttttcttgtttgtttttcctgaagaggtacaaccttctccaggcatgctattgtgaatattggaggggtgccatttctgattataatagaaacagcatttgttgagtcatgatacagtttaaatagttctcattatactttgatatgatttttttcatttttttaaatggttatttttagatgaaacctaaaactgtactctttactacttgtggtaaaaaagaccctaccgttatttttggcaagtcaggagatgtaaccttagctgtgctggttaaaagccagctttgagagttgcattttacctcccttagaattactccttcccattctttcctcagctccattcctatttcaactagatagttttgtactggacctgtgttccagaaccattactgtctggggagcgactcttataaactactgccttttagaccagatgtgtgtttcagttacatgaatagagaaaagaatgtcatccccctgctatagctgtgtatatgatagcatgaagaaattaaatccaccagcaatctaggaattttcagaaaatttattttcttctactctttatacaaagccaggtgccacattccataaaaagcaaagcatattttaaaattgtacttcttgtttgtccatttatttagagggcttaattagtctgtagccagatattttggatgattcaattcacaaattagattatcgttctgtaattaactgagaatgatctctctgtggtgtgctttatagtgagaattaccaaaggtctgtattcactcggaaaggtcttagttttaaaagcagtctttttaaaggaaatgtagctatgctcattgattttgttattgttgtcctttgagtttttatggtacactaggcattatgctaggtatatgaaaatatgtctctaatccctgttttagacatgataacattgaggctagagagattatgtaacatgcagaaaattgtatagttatatgaacccacggctggtgctcccaaaactcattcatccccttgaggagttcagattctactgattgggagagaaagagctcactgtaatagaatgcaaaatgtagtaaaaattttaaatgaagtaaattgtaaaagtagagatacaaacaatttagtgagaacacagaggaagaagggattaactgtgattaggaggatcaggaaaacataatttatcttctctcctacttctctaagtttttttttttttttgagatggagtctcactctgttgcccaggctagagtgcagtggcgcgatctcggctcactgcaacctctgtctcccaggttcaagtgattctcctgcctcagcctcccaagtagctgggactacaggtgcctgccaccatgcccggctaatttttgtatttttagtggagactgggtttcaccatattggccaggctggtctcgaactcctgaccttgtaatctgcccgacttggcctcccaaagtgctgggattacaggcgtgagccactgcacccggccttacttctctaggtttttaagctcctcctgacttcttaatcttttaatagtatcgtaagtttttcagtaatcaagatttaaatctttgactgtttgtcttcatattcttacatttcatcaatctgtaatgccttttagttcttactgaaaacagtttcttggtagttatcccctaccatttccactgctgtcaccctagttttacctattgctgtatcatctaggccagtgattatcaacctttggtggacctaagaatcatctaatggtgctttgtcaaagtataaagagattttgacttattagtttaaggttatgggtgattcatcaaagttgagaaatacttatctagggcagtggtcttcaaaatgtgatcttgggactgctgggtgtctctgggactttatcaggtatctgcaaagttaaaactattttcgtagttagactaagatgtcatttacttttttcattgtgttgacatttgcactgatggtgaagaaaatagtgatggataaaacttgtagtgccttagctcaaattaagacagtggtaccaaattagtaatcaatgcattcttcactgccacataccagttttgcttaataatgtctttaatgaatcagttaaaatattattattaatttttttatttttaatttttgtgggtacatagtaggtatgtatatttatggggtatatgggatattttgatacaggcatacagtgtgtaataatcacatcaaggtaagtagggtatctgtcacctcaagcatttatcctttgtgttacaatctagttatactgttttagttatttttaaagtacaattaaattattattgactatagtcacctgttgtgctgtaaaattcactctttctatttttttgcacccataaaccatccccacttctctgccccactctccactactcttcccaacctctggtaaccatcattttactctttatctccatgagttcaatttttttttttttgagatggggcctcgctctttcacccaggctgaagtgcagtggcatgatctcggctcactgcaacctccgcctcccattttcaagcgattctcttgcctcagcctccagagtagctgggatattaggtgcataccaccacgcttggctaatttttgtatttttagtaaagacgaggtttcaccatattagccaggctggtcttgaactcctgacctcaagtgatccacccaccttgccctcccaaagtgttaggattataggtctgagcccctgtgcccggccaagtgttttaatttttagctcccataaataagtgagaacatgtgaagtttgtctttctgtgtccgacttattttacacaacacagtgaccttcagttccatccatgttgttgaaaatgacaagttctcattgtttccttatggatgaatagtattccattgagtatatgtaccacatttctttatccattcatctgctgatggatacttaggttgtttcttttctcttgttgcttttaagatctttttgtacttttttgccatgcataaatttttatgtagtaaaatatatttatattttcttttattatgtctaaattttagtcatagttggagagactttcattgcactgaggttagagaggaagacactcatgttttctgcaattatgcatatacagttgatcctcatttttttgtagacttggtgtttgtatgtttacctccttgtcagagtttatttgtaacacccaaattaatgatcttgttggtttcatggtcatttgcagacatgtgcagagcagtaaaatatggagtcaccaatgtgcatgttcccatctgaagctgaataaggtgatatctaccttcttgtttcagctgtcatattgtaaacaagtgttctttttgtcggggatgccacctcttccaaaacacatggtctgagagtgtggaggaatagttttccaaaagaaatagggtatatcaaatactacatgttctcacttctaagtgagagctaaacatcgggtattcatggacataaagatgggagcagtagacactggggaccattacagggggaagttagagggtgggcaagggttgaaaaactaactactgggtgccatgctcactatctgcatgatgggattatttgtattctaaacctcagcatcacgcaatatacccttgtaacaaacctgtgcatttatacccccaaatctaaaacaaaagttgaaattatgttttataaaagaaatggggtatgtttatcagaagaagggggggattaggtgtcagtcagaaacaactgtctactgtaatacctgagtaagcttttattggatagatttgaattggtgaatgaataaattgggtcttggagaaaggaaagggcttgaatgagttctttcagaataggccttttcttttctcaaaagtaccagcaatagcttcccattttttcagaactgatacctctagctttattggcttttatcatctttgctggagggaaatgacgttgggttaagtattgagtgtgaaggaagatagcatgaggatcttgtttgcctgcagctttattcctgcctgctagacctactgccctttaaagacacttgaaagggcttgccccagctttcctcttgactttagggggcaaaagtatgtcattcttatataagagttggatttataagattgtatatcaaattacatactcaagagttggattttgtttgttagtattgtctaaagttacaacatgtaaatagtctgtgtccttactttctaagcctgccattacaaaaagaaaataatatttcctattagagcctgaagcttttttcctccctagctcttatttagggagaatatataatttaagtgtttgaataggaatagaggaagtagccaaacacttttcaatagtccagctaaaatacacaatagcacatgtttaaagtacatctttggaagaaagatttgaagatccttgataagataatatatcatgtaccacaaaggcatgccctgctaagtaaaagtgggaagaagcagtacatattctattagggggtcagaaatctttaaatagaagtttctctggcaatctggttcccagatagatagttgaaggctcaaagaaatttccaagcttgctagaaatttccatctgctggcttttgtgttgagttaaatgccatcatattttattgcctcatacatttgcattaacactttccctttaaatttacttaaagtattttttgttttgtttcatttttgtttttttttgagactggtctcactttgtcgctcaggttggagtgtagtggagctcacagtttacttcagccttctgagtacctgggactacaggtgcatgccaccacacctggctaatttttgtattttttgtagagacggggtttcgccatgttgcccaggctggtctcgaactcctggcctcaagtgatcctccttgccttggccttccaaagtgctgggattgcagacgtgagccacagtgcctgacagtaatatttttttttttattagaaacataagaacccacctcaaagcttgggcttggaagtctatggaggctttatttattttagccacagacatggataagaggcaatctaagttaaatatgtgcactttggtaccaggccaacctgagttctaaccaaatttttcatgttttagatgtgagacaagttaatcttctaggccttacttccttcatgtataaagtagttattattacttaattcaacaaatattattagtcactcttctatgtgttggggtattccagtgaataaaataatgacagtctttcccttagtgcagtttccattctaatggtagaggacggaggatgggggaggcaataaaaaggaattgtatgttaaaaataataattgctgtaagcagagaggaagtagagcagggtaagggagatactgaatacagaagaaaggaggtgcagaattagggtagtaagggttggcatcgttgagccagtgacatctgagcaaagacttgaatgcagttttaaaaggcttgctctggtattgctgagttgagaatagattgcagggcattaagaataaaataaaggagaatcattaggagcttttcctagtaacctaggcaacagattttcttaggctgttcttgcgttgctataaaggaatacgtgagactgggtaatttataaagaaaagaggtttcattggctcatgattctgtaggctgtacaggaagcatggcaccagcatctgctcaacttccgcggaggcctcaggggagcttttacttatggtggatggcgaagtgggagcaggcccatcacatgacaaaagcaagagcaagagagagagtagagggtgaggtgcccaacacttttaaaccaccagatctcttgagaactcactagcgtgaagacagcagcgagccatgagggatctgcccctgtgacccaagcaccttccattaggccccatttcccatgttggggattaacattcaacatgagatttgggtgggagaatattcaaaccatatcacagatgatgataacttaacgagtattatcagtgaagatgctgaggaatcattgaattttgtatatatttttgagattgagacaacaggatttcctgacgatttgagtatgttatatgaaacaaaaaggagtctatgtttttggctcaggaactgaatggatggagctgttatcaactgataagaggaacactgtggacagagcagatttgagggggaagatcaggagttcagtactatatatatatatattgagtttgagatgtctgtttggcattcttgcagagataatgacatctaccaatgggttggttgtgatgattaaatatggtgaatgtaaattactgagcacagaatctgaccattatctctgtgagatcagagaataaattgctacatgaaacaagaataagagattgcaaaagggagatacttagggaaaaagagctcacagaatgtgatagaaaaaaatttttaaatgatggatgggaggataagattgaagaaatctcccagaatataaaagccaaagagatgtaagaatattacagaaatattaaaaataatggagaatctactcaggaggcccatctcctttctaaaaagattttcagagagagagagagatcaaagaaaagggaagggaaataattttatttatttatttttttgagatggagtctcactctgttgcccaggccagagtgcagtggcatgatcctggctcactgcaacctccacctccagggttcaagcaattcttctgcctcagcctcccgagtagctgggattgtgggcatgcaccatcacacccggctaatttttgtatttttagtagagacagggtttcaccatgttggccaggctagtctcaaactcctgacctcagttgattcatctgcctcggcctcccaaaatgctgggattacaggcatgagccactgtgctcagctaagggaaataattatcagtgaaacaatgcaagaaaaatttccagaactgaaggacatctgtttctaaattgaaagtgctcagcaccattaatgagggggaaaaagacatattaccaggacatttcagagtgccagagagtaaaaacaagtcacaaggaaaggaatagggattagtggagtgtcagacttaactcaaaactaacactggaagctagtagacaaggaagcaataccttcaaagtgctgagggaaaattatgacaaacatagatttctaattccaaccaaatagtcaatcaattatgaggatagcctaaagatatttttttagcatgcaaagtgccaaaaaatttatctcctacacatctccccacaggaagctattgaagtatgtgaaagaaggcatgaaatctaggaaaatggggaatgtaacactggagagagagaggaagtttgcaagatgatggtgaacaaaagtccaggatgacagctgagtagcaagcctagagatgactagtacagattggagcaggaaggtggaaactccagggaagatgtctgtacaaaccaaattaaactgatgcatgtgattattctgaaagagtttcatagtttgttcagacattagggaataaactgtccctaacttaagggagcttacactgtaataaggggtacatgcaagtaggcaggcaattatagtattctgtgaaggttcgtaaagtttagtactgtaggaaaccagaatatgcctccccaaaatgtgaaggattctcgagctgaagacagttaagatgcagtagagctctctgcctaaaagcaggacacagatttacagagaaaaatgtcttgctgtcctccctcctccctttctcccctaaagacaggatgtaaattctttactggaaaaaaaccctttatcatctcagagacggcgccagaggaatctgcaagctgactttactccattagtgccttccatatatttacctttccacggtttcccacctctggaagtctgggactgctttcctttgccttgtcacttctctaaaatttattgttctttgttggatatactatataaaccagactcatgaaccactgccttgagttacttttcactgagggcttttcctgtgtgatatgcaccgtacacgttaataaacctatctgtttttctcttgttaatctgccttctgttatagaagtctgtgctaactacatacttaagaaggttgaggaaaaaatactttttctccccttcagttctctgctgctagatcacccatagttggaatggaggctcagaaacctagtatttagctcctttgagcatctgtaattgaactggcaaagcaagagcttggggctgactgttggattagctgaagaatagtttccgtcatattctagaaaagaaagctttttttttctttttctttttctccagggaatgagtggggttatccatttattgtagtttaaaggatttaaaatccatctatatattgataagcattcatcagtttttattttagtatgtatggtgctatcatgtttataagaatattttgtttttaaaatgactagagcggtacaaaggaaaaaactttagttgttaattttagatgaaaagcaactgaatttcttaggtaataattattttaccctcccaagatacgttttctgtactccattgacttatgccaataaagtaatgttcttccaatttaataatggattttttttcttgttgaatttttttcaactctaacgttattttgttgttggagattgattaaaaaatacaaattttactgtttaaagaatgttgcctaattagttataaatctatttcatctttgcatttttttcttttatatactcatataaaatgtagcagtttgtatcacatcagtatttctcttatataaatatggtttatggttatgtctaatctcatttctcatttggccagttaatatatgcacagataaatggcccataaagaaaaacttcaagaggagaaaaaggtaatctaaatgcatattattattttaaagttctaatactgtgtacaattttatgaagttaagtttctgtaatatgtggtcacccaggggtctgagaacattagttaatccagtcaacaaacattgatggcatatgtgctgtatgacaggctctgtgcttggtcttaggaatacaggacaagttagggcatcattcccaccctccgataatgcttagtccccaggaaaaaaaaattgacatataaacaagtagaggtggtaaaacagaagattaaaggtcctatagatgatatttaccaatgaataaagagagaaggctatcttaagaaaaatatgtagtaagaagaaagaaatggagatagagaacatttgaggaaatggcagacatttatttgtatttggttgtagcatagagtaatggggaagaccggggaaacattgagaaccatctcatagagcaggcatgctacatgctggagtttagtcagtttctcctggaacagtatttctcaaatatgtgtgatcatatgaatcactgagaaagtttgtaaacaaacaaaaacaaccctaacagattcctgaatttcactccagacctggaaaatcagagtccttagaggagggctaggaatccgtattttgttatgtcatgtcatgtcagacagggtatctctgttgtccaggctggagttcagtggtacagtcatagcttactgcagccctgaactcctgggctcaagtgatcctcctgcctcagcctccagagtagctgagattacaggcatgagccactgtgcctggtggaatctatatttttaacaagagctctggtaattattattgtaaccaatttattgaacaagtacaagctattagggtataagcaaatatttttccctcaaatgttctagttgatgtgagactttcctttggcatgtattaatgaaagcaaggacataacccacaaatttcctatgtgcatgtacatatgtgcacatcacacacacacacacacacacacacacacacacacacacacacacacacacacacattttgtggttactaaacagtctaggccaggataaaatttagggaattacagcaggtcctcaaataatgttgttttggtataacattgatgactgaaaaaacaaaaaacaaaaatcccagttcccaactggtgccactctctctgtggaatttgcacattctccccatgtttgcatgggttttctcctggtacttcagtttcctcccctgtcccaaagatgtgtgcattgggtgaattagcgtggcccctgtttgagtgtttatgggtgtgtgtgtgttagtgtgctctgcgatgggatggcatcccctccgtggtcagttcctgccgtgtgctctgactaccaggataggctttgctttcagaaatctccagataattagcttcatatatttctgtgttcaggtgctttcagtttctgcagctcagcaagcgtccagctttggatcaagttgccagtgtgtccttcttgcagatatcttcaccttgcaatctgtatgaccaattattttgaagtgccaacttaatgaatgacccttcgtggtgccagactcctaagctctcccttgccttctcttagttctctctttggtagagttggttgaatgcaccagtgagtttgttacttctcagcaaaccttgggggagatatctgaacctaattgttggtgttctcccttagatttgggctttattgcctcttgctgtcagctttgggccctagttactgattctggaaaaagtggaaaaataccccttaacatcttgttagattatgaataggtaagtttaggaaatattattgcaggtagaagaaaacctaacaggtttttattttctaatgtttaaagagacatttaagtaaaagatctcaatggaattatacctttctttttgttgttgttgttgcagatagtatgtacttaatttttttttttttttaaatttcaataggtttttcaggaagaggtggtgtttggttacatggataagttccttagtggttatttctgagattttggtgcacccatcacccaagcagtgtacactgtacccaatatgtagtcttttttttttttttttctttttgagatagagtcttgctctgtcgcgcggcctggagtgcagtggcatgatctgggctcactacaacctccacctcccgggttcaagcgattctcctgcctcagcctcccaagtagctgggattataggcgcctgccaccacgcctggctaatttttgtatttttagtagagacgaggtttcgccatgttggcaggctggtctcaagctcctgacctcaggtgatccacctacctcagcctctcaaagtgctgggattacaggcatgggccactgcgcccagccgtaatatgtggtcttttttacctcacctgcctcctgcccttccccttaagtccccacagttcattttatcattcttatgcctctgagtcctcatagcttagctcccacctgtaagtaagaacatacaacgtttggttttccattcctgagttactttgcttagagtaacggtctccagttccatctaggttgctgtgaatgccattgtttcatttgtttttacagctgagtagtattccacagtgtgtatggggtgtgtgtgtgtgtatatatatatatcacaatttctttctttctttttctttttcttttttttttttttttttgagatggagtttcactcttgttgcccaggctggaatgcaatggtgcgatctcggcttaccacaacctctgcctcccgggttcaaggaattctcctgcctcagcctcccaagtagctgggattacagtcatgtgccaccacgcctggctaattttgtatttttagtagagacggggtttctccatgttgttcaggctggtcttgaactcccgacctcaggtgatccgcccacctcagcctcccaaattgctgggattacaggcatgagccactgcgaccagcagtatatcacattttctttatccactcgttattgatgggcatttgggctggtttcatatttttgcaattgcaaattgtgctgctgtaaacgtgtgtgtaagtgtctttttcatgtaatgacttcttttcctctggttagatacccagtagtgggattgctggatcaaatggtagatctacttttagttctttaaggaatctccacattgttttccatagaggttgtactagtttacatttgcaccagcgtgtaaaagtgttcccttttcaccatattcatgccaatatctattatactttgatttttaaattatggccattcttgcaggagtaaggtggtatcacattgtggtttggatttgcatttccctgattattagtgatgttgagcattttttcatatgcttgtcggccatttgtatatcttcttttgagaattgcttattcatgtctttagcccacttttttgatgggattatttgtttttttcttgctgatttgtttgatttccttgtagattctggatattagtcctttgtcggatgcatagtttgctaatattttctcctattttatgggttgtctgttcactctgctgattatttcttttgctgtgcagaggctttttagtttaattacgtcccatctatttatccttgttttagttgcgtttatttttgggttcttggtcatgaaaactttgcttaagccaatgtctagaaggggttttccaatgttatctgctagaatttttatgttcaggtcttagatttaagtctttgatccattttgacctgatttttgtataaagtgtgtcttagtccatttttacgctgctggtaaagagatacccgagactgggcaatttacaaaataaagaggtttaattggacttatagttccacatggctggggaagccgcacaatcatggcagaaggcaaggaagagcaagtcatgtcttacatggaatggcagcaggcaaagactttgtgcagagaaactcccgttcttaaaaccatcagatctcgtgagactcattcactatcatgagaacagcacaggaaatatccacccctgtaattcagtcacctcccactgggtctctgtcacaacacgtgggaattcaagatgaaatttggtggggacacagcaaaactgtatcattccacccctggagcctcccaaatctcatatcctcacatttcaaaaccaatcatgccttcccaaaagtcccccaaagtctcaactcatttcagcattaactcaaaagttcacagtccagcgtctcatcagagacaaggccagtcccttccgcctgtgagcctgtaaaatcaaaagcaagttagttacttcctacatacagtgggatacaggcattgggtaaatacagccattccaaatgggagaaattggccaaaacaaaggggctccaggccccatgcaagtcaaaaatcaagcagggcagtcaaatcttaaagctccaaaatgatctcctttgactccatatctgacatccaggtcatgctgatgcaagaagtgggttcccatggtcttgggcagctatgcctctgtggctttgcagggtacagcccccctcctagctgccttcatgggctggcattgagtgtctgcagcttttctaggtgaatggtgcaagctgttggtggatttaccattcttcttttttttttgagacagagtctcgctctgtcaccaggctggagtgcagtggcgtgtgatctcggctcactgtaccctctgcctcctgagttcaagcaattctcctgcctcagcctcccgagtagccgggactacaggtgcctgccaccacgtctggctaatttttgtatttttagtagagacggggtttcaccatattggccaggttggtctcgaactcctgaccttgtgatctgcctgcctcagcctcccaaagtgctgggattacaggcatgagctactgtgcttgacctggatctaccattctggggtctggaggatggtggccatcttctcacagctacactaggctctgctccccagtagggactctgtatgggggctctgactccacatttcctttctgcagaggttcttctccataagagtcctacccctgcatcaaacttctgcctgggcatccagatgtttccaaacatcttctgaaatctaggcggaggttcccaaaccccaattcttgacttctgtgcactggcaggcttaacactgcatggaagctgccaaggcttgcggcttgcaccctctgaagccttggcttgatctctcattggctcctttcagccatggctggagtggctggaatgcagggcaccaagaccctgggctgcacacagcctgggccgcacacagcacagggaccctgggcccagcccatgaaaccactttttcctcctaggcctcctggcctgcggtaggaggggctcccatgaagacctctgacatgccttagagacattttttccattgtcttggggattaacatttggccccttattacttatgcaactttctgcagccagcttggatttctcctcagaaaatggattttcttttctatcgcattgccaggctgcacattttctaaacttttatattctgcttcccttataaaactgaatgcctttaacagcacccaagtcacctcttgaatactttgctgcttagaaattttttacaccagatacccaaaatcatctctcttaagttcaaagttccacaaatctctagggcaggggcaaaatgctgccagtctgtttgctaaaacatagcaagagtcacctttactccagttaacaagttcgtcatctttatctgagaccacctcagcctggaccttattgctcatgtcactgtcaacatttttgtcaaagccattcaacaagtccttttttctcttttaaaatagacagatcatgccagtgttgaagggatatgtttccttttttttttttttttttttttttgagactgagtcttggtctgtcgccacactggagtgcagtggtgtgatcttggctcactgcagcctccgcctcctgggttcaagcgattctcctgcctcagcctcccaagtagctgggacaacaggcgtgcgccaccacacccagctaatttttgtgtttttagtaggggtggggtttcatcatgttggccaggctggtctcgaactcccaactttgtgatctgcctgcctcggcctcccagagtgctggaattacagacgtgagccaccacgcctggcggagatatgttttcttaacactgggcaaagaatctcagtttatatagctcactggacaatttacagatcctgaggtcagggataatagtaagtatggattgtgaaaaccttcagtaactcatagattttagccaatgatatgttacaaagtattttatactgtgatattatttcctatgagtcatcccattcctgttatttaagcagtgctcaagatcactatggttcatatccatgaatgtatttcagggtagaataattcttgaatcttatttataagatatactgttgactttaaatgaaagctactcatttaaataggacaccttatataccttggatatggatatttgtttttttctctttaattgtcatattttatatatttatggggttcatgtgagagtttgctgcatgcatagaatgtgtaatgatcaagtctccatcatcatgagtgcttatcatttttatgtggtgtcatttcaagtcctctcttctagttactctgacatatacataatattgttactaagtgtagtcactgtggtctgctatcaaacattagatcttgtttcttctatctaactatgtgtttgtacccacaaccaacttctcctgtcctctccccttgaaccacccttccgagtctctggttatctgttgatctattctctatgtccatgagatgaagttttttagctcccacatgtgaatgagaacgtgtggtatttgtctttctgtgctgggcttattttgcgtaacataatgacgtccaattccatccatgtcacttcaaatgacatgatttcattcttttttatggctgaatagtatttcattgtatgtgtgtgtgtgtgtgtgtgtgtgtgtattatataatatattcattgtgtgtgtgtatatattatatatatacacatatataatgtgtgtgtcttttatggttccatacaaattttaggattttttgtctatttctgggaaaaaatgaatcccacttgatcatggtatgttatcttttgggtgtgctgttggatctagtttggtagtattttgttgaagacttttccatttatcttcatcagggttattggtctgtattttttttgttgtagctttgtctggttttggtatcagggtaatgctggcctcatagaatgagttagggagaatttccttctcttaactttttggaatagcttgaggaggactgatatgagtttttctttatacatttggtagaattcagcagtgactttattcagtactgggctttttttcttgagagactttttgttcctggttcaatcttgatactcattatgttcaggttttctatttttcctgattcaatcttgttggattgtattgatatggctccaatgaatggaggaacaccagtgtccttggtcttgcgctgatttagataaaatgacatggacacatgtggagtgattttaaggagcggagagtttaataggcaagaaagaaggaagaagctcccccatacagagacagagggaggggggctctgagagagaaaccatgtgtgcggtggcaaagtagttagttatattagcaggctggaggaggcggtgtctgatttgcatacagcccagggattggttttaccagatgtgtcattcatgtggcccgtgaaaaacctggccctcccaccttcgtcctttaatatgaaaatgcgggtcaccatgatgtcctgaacacgtgtgagttatctggaggcggccatgacacttggtacttgtggtgacaaggagaagagggcagcaatcgccatgttggccatgttgggtggacctagtttctaatcgccagaatttgcatatcaaagcttgccgtctttaagccgccttttctgttagaaaagaaatggtttgggggttgcttcttacaggaaaatttccaccgagaacctttaccctttctacctgcctaaaaattatttcttaataactcctatattaatgtgtttccaggaatttctccattttctctaggtttttcactttgctagcatataattcataatagtctctgatgatcttttgtacttctggtgtcagctgcaatgtctcctttttcatttctgagtttgtttatttgggacgtctcttcttttttcggttagtcaaggtagcggtttatcaattttgtttatcttttccaatgatcaacgttttgtattgtatttttagtctctatttcatttagttctgctctgatctttattatttcttttcttctgctaatttttggttttctttgttcttgctttttagttttttgaggtgcatggttagattgttcatttgaaatctttctgtttttctgatttaggtgtttattgctataaactcccctcttaacatacttttgctatgtcccacaggttttggtatgttgtgtttccattttctttgtttcaagaaattaaaaaaattttttatcttgattctttcattgacccagtggtcactcaggagcatgttgtttaatttccatgtatttgtatagttttcagagttcctcttggcattgatttctagttttattccattgtgatctaagatacttgatatgattttagctttggaaagattagttttatagcctaacatatggtaaatcctggagaattttctatgtgcagatgagaaaaatgtatattctacagatgttagataacattttctgtacatgtctgttaggtccatttggtctaaagtcccgtttaagtctgatgtttctttattttctgtctagatgatctcttaaatgctgagattgggatgttgaagtaccccactattattgtattagagcctgtctttttctttagatctagtaatacttgctttatgcatatcctcttgctggattgatccctttatcattatataatgaccttgtctttctgtgtcttttttttttgtgtttttttgttttttttaagaaatggggtctcaatatgttttctaggctagtcttgagctcctggcctcaagtgatcctcccgcctctgccttctgagtagctgggattacaggcaggagccatcgtgcccagcttctttgtcttttattattatttttgacttaatgtctgttttatctgatataagtgtaggtatttctgctcacttttggtttccgtttgtgtggaatatcttttttcatttatttactttgagtctatatgtgtcttcacaggtaaagtgcactgattgtaggcagcatatagttagatcatttttaaatcaattcagagagtctgtatcttttaagtggagaatttaatccattaatattcaaggttattattgaggttttgttccttcatattgttaattgtttgctggttttctatggtggtatcacttgaattttttggctttttcacttgtgtattgctttaccagttagttttatatttttgtgtgtatactttgtgtgtgtgtgtgttttttttttccactcccttgagcatttcttgaagagctagtctagtggtgatgaatttcatctgcttttgcttgcttagaaaagactttatttcttctttatttatgaaggataattttgctggatatagtatccttgggtggcagtttttttcttttggcactttgaatatataaccccattctctcctagcctgtgaggtttttgctgagaagtctcctgttgatgtaggctcctttgtaggtgactagacattttcctcttgctgctttaagacttttctccttgtcattgactttatgcagcttgaatacaatgtgtcatggagaagacctttcgcattggatcactggtcttcctgtacctggatgtctaaatctcttggtagacttgggaaaatttcatctagtatttcattaaataggtttttgagcatttttgttctctgtttccctttgaggatactgataatttatatatttgattgctttatggtttcccatatatcatgacgactttgttcattcttttttattctttattcaattttttttttggtctgcctgggttatttcttttttttttttcttttttttgagacggagtctcgctctgttgcccaggttggagtgcagtggtgcgatctcagctcactgcaagctccgccgcctgcattcatgccattctcctgcctcagcctcccaagtagctgggactacaggagcctgccaccacgcctggctaatttttttgtatttttattagagacagggtttcaccgtgttagccaggatggtctcaatcgcctgacctcgtgatccgcctgccttggcctcccaaagtgctgggattacaggcgtgagccaccgcgtcctgcctggctgggttatttcaaaaggcccatcttcaggttctgagactctttcttttgcttggtttagtctattgttgatgcttttgagtgtactttgtattttttcaaggacttcttcagttccaaaattttggtttgtttcttttttattctatcactgtggtaaactgctcctttatttcctgaattgtttttctgatttctttgtattgttttttgaaattctcttgtatctcattgggcttctttagtatcataattttgaattctttttctgggatttctttttttttttttttttttgagacagagttttgctcttgttgcccaggctggagggcaatggcacaacctcagctcactgcaacctctgcctcccgggttcaagcaattctcctgcctcagcctcctgagtagctgggattacaggtgcccaccaccacgcctggctaattttttgtatttttagtagagatgggtttcaccatgttggccaggctggtctcgacctcttgacctcaggtgatccatctgccttggcctcccaaagtgctgggattataggcgtgaatcacagtgcccggcccagcatttcttgaatttctttttattgggatgtgttgctggagaattattatgttcctttggaggtgtcatagttctttgctttttcatgttttctatatccttgtgttgacatctgcacacctggtataatagttgcttcttcaaattttttatttttttatttttaacttttcttcaacttttgttttagattctaggggtacatgttcaggtttgttacaaagttatattatgtgatgctggagtttggagtacaattgaacatgtcacccaggaagtgagcacagtattcaataagtagttttcaatctttgtcttcctccctccctcctacctcatgtattttccagcatctgttgttcccatctttatgtccatgtgtacccaatgtttagctcctgcttttggattttctttcataggagatgtatcaatggtgctagttgggtgggctctttggctttgattctgggtgcattcagttgtgtagtctctgtattatttctttagctataaacaatatctgtgttatctgtgatttcctccatggtttatggtgtggttattagtggagcttatagtgaagtttggtgggacagggatgctaggcaggccactttttgggccctattggtggtagcggtgggctgatcatacttgttcttaggccccagcacagtgtgcagtggcactagttttagtgggaccaagaggttcaattcttggctccccaggtggcttgctcagatgctgaggtggtggtggcagaggtggggtgggcaggtgagcaagttctcatgtccctgggaatttggtatggtgtgggtagtggcagcagcagtgaggagaagaccctctgggtcccaagcagtatgtgctaatgttgatggtggctgtgatgcagggtcactatccacagccccagacacacagctcttagacttgtccactcttggcagcaacagtactgtactgctatgccaaggaggggaggggccccatgttcacgtatgagtctaagcatggaggccacaccaccagtgggggcacagttactacttacagccccagacaggcagctcctccggcttgtccaccctggcccctggcaatagcagcagtggcagcggctgtagtggtgtgcagaggaggagagaggctcctgttgtatatgtgtaaacctgagcacagagaccactccattggtgcaggcagggtcactgcttccagctccagacagctattatgcttacccatctgggttcctagtgacagctactgctatggcaatatgcagagaaggggaggagatctttccacttgtgagcttgagcacagaatttgtgctgcctttccggtagaatgcacctttggtacactgtaactttttggtacactgcaccattccctgaggagtagtgttttccatgggctagaatactggggaccctggagcacctttgggtccagccagtgctatgctgctgtagccatttgagtcaacactggggttgttagtgggagatcccagaatgtggagatatggggcctctgatttccaggtcaggatgcagtcctatgacagctgtgctctcacagtagtgctctgcagtagcagcttaggccttgggggtgtgactgacccagcatgagttccttgtctggtgcaatgcccttgtgggtctccagatcaccacccttgctagtatcagggtttgtgtgggtagaggagctctcccatggtttggattgctgcagtccacagtggggacatggattgttaaggttctctcacttacccttccctatgataatgagtcccttggggctcatagctgatcttggctgagttggtcacttgcttccttctccttctttgcctcaggtgtttcctgtgactagatcctgttggacactagtgttctcttctagatgttctattataggtgtgattattttggttatatattagtaattttggttctttctggagagggtgagtgtccaatctctctagttagccaccttgaatacatctctgctgaggagttcaggaagagcagaagctacctctatgctcctgctgagtcaggcaatgcctatacctttaattctaccagaattgaagtaacaaatttgtctactttagggcaataaataaagtcaatatacacctgactacaaagcttcgtagactatcaacatcagttacttctgacagcttggttgtagatgtgaaaggaaatgggttcattgtatctgatgctgccgttagaccaagctggcaccacagaagacctggaatttgttaatactgcttaactttcatgtttcctggtacaatcaggatgaagggaactgtaaccactaggtggcatcttttaattagaaaactgtgaatactccattgctcactaggatccttgtggcctacttagcaaagcaattgcctgtgagagcagctggtggcagtctttaagatgcagatttcaaataggagagaaaggaagagataaagataaaaagagaggaaagaagtgggagggcaagagaagagaaaaggagaaagtaaacaggcgtactgtgaaggaagtagtaaaatgccatcagtaattagctcaggaaagtggtatttatggcatttgttgcttaccattgtttcatttctttatttatttgacacgtatttaatgggaattaggaattctggctgaggatacgagatgctgtttctaccctcagagagttgatagctaaagggagtttaaaatatctcaacttaaaatcttgacccccttcctgtagagtatgttaaataatacatgaaataataccttttatttttagttttatttgtttcgtattctctatttcattcccctatcagagaaaagagtttctggagtactctagttgacatactttgaaaattagccccttgagggcagggagtgtatattattgaggaatctggagcatgttgttccatccctgactcttattgatgggggggaatgtccatacgttgaacgaatggtaggatcagatgagaaacctcagcaaggtgtctcctggttatagtctacagccttcctggctctttgtagaatttaggcttctgactttgaatgctttcctgacagcaccatactctcctctgctatatagcacactatcatattgcctgtttacgaggcatttgtgtttctccacagtgatgaattcttttatggtagggtctgtttctaatttaatttatttatgtagtttcagtgtttagcaggtggtgagtgctcaataaattttggttaaatgaatgaataaatctgactaattatagtgtacttggtataagataaatttgtataggaatccttttggagagagttaatttttggatatgccagaaagaccatcctttaagattttttttacatatgtgaggatgattaggcaattactttgagtgtaagatatggtgcactttcaaagataaccagaagatataccagttgtatgctagagatggatttgtagtgccaattctacaaatacaactcttaaaaaagtttttttttcagagacagtcttgctctcttgcccaaatgggagttcaatggctcgattatagctcactgcagctttcacctcctggggttgggtgattttcctgcctcagcatcccatgtagctaggactacaggcacataccatcaggccatgctgattttaaaatttttttgtagagatggggatcttgctgtgttgcccaggctagttataaatccctggcctcaagggatcctcctgctttggcctcccaaagtgttgggattagaagtgtgagccactgcccctggccaactcttttaaattttaaagtggattctgttgcgttgtcttagataagtagcccagctgcagtcttcttgtttcttttttctaaaataataggcactgatgacatctattatttgctccttcaggatctagggcctgccgaggacttcatcttataaagatgagtatgagaactgagacaaggtcaagtagagtagtaaaaggtgggcagagagggatttcactatggcggaattctattataccagaggataatgtcagtaggccaacgtctgtttgttgaatgccagaactttcatattcaagaatatatattagaaaatagatgtcattttattaatagacctttttagaaaggtctatcttataaaggacacattataaaaagccttcaaaaaacaaaaattttaacagctttttgagatataatttacataccatacaattcacccttttaaggtacacaatatagggttctttttttagcatattgacagattgtgcaacgatcaccacagtctaattccaaaacatttcaccaccccaagaagaaaccctgtacccagtagcagccactctctcactctgcatttccaccttccccaagcccttggaaatctctatttgctatctctatagatttgcctgttatggacatttcatgaaagtggagtcatataatgtgtgttcttttgtgactggcttctttcatatagcataaagttttcaaaattagtgttgcagcatgttatcagtattcttcattccttttcattgccaaataatatactgttgtatagatagaactcattttgtttatccatttatcagttgatggacatttggtttattttcacattttgggtattatgaataatgcagtaataagcatccatgtacaagcttttgtttggacatatgtttttatttctcttggttatatccccaggagtagaattgctggatcatatggcagctctgtgtttaataatttgaggaactgtgaagccacttttccaaagtcctaccagcagcgagctagggttccagtttctccacatcctcactaatacttgtcatctttttcttaaaaattacaataatccttgtagtgcttgtgaagtggttatgtcattgtggtttttgtttgcattttctaatggctgatgatgttgagaattttcaagtgtttattgaccatttgtatatctcttttggagaaagtctatttaaatctcttgcccagttgtaattgggttgtctttttattattgtattttaaagtgctcattttatatgttggatacaagacccttaatagatatttgattttcaaatattttctcccattctgtccttttactttcttgatggtcttacttgtagcagaaatatgttatatacacatatatgtaaatgtaatatttatagcataatgaaataaagtagtttagaaggatttgcagtagggtgccatgaaggggataacagttgtcttttattgaaattcaaagctgagccctaaatccatatgtaatacaattatgggaagccaaaaaagaacagaagctgctcagagtgaaacataatgtcctacagcacatgacacaccttcttcctgtctttgtgatatcccagttacaagctagttagagaaatgatagggattggggtagtgagaaaagaatagttgtttcctttggtgtctcaggtaagatatactgttagagatatagctagaaataaaaccaaccggttctagcagagatgacgataattctacttttgtcaaatcaccaccagagaaatctcctctcagttgattaacatcatgtgccgcaggctgtttctttcttttactctaggtatagtgggagtaacccattggcaagaaaaactcatatttaggtggtaaggggaaggcaggtagagaaaatgaagtgtgtctttgacacagtatgaatggaggtgctccccattaggaattgagcaggtagactgtgttgatgaacatagagtaacacgctgggatggttgtggccacttgtctgtctcattggtccatctctcccagtattccatttgaaatccttcttcagccccttaccacagcttcaggttgatattgaaatacaatggtaatagtgagggtattttaaaagtggactttaaagctgagttacattaagaaatgggcatatctggcaagttacaggcacaggtaagtaacttttttttttctttttttgcattaggggtttgaaatagtgcaccgatggccttctgagaaaggtgtctaccttctcaaggtttttctatagaatgacttatcaaaatccatatggattcttgaccgaggcttttcagctggattatgtgaaaagctgtggattttgtaaagaagcctggcatgtgctccagtgtgtttcagtttttaaattttcattttttacagtgtgagaactaattccagactaataacatttatgtgaatagttctctaagctttgcttcctaaagtgtaactgttaagccttctggaataacaatgcagttctcccttcagaaagattctttatgttgatgtcttgtgactggcttaaattcttcaggcactttctctcctggttcctctccacacccagagagagattttagataatcttgtgcattgagcagaatcaagagatgagtcaggaaagttttctaacaaataatacttttgacggagccatacaacttaatttcgattttgaagtgacagtaattgtcagtattgctccttcaagtggagggactaatttgtaatcatgagcatattgcataatggcgacataattgagggcgtaggcctatcctttagaacatagcccccaagagaattgtgttccatacataatataaagatatgttaaggtggttgtgaaactccttgctgtgaaatagtaggggcttctcagtcattttgtgtatagtttgctttgtagatgatgctgtatttcagtagaaaacagttgatgtctcaatgtcatattggcatctgtggttgagaatagctcaaatactattgaattaaacttgtgtgcgtgacagtgtgcttgcccagacggactccttagcactgtatgactcttgagaaaatggtctcacttgacaatttcattgctacctaagatttttatttagtggctgaggaagtgaagtagtgacttatactgatttgccatctagggagataattggtaaacttgggcctgagaaaggaagagatctgttatgtaagaaaaatactgatcaaaagaacaatatttgttgttgttgttgaccagctctgactgtgaaacatttaaagtgtctgggctctaatttgagagactagttgaaaaataatcatttgacatttagcactctgctaggtaccgggaaattagagcaagtaagaaataatttcatatcttgaggtacttatattagggggaagacagacatacaggcagatatttttttctgatatattagataaaggctttactcttccccgcccctgcccccctccatgtggaaacacatacaaacaggagcaaaaaagggaataccaaattcattttaaatacatgtagatacccaatatgtaatatgtgtcatcttactctaggatgtgagctttaaaaaggtggaagccaaattgtgcatgcttttgtatagatccttgcataaactagatagtatatagaaaattgacagtagtaagtgaaatgcttgattccttttaagaaagaaaattccaagagttatgttaagaacttctttaaaaaaaggcaagagtgaaaaaaatgcacaattcagaatagtgatgatcattgcagggaggcaggtagatggctttcggtaggggcccatgtatagcttcactgggattgtgtttttagttagcttgggctgctgtagcaaattaccatagattaggtagctcaaataacaaacatttatttctcacagttctgaaggctggaagtctgagatcagggtggaagcatggttgggtgccctcttcctaattatgtcttcacatggctgttcccatcacagggactccagcttcaagacttaatcgaaccctaattacctccctaaaggccctaggtctaaataccattacattggggattagggttttaatacattaattttgggaggacacaaacatttagtccatagcagattggaaatattttaattcataaattaggtgctgggttcattaggtatatattctgtaattatgcctcataacatacattatatatatataaaaaaataaaaagtatatatataaaactgtaacatttgatagatgcatatatatatatatatatatatatatatatatttttttttttttttttttttttttttttttttttttgagatggaatctcactctgttgcccagcctggagtgcaatggcgtgatctcagctcactgcaacctctgcctcccaggttcaagctattctcgtgtctcagcctcccaagtagctgggatcacaggtgcctgccactgcacctggctaatttttgtatttttagtagagatggggtttcgccatgttggtcaggttggtcttgaactcctgacctcaggtgatccaccacctgccttggcctcccaaaagtgctgggattacaggcgtgagccaccgcacccagccttcccagtctgaatttcttaaaagcttttgcttaggttaagttgtgggagaaaaactgaactcacccagctagccaaactatctctctgttgtctttccactttatccatctattttttactttttttggaaacacaataacaatagtgtagaagtcttttcacattgcctgactctcctgtttgtgtcccataaggttccatgtactctgtccagaactcagcttattatgtcaaaggattctgtctggactggtcagtcagagatataagttctcattacctcagtgtgtgtgtttgtatctgtatttaatgatgtttgtgcttggcttaggctggggattttgaaatctttgcagagtttcccaatttgttgggcagttttagaaatgatagtatcagtaggaaaaaaaaaacacagaaaaatacaatttcttctttcatctatgtcccatattatacaaatgttcgctgaaagcaccaattttctgggaaaggttttgactcagacttttttcaccctttacctctactctccaattcatgtttccttcttacaacgtggtcatatgcttgcccaggcctggcttatgaaccgtgcagaatatttgtggggtttgttttttaagccctaaactgtgcacatgatgcagtatttaatttggaatgagctcttagtttagtcacatgtgcttcttgtggtgtttatcttggaatccacaagtaggagggaagtatttttgcattttatacatctggacattgttcatggtccttctgtaacttgggaattctgtgtgaggcaaaatccaaaaaaacagcattaaaaataacacggagttatgatgacatctgagtcaaaacccttgagaatacccttctgatcccagcagagtttgtttttgaggtggtgaactttttcaattgtgtgtggttcactgctggcctgaggagaatgctgggattataaggttacctgacacccttgcatgtagactaatgggtttccagacattctgaaagtctattgcagatttggcatagggggaagattttgctttttggcttagggggaggattttgctctaattttgcatggggtaaaataggtaaagtgaattctgctcactgttgctatgcctctgccacaagcattctaagagacctgtgagactgtccctatttctctcttaaacttgcctaattacagccagcttagagctaaagttgactctgagaatgcctcgggctctgtgtcaggactgggggtttagtaaccttatccttcccctgatttcacatgagaagttgttttaaacaggattggacatagagatatagcacagtacctcctccttttggctaggggtctgctaaagtggaaaaagtgggaaaggatgtacagaaactcctgctctttgagtgagtttgcatatggacagtattgctttttggccccagcctagttttctttcattcccatgtctcatcttttatgcagctgcagagagcaggctgggaaagcagaatgaaagcttcaaacagatttgcacttgaataaaagaaagagtgatttctcttgttcagagtacagaccagtttgggtagaaaactgtttgcttttttactttctgggtaaggactgtttgcttttctctctttaaatgtagtaaagagaggaaaagctaataaagtagttggacctgctggttataattcatagagaattttcaagtgtgtttaataaagtctctcatataattataacagaaataagtaattggaggggaaaggttaaaatcctgtagaggtttaagaatcagttaaatatgaggcagtgtgcttggatgagacaactaactaggagctgcttctctttgctgatttctctgaactttccttttgagattttttcctctttactttcgtaatgcattttgcaactttcattaaaaaaatccatcaatgtttaaacttctaacaaataaacatatcctagtcctattatggaaatcacaatgtagcagagaatagcttgacttcagctagagagaggttaatgataggaaccctaaggattgataccaagatcatgcttgtttagtgttttaatgactccagaaggaaatggtgaaatctgctgatgacaccaaattgtttttgctgatccaaacaaggatttctgggaagcttcttcagagtatttggaatagtagaagaattgagaaatatggtggcagacacactgaacttaaagtgaaggtttacgtgaagtagcaggagtaacgtcaatacgttgaagttacaaagcctgccaaatcttccaaaaggaagattacggagtctatagtttcatgaaaggaagacttaagacaaagaacatttatacatatagcaaatgaaaactattatgggaatagttgcaattataaagttcagtgacttaaaaatatgatgtctgaatttctttttaaatgtcagcagtagtatatctaaataggtgttgtttctctcgaaatggtcatagaagattatatacccattttatgcatgctcctttcttggtacgttcttttgtcagttttctgtggtggcaggtctttattttgcaggctgttttgaattttgaaacagtcaactgtcacttaaagccaagtgtgataaataagatgggtggtcaaactaagtaatagatttaaatatattaaatatattaaatgaaatataaagtagtaaaacttattttcttttattgctttcaaaagtgattctaaaggacattaccaatgagaaattgcaaaaatgtttgtgtactaatagtgttagattaagttcttggttgatagatttcacaaacatcacttatttagatatgtaagttacagggcttgtactaatacacattttattatattggagacaaaccatgtttataagtgacctttttaaaatgttttctttatgctccctaaatatacacttagggaggaagaaggaggttttgaattaactggagatttccctaatgtgttgaatttttctgactaaagcctacatttttgtaaagaaaaagaccctgtgggataaaaaatacgataggcactatcacaggagctgtgggctggccatctatatccatccatctatctattattccacccatccctccatccatccatccatttatttaattaagttatttttaacggttggctctggagttgacattcatttattttaaaagaacagtgaatcatagctcttttcctcaagatgcttgcttttatttgcatggtggcatattgattaagtactcagaacactatttgacatatggtaagccctcaataaaagtttgttattattatgactgtacttctcccctctaatgtatagaggtaaacattttggttcctattgtgacacgtgggttataatgagttagggcctacttaagaagaaagtggaaagaaagcgggtaaaattgttgctcagatactagcatgtgggtggagatatagatatagatataggtatagatatagatagtgtaggtatttacatctaagtatattgtataaagtgacggattctgaatttgctacatttctcatttcttcagcactctgggataaaaccagcaaaaatgatgtgatctgaacagacacagtagatggcgctgtaggacttagtttttaaagaaaacagtacagccagggggagtgggggcatggagtgggaagaaaactaaagcacattttaatgggctcttttgtaccaccaagacaatttcatcttagagtacgtgcctctaagaagtaaagatttttttttttttttttttttgacagagctggagaataattttaggaaaactaaatctccctgttgctatgtttgtgccagctttgtcacttggaaagtattagttgttttaagccacaaatatataaggaagttattttctttcaaaacattgccttatttatgagggttttgtttgtttgttttagctgtctttgtctctgtattttaatatttttgctcctagcttttttggccctttgttgtttcataaaaacgtggttgtaaagttaatttgaaccatatcaatatgactataatgtcatattttaaaattcagctatattttaataggccttaaaaatacaggtttacattaaagagtaacatagtgtttttgatactaccgtagtgtgtttatgtacttgatcttatttaatcttagtactaattgtatgaattttattattcacttttctaggtaaataaactatatcagagatacttagtaacttgccaagctcacatacctagtggttgaactagtagttgctgcaagagtttcgccagcatattaaagttgtattttttgagcacttactgtgtgccaggcaagctaaccactggaaatactatagtgtccaaagctgacctggaccctgcccttatggaccttacagttattagataccccacagacattttttgaaatctgctggattgagagtgggtcatgaagatgaatttgaatcattgtgattgttggataagccagagagccctttcaccaaaaagaaagtaagaatcatacctaccttgaatatattactgtattaaaatatttgttttagttgtactccctgtagccaagggaaaggcaagacctcctttggctacaatgagtaactaaactgtcttctagataagaatcaggaagagtaaggaaaatctggctatactataatgtcaaaattttccactgattaaatggtattaaaatatctaaagcaagaaggtgttagttagcagtggaagtctgagagattaatgtggtttgtgtacagcctaagaccatgttaacttctaattggcttctctagtgccatttggtgagatcttttagagtacagccagcttagtgataccccaaattgccaagtacccctttcatcttgggacattaattgtcaaaaatctttgaattgatttttcttcagaaagcttcactttattattttcacacaataccaagttctcatgatatttatgggtatgtgattggtgagaaaacagaccaagagttgttttttgtttgtttgttttttgtgacgaagtgttgctttgtcgcccagactggagtgcagtggcgcaatctctcctcccgggttcaagcgattctcgtgcctcagcctcccgagtagctgggattacaggcacacgccaccacgcccagctaatttttgtatttttagtagagatggggtttcgtcatgttggccaggctggtttcgaactcctgacctcagttgatccacccgcctcagcctcccaaagtgctgggattacaggcatgagctaccatgcccagcccagaccaagagttttaaattgaggtccatgattgggtttcagtaagtgtatggaatgtctaaaattatataaaattttatgtgtatgtacttagaattattctgggaagaaagtccatagtctgcacaaatttctcagtgagtttcataacccttaaaaggttaaaagtggttgtaactagactttatcaaaaggggtgttcaaaagtcactccagttcaggattgtggaaagataactgtcttctcaaataggcatcttagaggaagggctgtttgggttccttttaagaactgtaatcttgagatgtggagtgaatttgggatttgaaaatcccaaaatagagttttggaactctcagctcttagtgatatattctgttttgaaatgagggatacctttcggggaatttgaaaatacttttttctaattcaacttttaatcagataaatgattatttttgaaaaatgaaatagaaagtaataggaaagggggaaaagttgttatgtctcttcgtggaataaatagctaaagaaattaatttctaaattttaaatttcatccctggttaaaatagttcctcttttttgttgttgttgttgttgttgttttttgttttgagatggagtctcactgttacctaggctggagtgcagtggtgcaatctcggctcactgcaacctccgcctccccagttcaagcagttctctgcttcagcctctcaagtagctggggctacaggcactcgccaccatgcccagctgatttttgtatttttagtagagacatggtttcaccatcttggccaggctggtcttgaactcctgacctcgtgatccacccgcctcggcctcccaaagtgttgggattacaggtgtgagccactgcacttggccaaaagagttcttttagagaaaacaaaagtctttgatataagcaatatgatcatacaaatggatattgtgcttttttaaaacaaacaaaacacacaggtttaaggagagaaggtatggatatactacttctgtcttccctatcttctgccatattctaagctttgcatatgttctcctgaggaacaggatagttataacttaaacttgcatttatatatttctgattaagttgttaactatggttctagatagaagaataaagaagtaaaattagatttcttaatttgatatatttaagtcccttattttgatctaatatatttgataaaatagtaatcttttaatagtagccctgttatacataataataatacctatcagatagggttgtggtgaggattagaccatatagtaaatgtaacatgtctagtgctgtgccctgaacttaacacgtgcttattaaatattaactattgctattaccattatcatcatcattaataaacatctatattttatatccccatgacttaatgtacagtataaagcataaatagtaaaattacccaaagacaaagaggaatgggaaggtccagttgattagcttcttgtttagagaagcagattattccgggggttaggaaatagtttcctgtaaggcatgtttagctttcattcatggattgatggcaatataaatcgctcttttgatgtgagaaaaatataatgatggcattacatcaattataaatttcatgagggtagggactgtgttcggtttaccttgtgtccttagctcccattttaatgtctgacccatggaaggcatttcattaaatatttgttgtcatctgtctatgttttcttctttgtctttctttagcttccaaaaagagttgtttttatattcataatttcttatttcatcagtaatgtgactcccctagaagtattggttaaaatacagatctttcttggaaggagactgttttgtttgaagcaaatgacttgggagatgacttaagaacattcaggctttaggtgtttttgtagaaagactaatatttggtcctaaaaaacaaaaaaaacttatcttcatctgtcagaaaattcctaatgtttagcacttaagttgctttgtgttctgatgtatatattataatggaaaaatctgcagcctaaaaggtagtgttttcaattagatatttaagaaacactttctactctcctactttagaggaaaactttacatagcccatttatcttcatgtcttcttgagtcagcaaaacatttacaactataggaaagaagatgtttttcagaaatgaatgctgatcaaaaagaagtatagctactgtggcaaaattaggtaaatagttctatttgttaaggaaaaaatctgtcttgtggagttgtatataaagtacgaaattgaatatatagttatatgttagtgttcctattgcatactagagtctggatatacataggctcagagtaatttgttatggtccacaggaatatatattttaagatggactctcctaagagtgagaggtgatcctacagccagtggcttgcttggttgtaggatcagatgtgattaagttcagagaggagacattttgaacttctctggttgtagaaatgctgcctccctatttcctacaaatatacagtgaactctggatgtcttctgggacagagtagaaatacttgcaacaggaattggggtctggagatatatgcaacccagcagcactgttataaatattttggttttggtagcaaatttgcttacagtatacagccataccttgtagatatggtgggttccgtgtcagaccatcacaataaagtaactattgcaataatgtgagtgatacattttttttggtttcccaattcatataaaagttatgtttatactacattgtagtctattaagtgtgcaataatattatgtcaaaaaagcaatatataggccgggcacggtggctcactcctgtaatcccagcactttgggaggctgaggcaggcagatcacaaggtcaggagatcgagaccatcctggctaacatggtgaaaccccgtttctactaaaaatacaaaaaaattagccgggcatggttgtgggcgcctgtagtcccatctacttgggaggctgaggcaggagaatggtgtgaacctgggaggcggagcttgcagtgagctgagatcacgccgctgcattccagcctgggtgacagagtgagactctgtctcaaaaaaaaaaaaaaaaaaaaaaaaaaagcaatgtacataccttaatttaaaagtttttattgctaaaaatgctagtgatcatctgagccttcagtgagtcataagctttttgctggtggagggtcccctctcaatgttgatagctgctgactgatcagggtcgtggttgctaaaagttggggtggctgtatcagtttattaaaataagacagcaataaagttcattgaatgatgcttgaatcaattgactcttcctttcatgaaagatttctctgtagcatatcatgctacttgatagcattttactcacagtagaacttcttttaatattgggatcagtcctctgaaaccctgccactgctttatcaactaaatttatgaaatattctaaatcctttgttgtcatttcaacaatgttattagcatcatcacccggaatagtttccctctcaagaaaataatttctttgctcataccttatccctcatctgttcaagtttggtcatgagattgtaacaattcagtcacatctttaggctccacttctaatttgagttctcttgctatttgtatcacatctacagttatttcctccactgaagtcttaaaaccttcaaagtagtccatgagggttggaatcttcttcgctcctgtcaatgttggtattttgacctcctaccattaatcagaaatactcttaatggcatctagaatggtaaattctttccagaagaatttcaattttctttatccagatccatcagaagaatcacaatctatggcagaaatagcattacgaaatgtatgtcttaaatagtgaaacttgaaagttgaaattattccttgatccatgggctgcagaatggatggctgtgttaagaggcatgaaaacaacattaatctccttgtacatctccagcagagctcttgggtggccaggggcgttgtcaatgaattcttttcaaaatattttgaaaagaatcttttcttctgagcagtaggtcttaacagcgggcttaaaatattcagtaaaccatgctataaacagatgtcctgtcatccagaccttattgttccatttctagaccacaggccgagtagatttagcataacttttgggggccctaggattttcagagaatggccagtgagtactggcttcaacttagaaagttgccaactgcattagcctctaccgagagagtcagcctatcctttgaagttttgaaaccaggcactgacttctgctctccagctatgaaagtctgaggtggcattttccccccacctagtgtgaggctgttttatctgtatggaaaatctgtcgttcaggatagccaccttcatcagtgatcttagggagatcttctggataacttgctgcagcatctacatccacacttggtgctttgcttgcacctttatggaatggcttctttccttatacctcatgaagcaacctttgctagcttccaacttttcttttatagctttctttcctctctcagccttcacagaattgaagagagttagggccttgctctggattaggctttggccttaaggtaatgttgtggctggtttggtcttctatccagacatttggtcttcttatcagcaataagactgttttgctttgttagcatttgtgtgttcactggggtagcagcacatttaatttccttcaagaatttttttgtttgtattcacagcttggctatttggtgcaagaggcctagtttttgccctgattcagcttttgatacgtcttcctcattaatcttaattatttctagcttttgatttaaagtgagagatgtgtgactgttcctctttcttgaacatttaggggccattttatggttatttcattttttttccatttttttgtctaacgtgattcagagaaatgtagagttattaaatggactaattttcatatttttatgtctcagggaatagggagcccaaaggcaggcagcaagacaggagaatggctgtcctggtggaacagtcagaacacatagacttatctattaggtttgacatcgtacaggagtgtggttggtggtaccttaatagtaatatcaaagattgctgatcacagatcatcataacaggtatgacaataatgaaaaagtttgaaatattgtgagaataagcaaaatgtgacacggacatgaaatgagcacatgctattggaaaaatggcagtcatagacttgctcagtgcatggttgccacaaaccctgaatgtgtaaaagaccacaatatatgtgaagtacaggtgaggtatgcctgtacgtagttggtgcctgtagttttgtatccattgaaatatactgtcactcattgggtctgcaattgggtgtaataataatatcattttattgttaatgggctttgagtcttcctctttcttctgtgatagtttgccattgtcaagttaaatttttatgagctttttcagagcagaaattaaacattaaatggtttattaaccaaaataaggcaactgcctttagactttaatgtagtacccattttttcctacagcttatcgtcttcccagtttaaaaggcttaagcagaagagtaacagtatagttaaaagtttttaagttacaaagttggaacttgcctttttttgattatatgatcccaagagtcacaagagagtaggcagaaagattactgctttatcaataggtgaaagttcaggtttatctgaatttagaatattaaattgtactttaaccataccacatgtttttataacatataaatcataactgacttcatactattctgttattttatgaggtgatctgatgtggctgcaaagttgttaaagttaaccttgaagaaacctcctatggcttagtgtttatttgcaaaatcaatcacattttttcttctgccttattagactgatgaaatcattttctagcatatggaaacattcctggacctcctgttattttgcgtaaataaccccatgtgactcacaaatgttgaaaaagcagtagatatttccaaatgctattagaaccatcaaactaatacaaaaaattcttcggtgggacaaatgaagaccagaatgaagtctaagtcactgtttccagtgaagattagtcactttttccactctaattccagaatttctttaatttttcttgcttatgttagcaacagtattgtcacaaaagattcaacagtcatctcctcaggtaaccaattgttacacaaaccatatgtagaaaatgctcactggcttcatttatagaaaaaaaaaaagataactggaagttagaaacagttgtccaaacttttgaactataataagctattttgaagtgtcattgtcaatacaaagtacataccagtgtgagattttaagcagtaataaaatctatgtgtggaagagtaaatgaagcgtttctgcaatattaatgaacggacagatatatgggaagaagtgatattaaaccttgccatacactctgacaatgtacatgaacagagccagtttgcttgtaaagattagtaacatatcattgcaatagatgtgcatcctgtggtctaaacttattcctaaatgacatcttgaagtttggcctgtccaaaaacatcttttgaggaaggacagatgctatagctgctttcttcaaggaaaaaaaaaaaagtaagtgacatcacaccttgttttaaacttaatgaagtgaagtaaggatgtcctctgaaaaactggccggaagtaggagtagtaggagggggaggaaaaggagaaggaagagggaaagaagctctttaagaaatagaactagttgaaaatattagtatctaatattgtcaggaacatgacatataagagattattggcagagtgcaacttcagaactcttagaggattctaaaagcaaaggaaaaaagttttttagtttagtttagtttagtttttttgttttttttttaataaatgcttactacttctgaatcagacattctttggcatcttaaactgaatgcctgtaattacattagctgttttgtgagacttacatatattctagtcctgtctagtacagaacactatgctaagcattgcagaaagagcaaaatggatattacttctgtcctcagagaacttatctaggaagaggtagaatataaatattcaaacatctatagaaaaagcagaatcaaccatctaagaggactgtgtagacaagacagatctaatccttttattaacataagtgcttcatgaaggaagtagatgtgaactggacattatggtgtgtgttgaatttggacagattaagatgggattggggtaggagttaggcttttgacaaagaaaacagcatgggcaaagatggagcagaggtggagatgtaggggatatttgggaacaggaagcctgatttagggtgaagtataacttttatagaggagaatggtgggagataaaatggcaagtaaagcttagagccaggtcatggagggttttaaaaatgagaatgaagatttgaactttattctctagcagtggggagtccatgaagactttttagcaagggcttggtaggagctagtagctgtgctttagaatgattaatgggaaggatatagtggagtcgggagaggttagaatcaagaattaaaattaaggggccattgcagaggcccaggtgagagagaataaggcctaacataaggtgtggcagtggagacggaaaagaaaagtgaagcatctggtagacagaatcggtagaactgagccatgattgtatgtgggaagtgagggataagagaattggaacaatatttgcatctgagtaactagggcactggttgtaccattaacagaaagaagaaaattaggaagaggagctgatttgggaaattaagaagatgtattaagtgtttgagatgaatgtgtaggggcatatgagaattgcaaagaagagaaagggacaggaagaaaagactgaaaagaaatgtgtgctttgagaaatacacacatttttgagtttgaatagaagaaaagaaggtggcagaagtggtcaaatcagggagaaagaaatcaggacagcatattattaggaagtctctcttgaggtgtgtgatcttgttttactccaactactgtggttttcattgtccttgcagactcttctgtactccatggttatagtaacgctctaactcaaattaattccattgttctttctattgaatcatcacagaagctgttaggactgataatccacagaatgatatgagggatcagaggcttacattctcaatgccaagattatatatactattcctgaccttaccaggtaggtaagattctttgtgcttaattccgcactcaggacagacttggtgagtctgttgcttattttcctgtatcttattagtgagggaaataatattagccattttgtaggtttggatgctgactctcgtgtttgctttctaaatcagcacctgatctggaaaccaagagatgaaagaatttcagtgagaggctagtcagtagcatcatatggtccactctccagaggagaagacagatgaaggttaagaaaagactccactaggtttggtggttttgaggtcactgatggcctttaagaagatagttttaatactatgatgtgggtgaactaatccaagaagttaaagaataggtacattttaaagaataaactttccaacacagactactctttcaaggatttaggagatgaatgggaggatagagatgaaatgttagctataggatcactagggtcaagggaagacttttttcttttctctttaaattgaaaaaagtaagcatatttgtaggcagaggtaaaggagtatttggagaagaagagaaagaaagtactggggagtagggggttaactgttggctgatagatcttggaggaatctggaacaaatgatatcaagtatataggttgagttattgaccttgggaaggaatgtttagagatcagaggagtaagaggacaggagatgggtggaggtatagggagaggacagatgctgagggaggatatatcagacctcaggcatctcattaaaaaagataaggccattggccaagaatgaggaaaaaagagataggagaaaaggtgtaaaatagttgcagtgggaaataattaaaatgaggtaaactcagctgaggacagatagttgattttatttcttgcctttttctagtaaaattcagttttactagaatttgtttttgcttaagaaagttccatgaaaggctgcattcagaaatatgaagaattttattgtcagctaattcatgctgatgtacatatcttagatccagaaatataaatgatgatagtactattactacttagggctggatcacaaaaagccaatatgcacttaggatttgaaggtactttcaaatgttataaggaaacagtttcatcagggagtagttgtaggaatgtagtttggaattttgtcaagcatatcttttctgtcaatcaaaggcatggttttgtatgacacagtgtctaactcttgcttctgatttcttctgtttatatgaaagatatttctctaggtttggaagtataccaaattacatgcctaatgtgtaaaagatgtttgacttaattcaagaagaccttaattttcagaattggtgatgataaaaatgaaatactacatatatcaattgctgatagttcagaaaaataaaacatattagattctatgtagctaaaattaattgtatttaatgaacttgacaaacactatagaacaaagcagaatttaccagcttagaggactgtgtagacaagacagatccaatccttttgttaacatgaatgtgtcattaagaaggaacatgtgaactggacgttggagtacatgtagaatttggacagatgaagatgggattggggtaggagtttggcttttagcaatgaaaatagtgtgggcaaagatggaacagaggtggagatgtaggagatatttgggaacattctttccctagttcctttcctgaaagtaaggactttaggtagctttttgacactgtggtggatactcagttcaggtaacatctttttttgttttactttaacttggttgtctgttttttagttttcacttgttatacttaaactgggaagaaaatttaaaaaaacagagacaccagattctttaaattttaagagtcagtattccctttcagtttaactgaatgttaaatgttttaaaatgttaagtatctggccgggtgtggtggctcacgcctgtaatcccagtagtttgggaggctgaggtgggtgaatcacttgaggtcaggagtttgaggccagcctggccaacatccctactaaaaatacaaaaattagccaagtatggtggcggccacctgtaatcccagcttcttgagtggctcaggcaggagaatcgcttgaacctgggaggtagagattgcagtgagccagatcatgccaatgtaccccagcctgggcgacagagcgactccgtctaaaatgaaatgaaatgaaataaaataaaataaaataaaatgttatgtgtctactatctataagatgatgatgagcaagataaaattccttttctcgaaaagtatgtaatctgttaagagacatttcacgtaggaaatttgaattatttcagtaaactatactttaaagggcaatcaatatattaaacaatataatcaaaccaagtcatgcataatatcttatattcctattgtaactaagagttgcactgtccaatatgttaaccactaactgtatgtggctattaaaatgaatgaaaaataaaattgaaaatttagtttcactagttacatttcaagcattcagtagctacatgtgattagtggctagtgtagtggacagcatagatagtgagcatttccattattgtagaaacttctgttgggtagtgcagctctagagctatagaacatattttaattgttttggacaggcttgtccttcatctcttcaacaaaccttcattaaatgcctaccatatgccaggtgttgtgatagagtgagatgataaagtcctagttcctccttacacaaacctttcaatcttgtgggacatcaagtcagtgaatgggtgaataagatagaatgtgataagcatcactataagaggagagatacaagaggatgtgaaaatacacaaggaaaagtacagaagcaacacttaaggtttccttttgtagaaaggtgagtaggtgttggcatggttaagttggagataaagcagaatccaactgcaggaaatgcttggatgtgaaagaacatggcacatttgagggactgaaagttgttgactgtatctggagcccagataatttctaaggtctcttaattcacagtcattattaggatacatctaaactatttaaaaaacactccttcctttttcaaaaccaaagggacaaagatccccatgcaccttccatctatttggggagcttcttatttttatatctgtggatcctacagtcaaaggaaggcaagagaaagtgaaaagaaaataaatttgaaaaagaaggaccaaagaaatgaagatggccagaggaagttttagagaaataaaacaggtaacatttgatggagaatgatagtaccatttataacactcggatcgctgtctccagtcagaagtgaacaccaaccattccaaaagctagtgcccccaaatagtttacttggtatgtgaaatataatatgtgagaatattttttgatatgggatttaaaaattgaatttctgccctggttcatttcagcagaaatcatagtagaatttgctttactgtaattttcgtaaatgtatacctttgtagtgtatgcaatatggaagaaatttacattctattattttgtttttatagaatacaaaatagtcacagtcaggttaaaacttacatgagaagtcagagagagagtaggatcaggaaacaaaagaattgtacgttcattcagtcctcaccaattacagagaatattatatgtattatacaaaatacattgcacataataaatctctcacattttgtaaatatttagctgttgttgatttatttctgggctaatggcagccgtcacgtctctggtctgtgttgggaatgtctgtttatatgtctgtgtcacatcatctgctctagcatggaggcttcatggaagacaggaaccatgtctgtttattttgtgtgatagtaacatggagctctatatatgaagctttatttttatttgatgatgatgatggtgatgattttctgtatgaatttctttcctggcttcagattgattgaatcttctgatcactattaatccagtggaactcagaagtggagtttacttttgagtgcttagcctggctaggcagcaggcttttgcaaacacggctatatgagatcttatgccaccacaaagaggcactctcttgaaaaaagatgaaaaatacagagaagccacccacattggttttcatcaaggaaaagtttggtgtctagtcttaccaccaagtgcttgtcaaataaacttggtttgaagtcaagactgaatacagtaaacaaaaaactcagataaaagctatagtaaaaaacaatatttctctttattttcattccttttcttatttgggacaaccttttgaatagtgtgggatgattgaatgtaaagttgatgaggtgaaactgtagccaagtgaataaggtctcagtgctttttaaggatgccctagctctaaacaaattttactattgtatcctacctgtaaaatatttgtctttgtaaacttgcatcactctaaattataaaactgggcatccaaagtcattcatatggacacaactattaagtttagttttatttgttagaatgttcaagatactactgataaggaagcttttaaatatttccttgaaaacctttctttcctctttcaccttgcctctactgccctttctctagatcgatcatgaatttttctattatatttcaaagaatctttagggtttacttgccacatcttctattggagtccatttttcacatcacatttttttgtattaacccattataaatgatactacttcttgtattatttgatttctatgttcatttttatgttttattctataacctattgaggtttatacatataaaataataatcacctgctagtgttaccaatgctgattatgatttttgaatttttagaatgtttgtgtttgattctcctgatttcctttggtcaatatttttttttttttgagacagagtcttgctctgttgcccaggctggagtgcagtggtgcgatcttggctcactgcaagctccgcctcctgggttcacaccattctcctgcctcagcctcctgagtagctgggactacaggcgcccgccaccacgcctggctaatgtttttgtatttttagtagagatggggttttaccgtgttagccaggatggtctcgatctcctgaccttgtgatcctcctgcctcagcctcccaaagtgctgggattacaggcatgagccaccgcacccggccaatactttcttttgaaatttatgttagccttgaaaaataatggtaagccgggtataaatatgctgatctaaaagtgttattagttgacatagttaaagttgataaaacagtcaaaatttaccatgctgtcttctttctagcatatctatattttgacaatgaaaatggttctttactaattatatatttgcttattcctgccaataataagacattctttgtaaaagcactttaaaacttcatagaaatatgaccgggtgcagtggctcatccctgtaaccctagcactttgggaggccaagacaggtggatcacttgcggtcaggagtttgaaactagcctggccaacatggtgaaaccctgtctctactaaaaatacaaaaaaattagctggccatggtggtggtgggtgcctgtaatctcagctgcttgggaggctgaggcaggagaattgcttgaacctgggaggcggaggttgcaatgagctgagatcgcgccactgcgctacagcctgggcaacagagcaagactccatctcaaaaaaaaaaaagaagtgtgtgtgtatgtttgtgtgtgtgtgtataatagaaatatgcaaacataacgttctatgttaagtgtataaatatactacttgacagaaataatactgtttctgttgagcagatgcagaatcaagttcagagaagttgaattgcttgttcaaagtcatgtaatagtaggagctgagcctcaactttataaatggtttgacactactttacttgatctttctataacatcatttcatctcttcctttaaaaattcagaatcgttatgattgtttcctttgtcacctttattttcttagtcatcaagaagactcttgttgttttcagctcagcacttcaggagagcctatagtttttatctttcactttagaaaaatagatttttgttctaggaccctgtcccaagattttaggaatttgatagcatcaacatgagtttagatatagcagtttacccacagtgtatctaggataaaataaatttaagataaatatatttgcaagaacactggatagaacttagatatattaattaacaatttgccacactcagaggaactgccttttttctttctttttctttttttagagacagggtctagctctcttgctcaggctagtgtgcagtcttgcagtcatagctcactgcagcctcaaattactgggctcaagcaatcctccaacctctgcctcccaagtagctggaacaacaggcacctgcctttatgcctggctaattttttaattttttgtagagacagggtctgactttgtggcccaggctggtctggaactcttggcctcaagcaatcctcccttcttggttcccccaaaatgttgggattacaggcatgagccactgtgcctggctacagaatttcctaagttattatttgttcgtttgttcattcattcattcatttattcaagacagggcctcattctgttgttcaggctgagtgcagtggcatgatcatggcttactgcagcctcgacttcctgggctcaagtgattctcccacctcaacctcccgagtagctggggccacaggtgtgcgccaccacacctggctaatttttttatttttatagaggcagagtctcgctatgttgcccaggctggtctcaaacttctgggctcaagcaattctcctacctctgcttcccaaactgttgggattacagacacaagcgaccatgcccagttggaatttccttttttcgatacagttttgatgaagaaattttctgagggctatacttgctaaagcttgaaacagaagaacaaaattggtcactaagaaagtaggagaggttttcattcatatccactgtgtatctgtgtctcagacaaagatatgctggctatcagaatgctgacattgcttactttcctatttttcaaagactgaacaccatacacatagcttgaggaaggatattattcttgtatacattttgacataaagatgtttagtccttggctggatatttcagttctctgaaaatgtgtagctatcctgtgagaagcaaacatcttggaaacagtatagtatagttgaaggaaacggtcctaccgtttccttgcttagacaaatcatttcatctcttcttttctcagtatttttttttctggaaatctactctttttctagaaatatgtatacaacatttaaatttgcatgtgtctgtcaacatcagtgtgtaaacatattatgttcactatgaaaacatttaggaaattcagataggcaaaaaggaaaagagatcgctgactacagcagaaaactataacattctgataaagttagataaaagccttttgggcttttatagtacatgtatatgcacacatacacatagactcacacacatacatgtacctacaaataacatcttaaaatgagttcatattgttaaaaagtgagtttatatagctaaggaagcacatctgaggacaagaacacctctattgcaaaactaacagatgatatagaactagtatggaatacaatagaggtgactaaaaatttaatggtttggagtgaaagcgtggaataatcacggtaaacacaggagtaagacacaaagatgaaagcaatttggttaacaatgatctgatatgaagttgaaaggattactggtgtctttgaggaagtggacccaacaaatcaaactaaaaaagtatttggagaagtgatatagcaaaacttcactgaaatgaggaactgaacctgcagatcaaaagatacattgaatcctgaaaattggtagagaaggttcaacatcatgtcatatcctgattgttgccaaacaagagaaaggtttcttcagtcatgtaagcaaaagcaaaagttatctataaggaagaaaagcaaaagttatctacaaggaagaagtttagactggcctcagacttcacaacaatgtgcaatactacaggagctatgtcaacacagttctgataaaagaaattacggcccaagaacagtgtacccagccaagttgttgttgaggtataaaggccacaggcgtatcctctcaaatgtgaaagaacccagagaatatagtatctgtgagacctttctgaaaaagaactaattgttgaaatttagccaaccaagagaggaatcaaaccaaaaaagtgttgtgatattaaataccttcatatatatatgtaagatttagatactgtagaaagtgtggcagtacaacagactgtaaacactctacatcatggcaaagtaaaacaaatatatacaataaaaattggaaggtaggtagaagggaaatgggaatgagagattattaatcttattcatagcaacaattcaatcagaactgtctcaaatgtaaagtagtttaaaagtaatgttaatctattctttgtggttttgatcatttttcttaaagttagagggactttttcacaattaatgtttcttgagtgaagaaacatttgtctaagatttaaaatttcttcagtttcatttcggcttctgttaattgcaggtaaaattagaattgatattttttatttttaactgtgaatataatctcatcccagaaagaatacatttatttctgtccatccattatctatgtgtatatgtgtatccatgtgtatagaattgatattttttatttttaactgtgactataatctcatcccagaaagaatacatttatttctgtgcattcattatctatgtgtatattccagttgtctggaataatgtcactaattgctaatctaatacctaatatttctcaatggtgagattttggatgatttaatgcatcttttctgtgtattttttgtagtatttgaatttatataatgagaatattttaaagaaagtgatacaatgaatttattgctctgaaaaatgaataaatacttacgcagttttatagcctcatttcttttttaacttatcttgaccccttttctcttaccatcattttaaatagttgcacagtattttatggatgtgttaatatatttcttctttcattcctgatctcagtttcttcatctgtaatgacagagctgaactagattagccggttgcaatctttctctttaaactatgaaatccttccaagaaataaacagtttataactcttggcttaggcatttcccatagaatgtagtttcaaagctgtacagattagataatttctgaggcttatttcattttaccaccaaaaattagggtttttcttttttttaggatttttttgagtgactttttcatgtgtttaaaaaaaatcggtaacagacataatcttatgaatcagaattttaaagtgaaagggactttgaaaaccatctagtatatttgcctaacttttatacatagggaaaccaaatttaagtttttaaactaacgtcatacagccaactgaaatgaatgagacttgagtgcacatctcctgactttctatgctgttcttttccctacagtacacataaatatatatacatatatatttatacaatgatgggcaaacaagatgacaattttattgtactcatgtcacatttaaaccatcatgtaaatgtcaggaaatatgcttaatttatagtgtatttattttcttgttcatgaaaagagatcagtactgcagccattattgaactcctagagttagaaaggaaagtgagtgggattctggcgagaaagaaagcatttacttgtcaaagatttggaatttactgtggttaccaaaattaaaataaaactaaaacttgacttggcagaagattaaaaacaaagcagctccaaagtgtgtgcacatcatggagaagatgccattattccttcaggcagccaaaggggaagggaatattgtttctttgcgttgctggagctgatttatttagttatgatttcaacatgcctacagggcacaccccagaaaacattacacaacaacattaaccagaacaaatggtgctttctttttctgtatctcctcctaaggttttttaacagcagtgaggttttttctttttctttttttttcccccatattgttaaaatggctctgattatgtttgactattgggtgtggcaggttttagaatgttaagtggtagtacaggttcctgaacaagaaagagaattagagttgatgtgacttgattattggaatgtgtagaatgtaaagttgtgagacatacgacggtctaccgcaggttgctcttagtaatggaccttcttgttaaaagccctgttattattgggaatttattttggaaactactaaagaagaaatttgacagaaaagtaaaacaaaccaccttgtctcatatttcctttctacacaggcactttgaagagatatcttaaatattgtcaagtctcaattatcctggcacacgttagcattatcaccattctcacaaacttgaattaaatgcacatggtattgcagcaggtgcagcacagagaaaattggcaaacaagatccttatccttttggagctcagtaagggttgctatcctagtaagtagttcaaccaatcccaaactaatttttccggatactctccaaacaccctccctcccttcctatatcctctgtcttcattagtggcctctccatcctctcagctggaaacctcacattcatcttgagtctttatgttcccttggtcttcacaaccaatctgtcaacaagtcctgtttcttctatcactaaaattgctttttgactttgtttgtactcttccctccattctcctagccattgccctgtttaggcccttttcatcttccatttcagttcttggagagctgcttatctacttttaacctttccattttctaatccatcctccatactcttgtcaaatctctttctttaaagacagttctaatcatatcactctctggtttaaaaacctttgatgggtccccattaacacataagggataaagtctaaactccttagcttgtcatgccagggtttcagagtctggctctgatctacttattctcatctcattacctgccataatttcccccttaccgtatttcccattgccagacgcacacacacatgtacatttactccattcccacaagcttcctcataattccctgagcttgctatgtaattgtgcttttgatcatgcctttccttgccccatatacacagaacactcttccctgacaaactcttgcttgtatagaggaactgaggaagccaagattttacaaagagtactcttgacaaaagaaataaaccacgtgcatagaccaagcagtagggccaccgttagagcagagttcagactagtggctgccgactagtttctcttgggcaaaccaggaagaaggactcaatcccagaaggtactggcattatagcagtgattaaattggtttgcaatagtattaaatgaatgcctccttcctatttatacagccaagagttagcatttacttttatagctaaaggatagagggaaatagctacagtaggtttctggcatagtagttaatttcaagaattaaaagaaaactcattacccttatctacctactactcctaccttatctcatgttccaaaggtgtaaagaatgattaggaactcacaggaccacgagccttcacactcacattggtgctttttaaaaatcaccaggatagagccagagatgatgggtttaaggggtaaattgaaagagggaaatagcagctctttacctcaagttactgaggaagcagaggcctttttcatgctctgcctagtcatgcttctccctaaccattgcatctttctgctcaacctttgtcctttttatccacatatgattcttttaaaaaattagttcttactatataagtattgtattaacatagtatcttcaaaacatgtggaatgtttgtaaaggcttctctgacattctctcaccaccatcatccccaatcccagctgcctacccaccaatgccagaaaatgacaactattttcagtttggttttctgttgcttcagacctttctctatgcattgacttagagatacatgttgtggatagacaaataggcttatgaaatatagtattgctgtgtgtgtttgtatgtgtacgtgtgtgcttgctttcctcacagaatcagtatcatacttactctgcctctcagtttgcaaacttgcttttttgactctgcccgtagatcttggatatctttcctattagtatgtagagataatttatcacagttttttcaacttcttacatacagtattatatttaggtctagcttaaccctttcctcttctcatagcaatctgatatggacaattagaagagaaaaaaattttagtaactgtgttagtttgttttcatgcagctgataaagacatacccgagactgggaagaaaaagaggtttaattggacttacagttccacttggctggggaggcctcagaatcatggtgggaggcgaaaggcacttcttccatggcgccagcaagaggaaaaatgaggaggttgcaaaagtggaaacccctgataaaaccatcagatcttgtgagacttattcactaccacgaaaacagtgtggggaatactgcccccatgattcaaactatcttccaccaggtccctcccacaacacaggggaattatgggagtacagttcaagatgagatttgggtggggacagagagccaaacctcattcagcctctggccccctcaaatctcatgtcctcacatttcaaaaccaatcatgccttccttatagtcccacaaagtcttaactcatttcagcattaactcaaaagtccacagtccaaagtgtcatctgagacaaggcaagtccctttcgtctgtgagactgcaaaatcaaaagcaagctagttgtttcctagacacaataagggtacaggcattgggtaaatacagccatttcagatgggagaaattggctaaaacaaaggggctacagggcccatgcaagtacaaaatccagtggggcaaattctaaagctccaaaaagatctcctttgactcagtgtctcacatccaagtcatgctgatgtaagaggtaggttcccacagtcttgggcagctctgcacctgtggctttgcagggtatagctcccctcctggctgctttcacaggctggtgttgagtgtctgtggcttttcaaggtggaaggtgcaagctgtcggtggatctaccattctagggtctggaggatggtggccctcttctcatagctccactaggcagtgtcccagaagggactctgtgtgggggctccaaacccatatttcccttccacactgccctagcagagattctccgtgagggccctgctcctgcagcaaacttttgcctgggcatccaggtgtttccatacttcttctgaaatctaggtggaggttcccaaacctcaattcttgacttctgtgcacctgcaggctcaacaccacatcgaagctaccaaggtttggagcttgtactctctgaaactatgcgctgagctgtaccttgaccccttttagcaatggctggagtggctgggatgcagggcaccaagtccctaggctgcacttagcatggggccctgggcccagcccatgaaaccattttttcctcctaggcttctgggtctgtgatgagaggggctgccatgaagacctatgacatgctctggagagattttccccattgtcttggggattagcattcagctccttcttgtgcaaatttctgcagccagcttgaacttctcctcaaaaaatgggtttttcttttctactgcatcatcaggctgcaagttttctaagttttatgctctgtttccttttaaaaatggaatgcttttaacagcacccaagtcaccttttgaatgctttgctgcttagaaatttcttctaccagataccctcaatcatctctctcaagttcaaagttccacaaatctcaagggcagggacaaaatgctgccattctctttgctaaaacataacaagagttacctttgcttcagttccaacaggtccctcatctccatttgagaccacctcagcctggactttattgtccatatcactatcagcatttttgtcaaagccattcaacaagtctctaggaggttccaaaccatcccacattttcttttcttcttctgagcccttcaaactgttccaacctctgcctgatactgacttccaaagttgcttccacattttcaggtatctttaaagcaacgccctactccaatggtaccaatttactgtattagtctgttttcatgcagctgataaagacatacctgagactgggaagaaaaagaggtttaattggacttacagttccacttgactggggaggcctgagaatcatggtgggaggtgaaaggcacttcttacaaggtggtggcaagagaaaaaaatgagaggatgcaaaagtggaagcccctgataaaaccatcagatctcatgagacttattcactatcacgagaacagtatgggggaaactgcccccatgattcaaaccatctcccactgggtctctcccacaacgtgtaggaattatgggagtacaattcaagatgagatttgggtggggacacagaaccaaaccatatcagtaagcaagtactggttctgattaaatgcaaaaaatgttgcaattgttggtttcaggaggagtgttatccttaaaaattagactgtcttagaaacacttgttggacccagttcaaaggacttcactagcattaacactctctctcctttctttctccttaacccacttctacccaattactgacattgatgggagttaaatgtaaccaggactctttgtttatatatacatctggttttccctgttccgtatgcctaaatcctccctccattgcttctgtttagcatttaatgtaaatttccaaattaattcaagaagaaaatttgaaatatataagatgagggcattaggtgatctctgagggcttttacagctctaggattctattaggttattaataatttatttccagaggatacattctgataaactaagaagttttctgtgcttgatttagcttttacttaattaggaatataaataactaaatatttaaatagataaaacttatgctatttgtcactttttcttgaagcatatttataatgatcatttaatgttcaaagtaaacctccaaaaggacttggtaactgccaaatattaccaccaaactgtagactaatcaattagaccactagtatttgaatttttttcttttactatataaaactaagaaacgtggactgaatcaaagtgaatgggagctttggataaaatattggtaagatgtttgcacttactgtctgcttttgaatgttcagatatttaagaggtaccatcatataccacgaacaaaaggttgggagtcaggaatcagggaattagtcctagctcatcactgtctcattttgtgattgcaggtcatgctttgctcttaaattttcccatctttagcatgtagtagattatttctgacccttaacttacccagggatgttttgtgaaataataaagataaccactgccagttattttttgctgctcagtaaagattctacacaaattaatggtagcagtagggtggttatttcattatttaagaaagttcttcaaagtgagagaactacccagcataggtcatttggaattgctgtttatttgttcttttaggccagcaaaagtgttctatgttaggtagaacagtgctaaaaacttacataaaagcaaaggttttgtaagttgtaggagccagtccttggtggatctagttctttccaactcttgtttttagtcatctgcttttataaaagtgagtggtcttaccttttagttgttttttttttcctaaggtagatttttatttttatgtttattcatatattctgtatgagttctgtcatcttgataaaccttggaatagaaagtcatatgtaaaatttgccactttacttgaattctaacactttttgtgatgttaacctgttagattctcattctaaattccacttctcaccttcttgtgattggttgctgtttgttaggaaaacatgtaacagattcttaccctctttgaaaaatcactgttgttctttttgttgatgcagaacagcagtaattttttctctttaaaggaaaaataatttagacaaaggagatacttgagaaaagagtttaaagaaatttactgttttctcagtgtacttcttttcaaaatgatgtcaccccaagtgttataattctttcaaagcttagtgtccaactggtgaacaaaactaacagttgattgcctcaagttcagcagtgtttgctgtatattttctacatctgtggactattctgttatgacataaaagctattaaagattataatttttaaactatatatttcactaagtatttataaacacgtatgaaactcgttctaagtataacctgtactgaaatgaactgttcatgtttatgactcagtaggtaaattgctctggagtgcttcagaccaggctcagctgaagcaaagcattttgaattgatattgttaggaaaggttttttttccttattcaacggttacatgcgaattttaaaagatttcttgtgtttggttagttctaaatttaaatttgttatacttcttatactagtagaatgtttcctttctatctgcagatttgagagttggtcttggaatatggctttgcagattaaaaaaaggttacttttaaaattcctcttaaactttataattcaaatcagtcaagtaaccaagaagagaaattagagaggataccattgacttgctttgtatctgttgttcttcctttccttctctgcaaaggtaaactgaattgcagctttgtacttagaagtaaattactattaaaataaagacagtttaatagtattttagaaaatgtggaaaatggaaagatgggaatgaactataaaagatagaatttgagctgagtcttgaagaatacattgttcttgatgtattccagacttccccttagacgttttttattctttgtgactgttgtgtgttatgtgactacttaggtcatcctccctcagggggaatagttggacgtttattctccaactactatgtaagcaccatcttaatatttgcccttggatgagtcacatcactctgctttgccttaatttctccatctgtaaaatgataatggctatataattttagatttattgagttcagtggaggcaaacctttaaagtatagagatggctttcactgtgaatgaatttaagataaaagatagcattaccacaacagtgcatttttctacctttaacacatatgttaaccacatttttgtgggggcacaaaaataaggatttggcatacaagataatttgagtgccttgtacgtgttctagctggcaataatcctaacccttgtactcagcatctggtttattcatgagatcccctgtaattaaccagtagtacttctcagtcttgtcttttaggaagatttatggtatacctcaggtggtgtcagatagcaggcagaagacagatgagtagctagttctctttatttagaaaaaaattctgtctccttgacaccaatattgttaaataagatatgatttctaaaaagccattttccctgtttatttgacatgattggcagctctactatctgaacacctaagaagtttaagtttcttaggtgtggttttagagtcttaggaaagctgggaagggcctagactttagaggcgacaggcttatggtgtgtcctggagtgttacacaaggaagaattattagggccaggtgcctttcatgtctatgtctgccaaagtaaaaaatgcagaggcaagagtttgtctcagcaatagtttcatacattatctacacagagaaaagtgactatttaatactggcaagaattcaaatactttctatgtaatcaatatcaaaagagggtaagtttgttttttgattggttatcaagttgatatacagtcctattgctgtggtctgcttaacctgtaattatcagagaaatcttgtcaaacaagattttctgaaatgaagcctgttaattatatcagatcctttggttttatgtggaactattatcatgtcatgaattgggaaccgtttgaacaaaatactgatttggaaaactctttatctcaaattttgcttgaaacccatgacatctaatggaaagggcatggtgagaggcaacactaaatttctaagctgaactcttttcctaaacatccctcagtgatcattctcttgtatgagtagatcccaacaagggtagggattggttagtttcagggcatcttatctaaacattcgtctaggggcaggtctatgctggttagacacatagaaatcaaaattatcaacacagtgatgacaatgtaattggccatatctatcagcaacttataatcaaccatatctaaggctgctgaaaggtacaccctggtaaaaattctggctctacctttgactttcattactgaccctaaggattttggactgaagtctgtaagtgagcttgaattcaacctggaatctgctttgaccttgtaggtaaatagtgtgcaaagttaggaaattagaacaaaataaaatttactttacagctaggataaattgtgataaaatgagaaattggcagcaagaagttttagtgaataggaccctcaaaggaaacttaaacaatgttgaagtgatgtttgctgccatcagacagcacacacacacaaaaaactatgtctaaactgttaaagtggattttatgtaaattgttcatgataaacatttgcattatatattcctattcctttgtacttcccatttgatgaagttttcaaactgtggtttgctggaggggaaaaagaaaacccaaatccaaaccacataggacaaattgaattacaaacctggtgtggtcccttaactcaattacatctaatttgtgttattttagtcatcctgggtggcagctgttctgagtaaatgcccacaaacattttcaatgtaagaatttgtcctgattacagctctttaagatcagtagtagcctatttatattttaagtggcaaagttttagattaatttggtgtatcaggaccattttaaaaattcaaaatttagttgtttcacaaatagacatttaaaaagcaagcatccaatgtttattttaaatgttaatttttgtaacttcacctcattttcttatttcttatgtttctacttatgtttcttctaaacatagccacttaattactttattcaggcatttatcaacttgcatatacaagggaatatggaattttagattcagataaatgctttgacattccaagtcaaaatttgagatgatctgggaagaaaaacatgaaataatatgggttcaggattgttcagttcaatataattaaaacggaggtttgtgttagaactaagttaagattgaatattaaatacaaaagaaatgaagaccttgaaactcatgaaagtcttgtggaaggaccttgactagtgttctaaggtagacaaatgggaccaggctaaattttagggaattacaatgaagagatactatccagcagagacagtaatgaaagaaaactcctattacttcaaaaatgatagatggtacatgaatatgtttaaaagccattgtttttctactaaattcagtaactttcagttagcaactgaatatcttttatggactagatattgatctatgtactgagacttcaaagatgaataaactaaaggttcctactttggaggaacttatactgtagttaggatggggaacatgtaaataatttatagcaacatatggtaggtgatatgataaaggtttgaataaattcaaagctttttcttttgtcataaggagggtataggcctaaagttagggtattagatcaaaacaagtgaaatttttgtttaaacttactacagtacatgagacttatacttcactagatatttaatcagttaatggtcgacccatagacttaggaatataaattgtttaaatttgaggtgtttatcagttgtgtacactttttccctactcattctctttttatggaaaaaacaatttggtaatcaattatgatatgtattttcttgtatatctcttataatttttaattagttgtgaactgtatcaactttaataacattttaaaagatgttcatcatcctatattcctcttttatatgtgatactgactactaatctactatttatttttgaaattatttttggtcttcagtggtagtgtgctttttttggtttctctcccacttttggagagttgatatctgctttgctggcttcacatctgtattagttatcaattgccataacaaattaccctaaaacttagccgctttaaacaatgaacatttattacctaatggtttctgtgggctagtaatatcgtatctgtcttattcacatgtgaatgatgaacattcagacatccgataaatattattgaatggtgcacaaatgaatgctgttattcaagttgaggttcttatcacttagcacctaatgggctccaccatcttctttgctggcttccaatccttacccccatgctgtttgtaaaaccaccctttcaaaagaaatttatgctgctgcttcccttattaataaccagttgtgactctcattggcctaatcaaatttctgttggtctccttggcattcaaagccttccataaaccagccttatcatatttattcaaccataaaccttaacagatatacctattttacttaaactggttgtttatactttagacctgttaaaagacaatccttaaccaaattaaatataactcagtttaattgagcaaatctggcggcttcttgaacccgagtagtctgagagagactccattgcagccacgtgctggaagatttatggacagaaaaaggaaagtgacgtacagaaaacaaaatagaggtacagaaacagctggattggttacagctccgcatttgccttatttgaacgtagtttgaacagttggccccctttggccaaaactcagtgattgtcacaagagcagattacagtctgtttacacatccttttagattatagttcacactgtgtagagaaacctttaggctgaatttaaaatatgtaaggaggcagctttagggtaaacttgatttaacagaccaaaccttatccccatccctaatatcatgttcagttttactttcttacctttattaatgctttattccctcatctgtaatgcttatattccttgctttttcaaatgttgttgattcttgttctccactcaaattctttatgtttcttgcacctctttcataaacccagtttggacttttctggcccactccagttgtttttgttttcgcttgatttttttttttttggttgttgttgtttgtgttttgagacaaggtctcactctgctgtccaggctggagtgcagtggcgtgattatggctcactgcagcctggacctcctgggctcaagcaatcttcgtgcctcagcctcctgagtagctgggaccacagatgcatgctaccttgccaagataatttttaaaaattttcgtagtgatggggtctccctatgttgcccaggctggtcttgagctcctgggctcaagcgatcctctcatgttggcctcccagcatgctggaattacaggtgtgagccactccacttggctcaactctagttttttgttttttgttttttaattttattttatatatttttattattattatactttaagttttaggatacatgtgcacaacgtgcaggtttgttacatatgtatacatgtgccatgttggtgtgctgcacccattaactcgtcggattaaagacttacatattagacctaaaaccataaaaaccctagaagaaaacctaggcaatacaattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcatcgtacagaatgggagaaaatttttgcaacctactcatctgacagagggctaatatccagaatctacaatgaactcaaacaaatttacaagaaaaaaacaaacaacctcatcaacaagtgggcgaaggatatgaacagacacttctcaaaagaagacatttatggagccaaaaaacacatgaaaaaatgctcatcatcactggccatcagagaaatgcaaatcaaaaccacaatgagataccatctcacaccagttagaatggcaatcattaaaaagtcaggaatcaactctagtttttaatctttgaattctcgttgcattaacactcagtaccaaacagtgcctttctttatttttaattagtttaagtgggtgaatatgtctttccaactagaattccaattttctgacagcaaaatccttttacttctcgcatctttattgtagtgtgctgtgagtgtatcctggttgattgaaaaactagaaatgttgattcacctgtatgtaaaaaatcctttttgagtgaattttaactgctagagacattcatgaggatgagctgggactgcaggacagtttggaactacattttattattttcctgaagaaacattgctgtatgaagagattaactttaaaaagttccctccggccaactatcagaattggcttttagccttgaactatcaaagcaaaactttcagtgttgcctagagcagaacaggtattaagtagcaagcaattcaaggtctctgatccctagcctgcttcagctatgggcctggccaagccctttggcaaagataagttgaataaggaatttacttttatcttctccctcttggaagttttatggatttgattcacaaagaaagggcaataattgaaattttgtgttagcttcttcttgttattcaccaagaaaagttaaagtcaggtaatgatatcaatcaaaatgtaagtacacctactgcctaaaaataacattgtggttaattgtgttccataatattcttggcatactttgcacaagccctggagaacaaagcctgagagcccatgggaaataaagctccagttctttcggccactttaaatttagttctgtgatcttgataagatatcattgtatttacattgttagtttctaccagcattcccttgtatcttcttttatggctttttctatttctgtgcctttttgttcctcttccttattttccccctaaagccataggtagaatgtttggttttagagttttataagaggagtatttgacttttccttatagcgatctcagatttcattaagtttgtgttttaggatgatttataatatcagtctatgatttgggctattatttgcacatttttggctttcctgtggctaaactactggtgtttatataaaaaagatttttttttatttatttatgcatgtaggggtttcagccaagattcctgtctttagtactggaatatttgaattagagaaattaagaaagtgaaaaaggctaaagttcttgattcttaccttttatccttatagttaatgacttataaatatatttctttgggaaaataaagaatatcaattgactgtcacctcagttaatccctccagcctctgcgttttttcctctaggtgacctgtaagggcctgctcaataaagccagtgtgatgatgttagctttgttgcatcttttagttttcttctttactcatcccacacttcccatacatatcccgcttcccttccctggtgtgtttaaaggtaaaagaagtaaagaagtgggagaagagacagtgtgaaggaggtgcagaggcagacatgaaaaagtgtcaggaagaagtctgagtgtagcccttaaaagactattgctttctctagccactaccctattctgctttgttcctgttgcccctactttaatatttctaaaaggagtttaaaataaaaatgaaatccatttgaatttcagtcttgaacactcaaataaaagtgcttttctgaaaatctacaatgatgtttttaaaacaccttccttgatcactctgctgcattttatgcaaagatgagcatttccttctgaaaaaaggaaaagacttattgactaacttttgccacatgaaactgtataatcaacctcatttgaaagtgcacatttcatttgatggcatttgcaaattgttccttccccccaccaccagaacttgcaatgtgaaaatgcttccatatgctaaaagctagtctactaattttactgaaggagaagaaaagaaagtatggctagccattttctaaacatgaagctacagtgtgggcagatttggcaatgggagcccctcagagttcactgtaaacaactctgcaacccccaggcctcactactgttcaagatgagtgtagaaagttgtttttgccccacaaaagtaaatttttaaaaatgcaattgtaatgtgtatatagttttaaaatatctaaatgcagttaaaatatagtattaaactctgatttctaatagatttgaacattttaagtgaagaaatacttttgctttcagattctttgtgtatctcaagacattttaatagttttcaagacatttaaactgagtcttcactctgggtggtgggcccccaacccctaatgcgtggcttatagcaatagttttctccctgattttcctaatattagtcattctcccttttaacactgcgctacttggtgctactaggataatctttcataaataacattatgccttttcctgttgactgatctcatttaccctaatctcaccaatatttctcccaaatctgatttataattttctttaaggagtcttcgtagtaatcccatctggccccatttttcaacagtacttttgaaccaagcttctactattattattttcatgttgatttattaaagttttttaaaaaattgtattatgtctgttctttttttcccaagtagatatcagtgtgatggaaacactatcttctatatcttttgactggagtcttttatacttctgagtacatgatagatgttaaatatatactctgttaatacatattagcaagtttaaaatggtggctgtttgtttaagtcacataaattatcaaacaaaagagctgagtgatggtacctgcacaatgcttaatatatagtagagatgataaaataaattctactgaagtctgtacttcatctttttaaaaggtttattgcttagcttttagaattaatggttttatctttgaaatagagaaacaggtctagggttcatgcagttataaataaaaattccttaattttatttctattactgtagcatcttatgccaaaaaaaaaatatcgtaaagaggaagaagtggccaggcatggtggctcatgcctgtgataacagcactttgggaggccgaggcaggtggatcacctgagatcagaagtttgagatcagccttacccacatggcaaatccctgtctctactaaaagtacaaaaattagctgggcgtgctggcgggcgcctgtaatcccagttatgggaaggctgaggcaggagaatctcttggacccaggaggcagaagttgcagtgagccaagatcgcgccattgccctccagctgggcaacaagaacgaaactccgtcttaaaaaacaaaaaaaagtggaaaaaattagaggactaacattacctgattttaagacttataaagctagagcaatcaaggcagggtattggcataaagatagagaaacagatcagtgggaaagaatggagagtccagaaacagattcttatgtacatgggcaactaagttttcacaaaggtataaaggcaattcacgggtgaagggccaaactttttaacagatggtgctaaaacaattggatattcatgtgaaaaaattatttatatcacataccatataaaaactaactcaaaacagatcatagactaaaatgtaaaaactaaaactataaaactccttaaagaatacatagggagaaagtctttgttatcttgagataggaaaagatttcttctatatgcctccgaaagcacaacccataaaagaacaaattgataagttgaacatcatcaaaatttaaaatttctgctcttgaaaagagaatgagaaggcaagccacagatttgtggagatgatatttgcaaaacatattatgataaaggacttatattcaaaatatataaggaactctcaaaattcaataaaaaatcaaacaacccaacaacaacaaaaggtagacatcggatagagtatggtggattacatctgtaatcccagcactttgggaagccgaggtgagaggattgcctgagcccagaagttcgagaccataagcacatgaaaagcccaatgtcattaattgttagggaaatgaaaagtgtactgcaataccacatcaaatattacttccttttctataaatatgtacaattattatgtgtcaactaaaaataaaagaaaaaaataaaattaagaagactaaccatatgaaatgttggtgaatatgtggaggagctaagtcttataccctgcgggtgggaatgtaaaatggtataaccactttaaaaaatagtttggcagtttcttaaaatgttaaccatatacccaccgtactcttcagccatgtcagttagctttttacccaaaataattgaaagcatatgtccatgcaagggcttgtacataaatgtcatagcagccttatttataatagccaaaaatgaagtcacccgcatgtccatcaacaagtgaatggataaacaaactatagtatatccatataatggaatactatttacaataaaaatgaattaattattggtacatgtaacaacatggatggcacttaaaataatcatgctgagagaaataagtcagtcaaaaaagactgcgtgctgtttgatttcacttgtataatattctaaaaaatgaaaaataattcatactgatagcagatgggtggttacctagagatggggaatagaggaggagaaaggaattacaaagaggcacaaggaaacttcaggaggttaaagaagttttaactatcttaactgtgatgatagttttgcaggtatatacataattcaaaggttatccaattgtacactttatttatttatttatttttgagacagagtctcgcattgtcactcaggctataatgcagtggcgcagtctaggctcactgcagcctctgcctcccaggttcaagcaattctcctgcctcagcctcccaagtagctgggattacaggcacacaccaccatgcctggctgttttgtatttttagtagagacggggtttcaccatgttggccagactggtcttgaactcctgacctcaggtgattcacctgccttggcctcccaaagtgctgcgattacaggcataagccaccatgtctggccccaattgtacactttaaatatgtgcagctttttatagcttagcaaaattatacttcaatttaaaaaaagaaaaaattgtaaagaggtgttaaacatgcagttcaccattgaaagcaatattatttaacatatgcactagcatattataagtataataaatgtaaatataatttatgtatttataaacataaatataacaatgaacatatacattattgaagagtcccatatgtcaccttccatcttgggttttatagttactaaaatgttatcaaaggagaagaccatttcataaaggaaattattacaccttgaccatccaatacttcagtctttcattttgcgtggaagttctgtatcagctaccatagtcattttttaaaaataacagcaatcttcgttttttgaaaaactatcataggccatctcaatctttatctatcaatattttccttctttcactttcttgataaagccccatattttgcttctgcttctatgtttttttttaaaaccaaatgattactaaacagggagtgaaggtccaggtgtggtggcttatgcctttaatcccaggattaatctttgggaggctgaggcaggaagatcacttgagcccaggaatttgagaccagcccaggcaacatagtgagacacgaatatctacaaaaatttaaaaaattagccaggcatggtggcacgagcctgtagtctcagcactttggaggcacaggtgagaattgcttgagcccaggagtttgaggctgcagtgagctattaccacatcattgcactctagcctgggtgacggagggagaaagaccctgtctcttaatctgtagaaactgtctaatactattactactgtattagttaaatgactcatttacagcataatttgggaaaggaaattcttggattttatcccaagtgaggacttagaaccaagtgatatagtggttaaaataagagtctcagccaactagagggttagaattttcttggtatttaatgtattgtgcttaatttatcattatgtaagtaagctcaaatctcattggtctctttatataaaaaggaaaaaaaggaaaaagagcagaaaagataaagccccatattttgctgcttctgttttgctgctattgacataagaaggcctatgtagtcctatgtaggcctttttatgtcaatatcagtctgagtaaaagcaaataatgaatttatgctgaggtacaaatataccatttggacagttttatattaacatctgacaatgtacaaaagttatacaaatttgttagcattttctcactgcaaaatattatcaaattaggaaatagcagacactagggatggtttttactatatataatgatgtttaagaggtacttaaacttgatttaaaagctctgcagtgatttacctaagatgagcctgaagagctaatagtctagtttttgttttttaatttttatttgtagcaacaagcacattaaccatttgattttttttatattttgggagaaagttgtgaccatgtggcagtttggatttgaaataataatggcaaataagtggcctgtgctgaaaattgttaggcatatctctttatggaaaactactttggtgatataaaaccaccgaggtctatagttatataatttaggcaagcagaaaaatcagacagggctggttttttttttttctttctttcttttttttcttgacagtgtctccctctgttgccaggctggattgcagtggcgcgatcttggctcactgcaacctctgcctcccaggttcaagtgattctcctgcctcagcctcccgagtagctgggacaacaggggcgtgccaccacacccagctaatatttgtattgttagtagagacagggtttcaccatcttggccaggctggtctcgatctcttgacctcgtgatctgcctgcctctgcctcccaaagtgctgggattacaggtgtgagccaccatgcctggccagggctgggtttttattaaagatttagtttcgttcttagaagttatgtcaatttctgatgagtaatctagtaataacttaatctgtctttctgaattaattctgcaaaacactgccacatactgattgttgtaaacattgttggtttcaagacactttcttattttaaccctcctaacctttcaaagattcctcattacttatggtttaagtcattccttcttgttttttatattcaagacctttcacagttgatcactgagctgtcctttaatcctctgtgtcactgcttttcagtatgaattgctaaagtttctatgatttttctgtttctttgccttttgtcaatctttgttcagtctggactctctgcctttctctcatctctacctactcttctaagccctagaatgcttcaggtaccacataaaccacatcagcataaaaccttccatgacattctattcatacatgttgtaaatgcctcttttgtgccgagctgtcagtggtcaccaaggtaaggacaggagcaaaggatgctccgtggtactccactctgatggacgaggaaaaatgataaatttacaaatattttatctcatcctatatacattttactttttatttatgtcttataatgtaagcaataaattggtacccaaatagaaagtgtaaaataattaaaatacatatgttgagggagtgcatgcccaaaatgttttactgatggggtatagaacaaaaagttaagaaaccaccgatctaattgtcaggtctgtttccgcatttgtaaagttaggtcaaggattggactagataatttccaaggtcttttttaagcttaaatgttcatggagttaaaaaaattattttgaaatctttaagtatacagaagagttgccagtgtagtacagtcagctcccataagccattcatgtggttttatccactgttaacattttgccatatctcctccttgtcttctaatacatatatatacatattactatacttttgttctggaccatttgctagtaaattgcagaggttgcaaccctttaagctatgtagtttagtatgtgtcccttaagaacaaagacattccattataagatgttatgtaagagactcagcacaaaagaggcatatgtaacatgtaggaagagaataacagtaattgatcaagttcaatataccataatctaacatagagtccacattcaaattttgcctattgtccctttatgacctttatagcagttttttcactaatctaaggattgagggaataggaattttcttgccatgtctatttagtttcctttaatacagcagctttttagcttttccttgacttttgtgacacggacagctttgaaaagtaaaggcccaaccagaaacagtggctcatgcttgtagtcctagcactttgggaaaccaaggcggggtagatcgcttgcgttccagaccagcctgtgcaacatgatgaaaccacatctctacaaaaaaaaaaaaaattcaaaaattagcttggtgtggtggtgcgtccctgtagtcccagctacttgggaggctgaggcggcaggatggctggagctcaggaggcggaggttgtggtgagctgaggtcgtgccactgcactccagcctgggcagtagagccagaacttgtcttaaataaataaataataagaaagaaataaagaaaagtaaaggcccttaattttgtataatggctcatttgggtttgcataagtgtttccactgtaccttgatttgtgtgtgtgtgtgtgtgtgtagtttaattctgtgtgtgtatgtgcatttgggtgcacacaatgtgcacgtacgtgctatggtgctgtgtgcgcaagttgagtcctcttttccaaaatagattgtaaattccttatagacagagatgatttatcttggtaatttttattccccacacttctatgcacgtatgatacttagcctatgattcaaattaaaaatattcataagtcaaaagttcttacatatcccatgggttaaggagatgatttaaaacatacagggaagaacatatcagattaattaactctcagtgattaaggatgccagagaataccatggtaacaatagaagcattatgttttattttattgaatcttgaaggaaattggatactccaaagtataatataatatggaacatgcactgtgaatactgtactagttgacatgtgtaatttcttttcatcatttctctgtggaaaccctttgcaataacgtttgaccttttttccatatacagagtcccaaaatagtattttcatctgacatgtgtattttaatgggtagttagcacgaaagatctttgtcttttaaaaatatgtttctcaagattgggaatatcttcagttgtcagtaaaagatctcttattatccttttattatcaaataagcatagttgtaagacagtgactcatccaaagatttgttgtggctgcttctatctatggtttttttgtgagatggagtttcgctctgttgctcaggctggagttcagtggcgtgatctcgactcactacaacctctgcttcccaggttcaagtgattctcatgactcggcctcctgagtagctgtgactacaggcacacaccaccatgcccagctaatttttgtatttttagtagagatgggattttaccatgttggccaggctggtctcaaactcctgacctcgggtgatccacccaccttggcctcccagtgtgctgggtttacaggtgtgagccaccacgcctggcccccttcagtctattttttatttttgtgggtacatagtcagtgtatatatttatggggtacatggtatgttttgatacaggcatacagtgtgtaataatcacgtcatggagaatggggtatctatcccctcaagcatttatcctttgtattacaaacaatacaattacaatcttagttattttgaaatgtacaattaagttattattgagtatcgttaccctattttgctatcaagtagtaggtcttattcatttctaattattattatttttgtacccattaaccatttccacctcccgctaagtccccactacccttcccagcctctggtaaccaccattctactctctatgtccatgagttcaattgttttgattttaatggttagtacaagtaagaagtttttcattttaaagtcagcatctgaaaagatacattgtagcctttagaggctctgatttccttgaagcctgttacttatttgtaaaggtccatagtaagattgaacttactatttggaattttaaattggtagcttcaagaactcttagaagatctttttttttcctattttaatgaagaacatttaatatacaggttttcttagtattgactttcataagtattttctggggcaattactatctcagttgattatctctgaaggcctattttaactctacatttatctgaacttaactgaataactcctcattactcagcacatattttagtgaagagattcttaggagtaacggctgacattcaccatattgtggtttgtctgtgtgtatgttcctgtggataacttggcaatcgcttcctcagcgaaataacagccagtgtggttcagccaaagtttagaggaataaagtaactgaagtgggaggtttttctgtaatgccgagtgattttattcttggttctttctttttgaattgctcaggtagtgtttgccgtggtaggtattaaaaccaaaccaagcaaacaaacaaacagtaaaaacccaataacaaccaacaaacaggaaataccaggtaattcagattatctagttatgtgccatagtatgaacccaagaactcttcctgtaactccaaaataaatgtatgcttaggtcagaatctgagttagaaatgaaaaacaaggctaggtgcggtcgttcacgcctgtaatcccagcactttcggaggtcaaggcgagcggatcatgaggtcaggagttcgagaccagcctggccaacatagtgaaagcctgtctctactaaaaatacaaaaattagccgggtgtggtggcaggcgcctgtcatcccagctacttgggaggctgaggcaggagaattgcttgaacatggtaagcggaagttgcaatgagccaagattgcaccactgcactgcagcctaggcaacagaacaacactccatctcaaaaaataaagaaataaagaaataaataaataataataaaaaagaaatgaaaaacaacatcttgtctattttttccaggatcaggtgtaataggaaactggtgatgcactaagtttttcacagacatggcttgagaatattttctattttatatgcttgttaattttttaaaaataggattgtttgggagcttatttccactgcagcaggaagaggcactgtgattcactgaattgtgtgaattaaaggcatgatcaaggaacaggccattgaaaatgatggccctgcagtattaaaagtgctttgatcttctgttttgacacattgaatttatctttaattatatgtgatgacatttgattactatacacttagactattataatgtggtttgtaaaatatagtttgtaatgtataataacttcaacaccgatttttctgtagatatgaatttacagagtcatgttttagttttgtttaagagaaaactattagacttctgaattaacagacatttaaaaggtaaatatttagtagtcaggcaaagtatgattcctatacaataagtattaggactgtaccctgtgggactcagtgccttattttaatagaggtaatagaattctatgtggtggtttcctgatctatccactactggctgctttactacaggtaaatcacttagttctctgagcctttgaaaaatgaaagccttagactacatgatattcaagattttaattctgaaattctttgaatctattattctgtgacgtctttgatggacataatatagaattccatagaaattactgacacattttctaaaagaaagatatttttaaaatattgtgtgaattaatgggttttgaccttgcatttaaatatgaaaatgaggccgggcgcagtggctcatgcctgtaatcccagcactttgggaggccaaggcaggtggatcacctgaggtcgggagttcaagaccagctgaccaacatggagaaaccccatctctactaaaaatacaaaaaaattagctgggcgtggtggcacatgccagtaatcccagctactcaggaggctgaggcaggagaatcacttgaacctgggaggtggttgtggtgacccaagatcatgccattgcactccaggctgggcaacaagagcgaaactctgtctcaaaaaaaaaaaaaaaaaaaaaagaaagaaagaaaaaagaaaaactttaaaaatgcacttatgggacagtgggttggggggcaaccccccacaggccacaactgtagagagaactttcattcggaatttcctttattatgccagtaccttagccttgagggtgtgagtctttctttgaaattgtctgctttgcttgcatttacatgctcaaccctggatttttcccaatttaggcagttttattccccagcaatgagagtccttaagagtttgaacctgatcctaattctctaggggaaattacaaattattctttcttttcaaatggtagccatatacagtgattttacttttaacatcttttttttttttttttttttttgaggcagagtctcgttctgtcaccaggctggagtgcagtggcgcaatctcggctcactgcaacctctacctcctgtgttcaagctattctcctgcctcagcctcccaagtagctgggactacaggtgcacgccaccatgaccagctaattgtggtatttttagtagagatggggtttcaccatgttggccaggatggtcttgatctcttgacctcataatcctcccgcctcacctctgaaagtgctgggattacaggcgtaagccaccacgcctggccattaacatcatttaatcaattttgtcaatgtccctaatgggatagtcaggcaaaaacaaaccaacaaaattctgtaagaaaagtggctaattatacattatcattaggaagcataatatttcatgtgtttttatcctgaactttgtttctttttgccatacaacccgttccttactttgtagggaggacttttattgtaaaaaaaagatctgcctcacacaattattggttatgactatttatcacctaagaactaaacagtggtgctttgatttgagtttgtttactcgagaggcagagtatgttttatctgtaagtactttgggatttcttttgaactaaaaatatacaaatacaattattggttatgactatttattgcctaagaactaaacagtggggctttgatttgagtttgtttactaaagaggcatagtatgttttatctgtaagtactttgggattttttttaactaaaaatatacaaatatgtatagtttgtggtaagtaggtgacagcgtgaaaagcaaaactggaaagctatgatcctacagctacatatcaagctaccctttttttctcaaagactattgctgtgttaagattttattatagcatttgtttctttttagagagggtagaagggtgaagccttactcgaaaccatttcagagtagttaactccagactatatactaatggagaagaagagtaatacagataagttaaaacattagataatgattgctctttattgctttaaaaaaacatggggaagagcagttgggaataggacccaggcacttaaatctgggaaactcatttttggtctttttttcccactgctgcagtagcctgggcaggatccctagagacacagccttcaggcaggaagatggaggagagaaagcagatcacagaccctaaacatctgtaggttctctctctttcttgttccctacagctggtgaatctgaattgaatccttagtaaagtttcatattaggtgatttagtagatgctagttaaggaaaaatgatgatctctaagaattagcctgattttattaaaaaaactttgtggagattaacctaatttccttcttcttaggaaggctattagactgttgatcacagcagacaggggtctgaatttcatgaagttttttgacatggtccatcatgatatcactgtgggcagaatggatgagagggatatgatataaaaatacggttatgttgttatgcagctggctgaacagccatctgaaagagtgatatttaatggtctgtgttaacctggaaggagaactctgggataccataggaatctgtcttcaccttcattatatatatcaacaaagagttaaaagaaatatagctggcctactaattaaatttgtagataatatacagttgaggaaggatggcttaaattattgggtgatatagacaggagtcaaaattattgggtgatatagacagtctcaataaacataggagtgcagatatctctttgatatagacaggagtcaaaaaagctctaaaaatatcaggatgataggcttaaccagcaagataaaatttactgagaacaagtttataatataatatataatgctatgtattacagaatagaggagaaatggcttagatgtaggggtaggaaaaaaggcttaacgttcctaagttaacagaaaacttaatatgggcaactttgtcatgtttctttcaaaaaaatgcattgtgatcttaggaatgtctagaacattaatagaatgtctagaataagattagtagtagtcccgctttattctatgcatcggactattttgttctgattatcgcagtctgagagtgataagcttcaagcacatccagaagaaaatggctaaagtttttcacataacaaagctacaaaaagaagcctataaggagtcataatagctgtctcctgatatttgatgggcaaccctttggaaggaaggttagaatgagactgtgaagctccagaaggtaaagtgacaaccaattgttacatgaagatggattttgactccatataaagaatatttgtctggtccttaaagctgtctaaaaaatgaaatagactgtgctgggagttaagtagtgaattttccagggtgttgccaaactaccttaagggtatgtggtaatagaagaaatttattcatcagaaagggggtaaaactagttgatgtttagattcagtctactctttttggtggtgtgtttcctacttgtttataccaatttactctctgtcgtttggctaagaggcagagaatgtctttgaccataaattgataaacaggattcatctgtatatgttattatcaaaacatgcctgttacttttccaagaagctttattcttatctactcctaaaatatctttatgaagttaaaaggacttaacataagtatttagaaggaaaaatgttttttttttctaggaagcattatttatatttggcacttttttattagtgtcaaaaacaaggtgatcacactgcagctataagaagatagtgctatgaaatgaatatgtgcagatacatcagagtaaccaggttcattggtttgttcactcatttgttttttactcattcattaatttataaatattttttcggatacctggtaagtgctggtcgctctgctaggtactaggaagttgatatatactatagtttctctgaccatttacctaaaaatctgttaataggctccatttcttctaatcatccaagaaacatttttttaatttttaatttttgttggtacatagtagttctgtatatttatagagtacatgagatattttgatacagatacacaatgtgtaataatcacatcagggtaatcatgcttgagggtatggataccccatcttttagttattttaaaatgtacaaaaaattattgtaaactatactcaccctgttgtgctatttagccctatattttattaattctatctaattatatttttgtagccactaactatcccaccctccctccatcccgctacactccccagcctctggtcaccatcattctactctctatttccatgagttcaattattttaatttttagctcccacaaacaactgataacatgcgaagtttgtatttctgcgtctggcttacttcacttaacataatgaccaccagttccatttatgttgtcacaaatgacaggatctcattcttttttatggctgaatattactccgttttgtgtatataccacattttctttgtccattcatgtgttgatggacacttagggtgcttccaaatctcggctgttgtgactaggtctccaataaatatgggagtgcagatatctctttgatttactgatgtcctttttgtggatgtatacctagcagtgggattgccagatcatattgtaactctatttttagtggttttaggaccctccaaactgttctccatagtggtggtaataatttacattctgtcaacagtgtatgagggttctctagtaaacaattattactttgttttttgtgatgtaacctctaaagacaagtataaaagaaacactggaaaatactgatttttaacgctgtatgctagctattctaacaactatatgttaataacttaatatataactgttagtatatataataacagctgtattataactattaggtatccataaaaatatcatgcctttatgtactttaatattaatattgctttgaaactgaatgctgaggtagaatttgttttttcaggtttctgtttactgttaagagttttctatattttcttccttttccttttttggactgttgttaatttccatattgctttttgaaaggagaaataagatattgttaaggggcccaaaaatatacactaaccactgtttttttcaagaaaaaaaagccatttttttctcttagataaatattttttagctggttttaattttaatgtgcatcattgctaggtaggcaagaatgatcttgaaaaagaaagcttttgtaatattaagccaacaaagacattgcctgcaggataaatgaatagttgaacatattcactggttacatggtcaagttttatctttaacttattttaatataagatggttactatgtttcatattaagagtgtacccttttaacagtaccttataaataattcttaagcccaggtagggtgagttagaagtatctagttttacaattagaaatatgaaatgagaaatcagtgctcctttgtatgactaagctcaagcaggatttaaggcagggaggggtcaccactgattgatcttcaaatcttaccatgtctaagactgttgctgctgccatttgtctttctctggttttctaggattctttggcaaaatgttagctccttttcatcaatcttcccatctgcaactgatgattttctctagcatttcccataatcatctcaagattgcagagaaatagaagagatatttctacactcatgtttatagcagtgttagacacaataaccaaaaggtggaagcaacccaaatgtcatcagtagatgaatgaataaacaaaatgtggtgtataaatataattgaatattcagcttttaaaaggaaaaacattctgacacatatacaacacgatgaccttgaggatgttatgctaagtgaaataagccagtcacaaaaagactaataatgtatgattccatttatatgtggtacctagactgcttagcagattaagggatcttcaggatttggagtataagacacactcggccgggcatggttgctcacacctgtaatcccagcactttgggaggctgaggtgggcagatcataaggtcaagagatcgagaccatcttggccaacatggtgaagccccatctctattaaaaatataaaaattagctgggcgtggttggcacgcacctgtagtcccagctactcgggaggctgagacaggagaattgcttgaacctgggaggcagaggttgcagtgagccgagatcacgccactactccagtctggcaacagagcgagactccatctcaaaaacaacaacaacaacaacaacaacaacaacaaaaagaacacactcacaataggatataactaagtcatctactccacatgtccaaaactgggaacttaggatctttttctcacacatttatccttgctccttccatcccaagttagaaatatggatgtcaacccatactgcttttttcccccctctgaatactattggagaccaagccctgctgattttatattctttttttttttttttcttttgagacggagtctctctctgtcacccaggctggatggagtgcagtggcgcaatctcagctcactgcaagctccgcctcctgggttcatgccattctcctgcctcagccttccgagtagctgggactacaggcgcccgccaccacgcctggctaattttttgtatttttagtagagacgaggtttcaccgtgttaaccaggatggactcgatctcctgacctcgtgatccgcccgccttggcctcccaatgtgctgggattacaggcatgagccaccgcgcccggcctatattcttcatttttaaaaaatctgccttctctacattactggtacaatttattcattcaaggagtacttaattatatagtattccagatggtgtcagttctgtgaaaaaagaaaaagtagggtgggatgggagtttgggagtgtgggaggtggggagagagttgcaattttaaaaatggtggtaatggtggtccaggcttggtgcagtggttcatgcctgtaatcccagcactttgggaggccgaggtgggaggatcgcttgagcccaggagctcaagtccagcctggggaacaaagtgagacccggcctctacacaaaattaaaaaattagctgggtgtaatggtgtgcccctttggtcccagctacgtgggagcccgaggcaggaagattatttgagaccaggaggtcgaggctgcagtgagccaagatcatgacactgcactccagcctgtgttgacagagtgagattctttctcaaaaaataacaacaataataaataaataaataaataaataaataaataaataaataaaagatgttccataacggtgaaatctcagcaaaacctgaaggaagtaagccatgagaatatttggaaaaaaggcttgccagatagagagaacagtcagtgcaaaggctgcaagatgagagcatgcttggtgagttcaaggaactccaaggaagccaatagatctgaagtggagagagcaggaggaagagccatgggaaatgaggtcttagaggtaacaatggtctgcttatgtaggggttttgtgaggcactgaatggatggatgcattgggcagagaagagacacctaatttatatttttaagagatcactggctgctggttgatactaggttgtatgagcaagggatgaattagacaagctaggaggttgttggaatatttcaatcaagagaaggtagcttagacagagtggtcagtgacagtggaggcagtgagctgtggattctagaatttggaagatagagccagcatgagtttctaatagattagatgtaggatataagagaaagagttaagataaatctacgtttgtttgtttgttttttcctgtgtaagtgcattttacatcaacttagatgggaaggaaggctgtgggtagaacaggtttagaggggaagaacaggacttgttaactttgagatgtatgttaggtatctaagtggagttattgagtaggaagtcagatatatgagttcagaatttcattggaagttaatttgggagttgtatgaaaatacatagtatttgaaacaaaaaactagatacaatccccaagagaatgaatagacagagaaaaggaacaagaacttagcccagggcatttcaacattaagaaatatggattcaggcaaagtaggggaaaagagggaaccaacaaaggagactgagaagaagcaaccaatgagataagggatgaaatcaagagtatagtattctggaagccaagtgaatgaagagtatcaaggaggagagagtgatgcattattgccttagtttaggtcttagtcacagtcacgtcctaaattatgacagtttactttggtctttcggcctctagctgcctccaaccccttctctatacctcatctttttcctattgtctgtgatcaaaatgttctttaaaatgaacacagatggttttctttctatttatgctgtttgtcatttgttgagatgcttttacctgttttttgatattttgtcaaatatggtaaatttttggccattaatttttcacgtactgtcctgccctctcagcctacccatggtactgtatttacatgtaagttcaaccagttaatactgttccacagatcagcgaatctttgctaattttatttgtcttttttctttctgtgcctcagtgtggatattattgtgtgcttcaagttcattatctttctcgtgccaaatctgctattaatcccattattaatagtaatatggaaattgtgaatgtgatgctgatgaatgcagaactctattgtctttctgtaaagaatgttgagctttcttctaggaagtagtttgagtgaattgtggatcagtacaacccttttgacacttgttagagtttgtccagagttgtttttactctagggcagtggctctcaaagtgtggtacctggaccaacagtatcaatgtcaccttggagtgatgcttagcaatctgtgttttaatacatctctaagttattgtgatgtactcttaacttttaaccttttacccctttagaaaatataagtgcagcttactgccagtgcttttttaacgttacataaacatgggtctttgaggctgaagcaaatctgactgattttcaatgtggaaataaaatataaaaactgttcttagagttatttttaaactgaactaacatcagaatcacctgaatcatcagaatcgtctatttcggaaaaattagattcagccaataactgtttgagaactgtgttaacatcatgtgtaggaatgctatgttttctaggatttgacatttttggtgattgagaattactacattttgtaaatggatatatcactaccaaaaacagaatggtacaaatagaatgatgtattttgtttccaaagttgatatactagagcaatgtgaaagtaataattaaaatgagatattacatggcaaagttatctcagggtaaacgctgcagccgcaagtgccactggtgagtattctctgggcagatgggaaaaggatcaagaaccactactctggagctagttcagccttactactaggatgtaacccttctggagtctctgtgcagtgctctagatattcaatgaggtctctctcctttaccttgtcaaaatgtctcacagtcttatatgagtactgggaattatttagattaacattcatggtactttgtttgttcttatggaatttactctatgtatgtgcagcttaattttcagtcatagtctcaaggggaaccctgtgtagatttcctgagctcttctctgcatagctcttcctctttagcactctgccctgaagagtccatctctttcctcctctttaaactctgaactctgtcaccctaacttagtaagacctctgtactctgcttggggttatcattccttgtggtgcattccagaaagtgcttccagacagacatcagggcgaccttgttcattttccttttctcagggatcacagtcttaacactaacttttgtctgaggtgtgacagtaacttttttgtatatttttccagttttttcagtgtttacagtaggacagatctggtactagttattctgttatagctggaagtccaggtacttattttttatggtcatgaggctacatagaagctcattatatgaggaaaataaatgctgtactaatttcttcacatgatttcaggcagcactagagtgctatatgatacatattaggcactgtgctagcataggaggattaaaacccaaatgggatagtgcctttgtcttcaaagatctcatgacctacaagagtggactggtatataaacaacacattccaagtcagtttgtgataaaggcagcatgaaattatataaaggccatagactttgaaatcagataggctttggttaaatcccaactccatgacttactattgtattatgcaacctctcacatctttagttttccaactgcagaatggagataatagtacgttataggacttctgagaaggttaaattaaaattcttttataaagcacttgacttggcatatcatagaggttcattaagtattaggtttatttcccgttagaatacacataggatagaggagcagttaatttttattattactatagaaatcttcagggaggaaatgatatttaaattgtgccttgaaggtggagtagggttttgatatgtgttagatgggttccaaggacattctacttttaaggaactaaatgagcaagggctcaaaggtgtaaaacgtggggaaggctgtaaatacacttatgaatgtcagcatagtccagaaccttaggaaaagcaatttaggtcttaaaaacaaacaaacaaacaaaaagacaacaaaaaactagtagtaggaatgtaaaaatgaagaaaaaaagaacaaacagaaagtctaaccccatagtaaaagtatacttccttaggccattcctatttattgccatgactaataaatttgggaatgcctgtggaaaattcctgtgggctgatcttttcttaaccactattcaagactgctttacgttgatagtctaagccgatcatttcattaatattaaactccagagctcattcccgagtttccaagaatttgctgaattgcttttctctgttatctgcttctttgggtaacttccatatttttctttcttgccctgtaaaaattgatttcctaggttttccaagtgattgataatgtgacagtactataaagacttttcttagactctggtatgttcgcatttagtacaaatactgtcaagggttttataaagtgtataactaatatactttctacatatcttttactagggaattctaaacttaagtattttatttcattgaggttaaaatatgtcctgttaagattttttttctcttttaaattattagtgttttgcattgttaaaaatcagctggcttcttggattgagtttacttcacttttccagtgggtaacttttatctgacctttaggtctgtaattgtttggtttgttttctgaagctatggaatgttttggaaaaaataagcctcatggagaagggctattatccctgaaaatgatgagaccggaaatgagaaaagcaaaaatcagatatcacccttgaccatgtggatttcagtttttaaaaagtctttatcctctgtctctgagaaccattatttggaagtctgtttctctgcctctctgtgataagttctcaccaaagatcctcttgtgtttttattagaattacatcgaattcataaattggggagaatttatgtatttataatattgaatcttttcatttatgaaaatggtttatttctctatttaggtattctataatattatagacttttgtcctcaaagatcttacaaatcataatttggttagatttattcatgggtttttaatagtttttaaaaaatgggatctgtttttattatgtaatccaatcagttcttggatcagaaaattgatttttatatttaaagtccagcaaaactgctttgcatgcttattaaaatggcttgcaaactatcgtatattttctatggaatcatatatgcagtagcagtttttcttctattccaaacctcatacttctttattcttgaatagaagtgtcatagtgggattttttcttattcctgatttccggagactccaatatatcatttttcattttagaaagtttatttttcttgctatattggtggaagcttttttcttaagtgatgaatcaatgtaaaattttatacttttttattttggaaatttctagtttattagggtcctcttttaatggacaaggcagtagagactcaaaaaggtaatggagtttatttatttatttatttatttgattttcaacttttaagctcaggggtgcatgtgcaggatgtgcaggtttgttgcataggcaaatgtatgccatggtggtttgctgcatagatcatctcattacctaggtattaagcccagcatctgttagctattcttcctgatgctctccctcttcccatcccccaccatccaaggccccactatgtattgttcccctccatgtgtccctgtgttctcatcatccagctcctacttacaagcgagaacatgtggcgtttggttttctgttcctacattagtttgccgaggataatggcctccagttccatccgtgtccctgcaaaggacatggtctcaatttttttatggctgcatagtattccatggtgtatacgtaccacattttcttaatccagtctatcactgatggacatttaggttgattccatgtctttgctattgtgtatagtggtgcagtgatcatatgtatgtatgtatctttataacagaatgatttatattcctttgggtatataagcagtaatgggattgctgggtcaaatggtatttctgcctctaggtctttgaggaatcgccatactgtgttctacaatggctgaactaatttacactcccaccaacagtgtaaaagtgttcctttttctctgcaaccttgccagcatctgttgttttttgactttttaataatagtcattctgactgatgtgagccattgtggttttgatttgcatttctccaatgatcaatgatgtggagctttttgttatatatttgttagctgcatgtatatcttcttttgagaagtgtctgttcatgtcctttgcctactttttaatgtttttttttccttgtaaatttgtttaagttccttgtagatgctggatgttagacctttgtcagacagatatattgcaaaaattttctgccattctgttagaaactataatcagcttgatgatagtttcttttgctgtgcagaagctcttcaattagatctcatttgtcaagttttgcttttgttgcaattgcttttggcatcttcatcatgaaatctttgcctgtgcctatctgctgaatggtattgccaagattttcttcttgggtttttatagtcagggttttacatttaagtctttaattaatctcgagttgatttttgtatatggtgtaaggaaggagtccagtttcaattttctgcatgtggctagccagttctcccagcaccacctattaaatagggactccttttcccattgcttgtttttgtcagatttcttgaagatcagatggttataggtgtgtggtcttattcctgggttctctattctgttccattggtctatatgtctgttcttgtaccagtaccatgctgttttagttactgttgccttataatatagtttgaagtcaggtagtgtgatgtctctagctttgttctttttgcttaggattgtcttgggtattcaggctcttttttggttccatatgaatttttaaatagtgttttctaattctgtgaaggatgtcaatggtagtttaacgggaacagcattgaatctgtaaattgctttggacagtatggtcatttacatgatattgattcttcctatccatgagcatgggatatgtttccatttgtttgtgtcatctgtgatttctttgagcagtgctttatagttctccttgaagaggtccttcacttcccttgttagcctgggtattttattttctttgtagcaattgtgaatgggagttcattcatgatttggctcttggattgcctgtttgtgtataggaatactagcaatttttgcacattgatttttatatcctgagactttgctgaagttgcttatcagcgtaagaagcttttgggttgagaggatggtgttttctaggtataggatcatgccatttgcaaacaaagatagtttgacttcctctcttcctattcgaatatcctttatttctttctcttgcctgtttccctggccagaacttccagtactacattgaataggaaaggtgagagagggcatccttgtcttgtggcagttttcaaggggaatgcttccagcttttgcccattcagtatgatattggctgtgggtttgtcatacatggcttttattattttgaggtatgtttcttcaatacctagtttattgagagtttaaacatgaaaggatgttgaattttattgaaggccttttctgcatctgttgagataatcgtggtttttttctagttctatttatgtgatgaattacatttattgatttgcatatgttgaaccaactttgcatcccacggatgaagcctacttgattgtggtggataaactttttgatgtgctgctggattgagtttgccagtaaaattttgtaatttttaatatctactaagataaatcatatggcttttttatcccattaatgtggtagattatgttaatggcttttgtagtgttaaatcatccttgcattgccaaataaactatacttagttatttaaaaagaatatattgctgtaatcccagcactttgggaggccgaggtgggcggatcacaaggtctggagatcaagaccatcctggctgacacggtgaaaccctgtctctactaaaaatacaaaaagaaattagccaggtgtggtggcgggtgcctgtagtcccagctactcgggacgctgaggcaggagaacggcgtgaacccgggaggtggaggttgcagtgagctgagatcgcgccactgcactccagcctgggcaacacagcaagactccgtctcaaaaaaaaaaaaaaaaaaaaaaagaatatattggtggatttttttgttactattttgtttaagaattccttgtagtttttgtttgtagtaccgatttttctttctagattatagaagaagctcagcagctttcttcattttctattctctggaaaaatttttataacataggattttctcatcatgaagatatggtaaaacttatttccacatcctccatacttgatggagtttctaagtaggagggcttttaaaaataatttataaattgaaatataatgtatttatgggaaaattgcacaaatgataaatgtagctgtagctcaatgaattttcacaaactgaacaatctcatgtaaccagaatccagatgaagaaacaaaaaattaccaatgtcccagaagcccccactgtgtgccctttcagccactgccttttctgagggtgaccacctactccagtttctaaactgtgtattttaggggggtttggttcgtttttgaactgtatacagatgaaattatacagaatgctttttttttggtatatggcctttttcactctgtagtgtatttgtgagattcatcatgttgtattgtgtagttgtggttcattctgtttgctgtgcagtatactattttgtgattattcatacaatagaacatattacatatttatgtatccattctaccattctactgtgtgtgtgtgtgtttttttttttttttttttttttttttgagacagtgtctctctctgttgcccaggctggagtgcaatggcagatctcagctcactgcaacctccgcatcccacgttcaaacaattctcctgcctcaggctcctgggcagctgggattacaggtgcatgccaccacgcccagctaatttttgtatttttaattgaggtggggtttcaccatgttagtcaggctgatctcgaactcctgacttcatgatctgcctgcctcgacctcccaaagtgctgggattacaggcgtgagccaccatgcctggcccattctactgataatggagttttgcatgccttctagttttagcctagtgtaaatagggctgctatggacattttggtggacttatttgcacatttctttcaacctaggagttgaattattgggtcatcagttatgcatgtatttagcttagtgatgttgccaaacagttaagttgttgaactaatttatattcttaccagcagtgttggagtactggttgctgcacattcttgttgggcttcgtatttaactactatattttagctactctagtgggtatattgaataacatgtagtatgctgttaacttgcctttctttgatgattaagcacattaaacacttttttcatatacttattggttatttgtataattttggtgaagtgatgtattgcttctcgacatgctataaagaaatacctaatactgggtaatttataaagaaaagaagtttaactggcttatggttccataggctgtacaggaagcataacggcttctggggaggcctcaagaaactttgaatcatggcaaaagacaaaggggaagcaggtgcatcttacatggcaggtggaagagagagaggagggatgtgctctacacttttagcaggaggaagagagagaggaaggaggtgataacacttttaaacaaccaggtgtcgtgagaactctatgaggagaacagcaccaaagtgatggtgctaaaccatttatgaaggatccacctccatgattcaaacaccttccaccaggccccacctccaacattggggattatacttgaacgtaagatttgggtgggacacagatccaaaccataccaagtgcctactcaagtttttgtccatttgagttgtctgcctttttcttaatgacatgcagaagttctttatatattataaataccaattctttgttgattttatgtactacaactagcttctctatgggtatatttttattagttactcagtttttaaatagttatccaaactttctatttccttttgagatctttttaataacatttttccagaaagttgttgatttatcttaatttttaaacctactgataaaaagttgtttaatctatttttggtatcctttcaattattctagaaaattattagttgctatcgctttaaatattgcatatacaagtatatatgaggatgtgtgtgtatttttaatataactggtagcatactttacatactgttttgtaccttattttcttcacttaatatttcttggaaatccttgcatttcattatataaggagtgcatcatttaaaaaatactttcatagtatttaataatattatgtgataatatatttacccaattttttattgataggaatttgaattactgctagtcttttgctgtaccaagcaaagctgaaattaggataaatacataaagtggaatttctggtcttataaactcctgggctgatgatagagtattaacttttatgtttatgttccatttttaatgttttaagtcttttagaaattgagatataaatgacatgcaataaaattcaccattttaaagtgtacagttcagtggtttttactttattcatggagttgtgcgatcactaccagtatataactccagaacattttcatcatcccagaaaaaacccttagtagtcactccagattcctgctttcccccagctcctggcaccctctaatctattagttttctgtcactgtgtattcgtctattctggacctttcatataaatatagctatacaaatgtgatcttttgtgcttggtttcttttacttagtataatgttttcaaggctcatctatattacaacatgtatttatgcttattttcttttatgtatggtcaaataatatttcagtgtatggatataccacattttatttgatggttatttgactcagttttactttttgtctattatcaatagtgctgctatgaatacttgtatctacgttttgtttggacatgtgcttttaattctcttgactctatatctgggagtagaattgctgggttctatagtaatcctatgtttaactatttgaggaactgccgaactgtttttctcagtagctgcaccattagcactgtgtgaggttccaatttcttcacacttttatcaacgctttttattttccttacaaattaaaaaaaaaattatacctgctattctaacgagtatgaagtggtatatcatggttttgattttcattttcctaatgtctaatgatgttgagcagattttcatgtgctgattggatatttacatctcttctttggcaaactgtcttttcagagcctttgcctcttgtttaattgggtaatttgtctttttattgttgagttgtaagagttctttatagagatacttatattatgtgtgttgataaagggcaaatatctccatatgaagtgttcctttatgttaatgagagtaaaaatgctaacttccaaatagaaaaatggccaaataatacaaaaaggaattcacagggaagaaaaacaagtagctaatagtaaaaaaataaagaaaaagcaaattacattactgaaataaatgcaaattggaatgatgacttttttgcgtattatatttttaaaaatatgattttttttgtgggtgagtatggggtgaaactctcaggtaacataggaaatgtaaattgattacctttgtagaggatatttggcaacattataaaattatatagaatatgtctatataatttgaatcagtagttttacttcttggaattttttctgagaaaataatcattattttgcatatagattacatacagtgatactcatgccagtatcatctttaatggcataaatttataatcagcaagaggatggttaattacatatagtacaatattttaccattgttaaaatttatattttaaaatatagacaaattgatcttcatataatgttaatgttaagtgaaaagtagtaagatacaaagctgtgtaaaatgtatgataacaattcataaaaagcaacattcacccacacaaaaacctccaccaccacacacacacagaaataagagtgaaaataaacattccatcatattgacagtgattaccttcgggcggtgtaattaaggttgatatttattttctcctttatgtagttctgaatttcccagatttttaagattaaatatgtattgctctctaactagggaaagaagtaaaataattataaataagatagattaaatggattattatggtgcagtgagaccttttcccattggccctgggattttcttcctttggtttatgagtttaaagtgttgacagttgtgaactagtttgctaagtgataggaagcagtgttgaaatgaaatactttaaatcctgaagatttatgaggaagaaaatacttgggcaaatagtgtcaatgagtcctgatacgtattgctaacttgtcactagttcactttacatctgtgtagtgataactttgttttttcctccctcattgattatagtctctcatcccaccatttgccaaggccgtgtaaatagtttgctgtcgtagagatacgcagcaggcccatttgagtagttctctttcactctgatctccttagaaacctatcacttttacctttaaatgatacatttttaaaaaactattgttgttgttgaatgggatttccctaaataagaagagccatctccctagtttcaggattgtggcttctttaattgtaatggagttttaatattatatctacggtggaaatcagagtcaattcaatcttattttgcatcccctgtatgctatcatactgattaggggtgtaacaaagaatggactgtgatttttgccattttgtggttttcactggagattttatagtacagagggagagaatggcatagtaaataaaagaatgagcttagaagtgagactttgtgggtttaaatacctgctctctaatttatcagtttgtatttaacttctcaatatccttatctgtaaagtagaaataacagcactatcattcatcactttctatttccttatctttttgccttttcttcatggaagttttcacttccaagacattatgtttttcttcatttatttacagtaatgtaaaatcctggaatacatgtacctttttggttcactcatgtatttttagtgtctagtgtagggtttgctacataatagctcctaatattcgttccttctactgggaacttcttccaacatgaatatccatatagcttatccccatgctttatttagttccctgctcaagcatcacctcactagagagaacttgctagacgacctcttctataaaatagcaccctttagttttctctattttttcctgctttatttttcttcataatactttactgactgctaagtagtaacatcaatttatttttatattttcgagtgccttgcaaaaattagggtcttcataaatgtttgtttaactgaaattaattatcttagactattctatcttattctcatatgtaataaattaccagcttgtgactgtttatttctaggctccttcaacctattcatttgtttctatgcttatttccacttcttttttcactacactaattcagttaactgccacctgttttgtgaacaattgagtagtttctcaattttgttttgttttcctccagttcctcaacctgcacaaaacatctagcttactgctcttcaaatatgctattatcatttcattctttttcaatggcttcccataatccattgaattaaatgatattcaaatctctttatatctaattggaacctacctttccatagcactaaggagagttgtaaggaggtgagtacttggtgtaaaaattgcttatagatgtagttagcttgctatgagattaaaatgatttttaaagtacagagaaaaataagaaataactttaatgcaagtcaatatataatcaactgattatacgtgatttagtccacagatttatagaaattcagataaaaagatcattgaaaccttggctcatcagagagagcttcattagaaaaactgatagttgtttggggtcctgtatcatttattcattttatttattcagacccaatttctccctgtttttctaatacaaatatataagattttagagtaatggattctgttttgttaatataaaaatatttcttgtgtcagaagaattcagatgcttatagatattcttgtaaaatgttattatttttaatgagattgggtcttattccattactttgaaaatgtatacaactgagctgtttcttctgatcagcttatactatggacacttagtttgaagtcatattggaataatttggagaaaggtagaatttagtagatattacagaatttaggtatctattgtaaaatttaggttttatatagggcatgacattttttaagcgaatttataataaatagggctttttcaattatacagtaatgtaggttccaaagtgctattttgtgggttttctgtgtgtttagctgttttgtctgtacttatatttgtatttgtattgtacaaaggatataagtttctttgtagtttggataatcttttggatgaaagaaaggtagtgagtcatacaaaatagtgaaaaaaatcagatattttgaaataatacttctaattttccaaggatttaccaaaatagaggatgttaatttttagtatgaatttttaatgattggattggttttctgatgactgttttaattagttctgcagggcatcccatttctatcaacatagtgtgtgcaacaccttatttaccagtaatcaactcatatctactctcagtctgtaaagaggggtgtatatgaacctttacttgttattttttacttacgtaaatttatttacttttacattcctggtcaaagtgaataaacattttttatacagatgagttcatttcctcactcccatatccattccagtttctaagagccttctgattaacaggctccccaaaatttttcccttccaatttaaatttaagtaattagctttttcctaatttggaaccttggttagaaaacacatttgtttgatttgtcattagtttgggcatcttacttcaaatgaggtcatgtagctttgagtttagatgatcacagaagtgttcactgagcagcatcttcgtagctttgaggaaacagaaaaacaacttttttctactttgattatgattctttttgacagttgctttaactacagttaggtactggctgtaccagttccagtttaaacaactggactctgaacctgtttttgttctgattaagaagtttatttatatgttcaggaatacagcggcacaacctgttaacagctgtaaatttgcttgattaagctgtgtgtagacaaatttactagagggaactgttccctaaaaattccagttcacttacatatgaagttagtctggctgtttctcaccagtttccatcatttcctgccaagaataataaacattttcttgcaaagcatcgacactaaaggttagaagtgttcagtgttttatcaatcacactgggctgtcatgaatctcaataaacaaacacagagatatctatgtggatgcctggagaagccgttagaccctagaaaaataatttctttcagacagtatcctagaccttttcaaagtagataaatgtcaattatgaagagacatttattgtaatggaaataatggattcttcggtctagattttcatttactgacctagttcagggaagcttgtacttttagtggataataataagctagagcaagaaagtgtgttttcttaatttcatataactgtagatgctattatgagtattataataaagatgggtttattaatttaaacttatagtattaacatttctctaccatggtctgtcaggcaaactgtggctcacgactggtgcacagcgtgttattgtagcactcacaagttaagaatgggtttatagttttaagtgattgtaacaaacataaaacaaagaattttatatatatatatctagagagagcgagagaggagagagagccctcaaagtctaaaatatttattatctggccctttaagataaagtttgccaaaccctggtctatattagtagtaatagtttactaccagcattcaaaacgtgccagcaacaaagcaggatgaaattatagtcttagtgttagggtattttatttcttatttagtgttaggatattttatttcttatttgcatgtggtatataaaataaaaatataacagtatccttatagggttattgggagcattaaatcataactttttgtggtgcttcttacacatggaggacaataactgttttgttagctgttgctgttgttatatgtcagatgcctgacagttgtttcaactttgttttatgtgtgtatcttctgtttattctctgctctatttgcattatgtttaattttgtaagtcttttaaaaatctttttgattttagttgcaatgcaaattttaaaagtatagcagttttattgttcccattcctgtggctgtgtaacagattaccccacaacttagtggcacaaagcaatcagttattatgctcacagattctgtgggtcaggaattcggacagggcacagcaggaatggcttctcttagttccacagtgtttgaggctggaacctcaaaggctaggcactataatcattcattcatttatatgtctggcagatgtcactggctgttggccccagttcctctccacatgggtctttccatgtgatgtctccaaatgaactagtttgggcttccttaagtagagtgtctgggttcctcagagcaaacatttcaaaaagagaaagataggcagaagctatatccttcttatgacagagccttggaagtcacagaacattatttctattttgctctgttggccagaataattagaaatccccctaggttcaagaggagagaaatagactctaccatgtgatgggtggggttggcaagattctggaagagcatgctggaccagaaatacggctgaagccatttttggaaatatgatctgccacaatgatattactttatttaataattgcttatgtagcatttaatctatatgctagggactactgtaaatactaaacaaatattaattcatttaatccataacagtcttattttacagatgaggaaactaaatcagaatattgtattacgtagaatataactttctctgctcttgatggacaacaaataatttactatgattttaaaaacttgtctagtattatttaaacattaaatattttggatgcaaatttgcatttcctgcatgcatcatattagaatagacttgagaggtgcagtttctattaagtaatgtcttaaataagtacaaaggtcaggcatccaggagctcatccttccatattcttagaattgggatgtgataaataagtcagaattttttcatgaagcagtgcccagatgagtacatgttatcaaatattttatttgataataatgcaggactgactgaccaaacttgatttataaattagttccatgtccttttatgagaataaatacaatatcttggtcttgttgtgataatattacctaatggctatgttttccttcattggcattgaaatcagaactgatttttggtaaggttagtaatttgcgttatttttaaatctccattattatgaagatattttatcagggacaaagattgccttttctctctccctctccttttcttttctttctttttttttttttttcccattaacagttgatggaggaaggtaactttgtatgagttattgttggacatgcaagccctgtttttttacatttgttgattctgctttggagatttatcagtctctgagcaagttgctttgaagcatttcagtcttctttgtctctcagaacccattagtgctatcttcaggatgtgccagagtgacttttaccctggtacatttgtgacacagttacaccatatctcctactctctactcatcactgtatagcaagtacaagttaccagatagaagcatattcttgttggattatcaaaactcaggtggagtgtttaacatcttttttgaatatttaaatagtgtttttctttctaattggcaaattttgggtattctttaaaaacaatatttgattaggagatcatggagaaatttgtatggtcaaaacttgccaaatttgagactcacttatttgtttaaatttaaggatcagtaaaaataaataaataaataaataaataaatgtaggaatctaagatagagacctgtactattctgaatgtgaatgaactgattacattgattggaatacgtaatttaggagcattcattattactttttgacttggaaacaatataagaatgaatgcaaaaaaaaaaaaaaaaggagcatgtggattcattgctatcttgtttactgctcagtcacttatttgagagtgccaaaccctacccactagggccacccgggatgctttgtttatttgagagggggtgtggaggcatggtgaagggcaggagctccagagttaggctgactgggttttaaacccagccctcctgccatctgtgcaatcttggtccagttacttaaaacactctgtgattcagtctgcttttctgtaaaatggctgagttttctcattggtagaaatggcatctacttcatggtgttgtaaacattaaatgattaaatatatgtaaagtgcttaggatagtgcttagcacattataagctcataaatgtgcgctcctattcattaaatcattctttcattcacttattaaaagcatgacatttatttaacacctactatgatggggatacaaaggtgactactcaggagatatgaatattataatagggggaggcagaggtatattatagtcattacaacatacgatggtgtattagtctgttctcatgttgctaataaagacatacctaagactgggtaatttataaaggaaagaggtttaatggattcacagttccacatggctgggaggcttcataatcatggtggaaggcgaaggaggagcaaagtcatgtcttacatggccgcagagaagagggcgcgtacagaagaactgccctttataaaaccatcagatttcgggagacttattcactatcatgagaacagcatgggaaaaaacctgtccccgtgattcaattacctcccactgggtccctcccatgacacgtggggattatgggagctgcaattcaagatgagatttgggtggggacacagccaaaccatatcaggtggagagtgatataggttataaaacaaatatgtcaaagtgccatgaaaagaagaggacaaaatttttgatagccttaaacaatcgtttcacttttctctgacaccatttattcatttataaatgccttaccttttatggaacttttacagttcttcagcaggaaataatctctcctttattggcatccctatatcattttgccttatggcaattattattttctatctttcttttggcagctgttgatagtaatcattttgtatcttgttaaatcattatttgttcctatcttgtccattttacttgaagacagttcacagtcactcaacacagtacttatcaaaaatgcttcaaaaatatttactgagtgagtcaggtaacaaaacgattaaaatgcttagccatcagcgtatgcctctattttttaagggctttttataagcaaatacgggtagaaaaacattggcagtttgagagtaaaataaacatatataactcaccaactgactgatcaggataattatctgggagtctctgggggtaaaaagcccccagtttgttccattttacaactcccaccatggcctcagtcaggccaccaacatgatacaactagatgtggagtttggaagggtgtgcactggaacaccatcatatagtaatcctgccaactggatacaatagtgtaagcaaccccaagagcacagataatagtaaaatgtccaacatatttaacaaatgaggtgttttgagtatttattatctttgttttaatataatttttatttattggtacatttataacatttagctttaaatgatggctgtgtttaacaactggcttagaaaattcctgaaaatttagtagtcagctcttgtgaaagagtacaagccaactcacatacacttttacccaggctctgctgactgtgtaacttttgctagtaatttcactcctagaatctgtgctaaggaaattatctgtgaattggaaaaagcacaaagatgtttatcatagcattagtagtaacagcaaaaagttggaagcaacctaattgtttaaagtgagctgtggttaagtaaattcactggaatgttttctggaattaagtgacttctttgaagactttataacaacaagggaaaatgccataaagttaaatgaaaaagaaaaaagaaagaatgctaaatatctaatttatatagaatgatcaaaatttaaaaatatagacatatgctaatggaagaaggaaatgtcagtgtttggagctaataaggacatggctttttttctttaaccctttcttcattttccaaatttctaataatgagtatattttataattataatgaaaagatatatcatttttgtcacaaaaccaaattctaatttatagctctagttttttgttgaattacaaggcattatcaaaataaatcttttttattttattttttttgagatggaatctcattctgttacccaggctggaatgcagtggagtgatctcagctcactgcatcctccacctcctaggttcaagttattcttctgcctcagcctcctgactagctggaactacaggcacgtgccaccatacccggctaaatttttgtattttagtagagacaaggtttcaccgtgttgcctagggtggtcttgaactccggagctcaggcagcctgcccaccttggcctcccaaagtgctaggattacaggcgtgagccaccacacccagcctatcttttttatcttagaaatttaatattttcctctaacaaccaatagagcatataccaattgaatttgttttttagagatcaatgctgagttcattttgcccctagattttatttacagtctatcatagattttcatggaggattttaaagtttgaatttttcaaaagtatcctacattacaaaataaattttaggccaggcatggtggctcatgcctgtaatctcagcactttgggaggccaaggcaggcagatcacgaggtcaagagattgagaccatcctggccaacttggtgaaaccccatctctactaaaaatataaaaattagctgagtgtggtggcacgcacctgtagtcccagctactcgggacgctgaggcaggagaatgacttgaacccgggaggcggagattgcagtgagctgagatcgtgtcactgtactccagcctagtgacagagcaagactccgtctcgaataaataaataaataaataaataaataaattttaactgcagaattacctatttaaaaagctgcttagtagttaagtagctgattgtccctttaaaacaattgatagttatattgttctaaaattgagtctgggtctgtgtgtcccacattcgtgtctaagctatgcattgttaaaattttatttgaccatttatagcttgtctcactttgtgaaggaatttttcagaccttttcaaaatacatttaaatataagcagataatctaattttacacacttcctgtcccctttttaatcagtaattggttaacttcaatagacaatttagacaagctaagcttctgtgtaatttttctccctaaagattaagatttgatgaaataaataatctgtagcgtaccttgtagaaggaaaatgctttcctaattactttttaaaggtactaatttaaatgtcacagcaagttctgttaaggttttacttctattttaaggttgtaatatctgttaccactctatttacttggtgtgggcgagtttcaacaaggattagattttttaaattaattctctatatttttatgggggagaaattgaagcattccattatattgtaggaattcccggaacttcttagtattccttttctaccttgttaaaccattaatttgtttctatcttattcattttacttgaagacttaaacatttctgtatcactgacagccactcaaacagtactcataaaaaatgtgtcataaacatgtactgagtcaagtagcaaaaccttttaaattattcagctttttatgtgtctggattttgagtcatagacttgtgtgtgccatggggtataatgaatgggtaatggactttggagtaaataagcctaagttcaaagtctgattcttccatttaccagctgtgaaaacttgggtaattattctttgggcctcagacgcatctctgaaatgaatataataatccctagcttgtggagttgctgagaggattagagataaaatatgtaatgttccttgcatatagtaagcattcaatacatggttagttattaggcattcagtaataattgagtggatgactgcttcagggaaaatttggtggctgatttactgaaacacccagtaaacatatatgaaaaaaaaaaacacaccaaaactgacttttagttagaacagtttagagaaactgagagtcagtttataaaggagccttgcaaggaaactgaaaaggtgaaatagacgggaacaaaacctacagagtaccgctgcagtggagaaaagaagtttcagaatgctagaatggtggcagtggcaaattctatagtgaattcaaacaagaaggtcaataattggtcatctctggatttggtcacctttgttatttcccaatttctgtatattctttttatgatcatggttgacaaaagtatagcgctgaacataagacatgctaggaaggaaaatgatttaggaggtacagttgattcttgaaaatcatgggtttaactgcatgggtccaattatatgtagatttttttcaagcaaatttccattgcaaatacagtatttatgagatgcaaaacctgcatgtatggagggctgacatttcatatatgtgagttccagagggtggactttggaacttgagtgtgtgtggattttggtatatgtggtgcaggagtggccctggatccaattcccagtatatgccaagggatgactgtgattttatcagttaagattaggatgactgcgtataacaaaaaaagagacatctatcttatttcttgttcgttcttaccgtattgccacattgtccaatatggctgctagagattcagccattgcatcagtattacagctggcaggaggagaaaagaccaaaaagaatgtgccccttccctgtaaggacatttctgggaagttacacattgcactttctctttggctaaaatttagttctatggccacagctaactgcaagaatgacaaccagaaatattgtcttttggctgagcatagtgtacccagctaagctttggggttcttatttttaggaagcagaggaaaattaccagatcataacaaggtgatgagcatggcctctaatcctgcttttcttttctttctttttctttaacggggtctcactatctcacctagactggagtacaatggtgcaatctcagctcactgcaacctctgtctcctgggctcaagcaatcctcccagctcagcctctcgagtagctgggaccacaggcacgtgccaccatgcctggctaattttttatatttttcgtagagcccagggtttcgctatttgcccaggctggtcttgaactcctgagctcaagcaatctgcccatctcagcctcccagaatgctaggattacaggtgtgagccattgcaccagcctctttgcttttttaatgttttaactctcagcgtcttttaaaaacatcacttaaagttactttaaaattacactagaaatacacttccttttagaaaaaattaggaaatatagaagactaaaaaataggaaaaaactacctaaaattgtccactattaacatttttggtgtatatctgttcagactttttctgttaatatgtaaatattcatattacttatatatatagagtttcagtttgggatgatgaaaaggttctgagatggatgttgttggttgcgcaagactgtgaatataggtaatgctactcaactgtacacttgaaaatggtttaaatggtaaattttatgtatactttactgcaatttaaaaaacattgattgtttacaaaaaggagatcaaactcaacatattattttctaatctgctttttagaggtaagagaatacctttccatgtaaaaatatatatgtttgcagcatgatttttgtggctgaatatttattttatcctttaggtgtaccaccttttattgacaagagtgttgaagcaaataaacaggagtgttagttctttccttgttaagtggattcacagagagctttgtgatgcatgagagaggacctggggaaataaccagatgatggaaactgaatacccccctgggaccttacactgtgtctgccttgttcaagtgactctctaaataaacagttttactgctctgaggacaatatagtacccttttgtttttttcacatataattattatttttagttcatctaaaagaatgtcccaactaagttaatgttctattagaggactcagggcaaaagagagggataaagggagaacattgcctcctgagaaatgatgccttcacacgaggatcagatgccagtgatggcagcaatgtctgcaatttcgatattgctaagccactctcaggaaggtttttcctgattggaggtctggctctcccgtgagatggtgtttctcttacagccagaatgtttgtcattttcccatatcttcactgtcacagggtcattgtccttctaagtcttccctgccacttttagaacgtcattttttcacctactataaaatactctgcctctttgttatatgggtaaacaaattgctacctagctaaactaagtgttatttcttttctgtgctgttattgacatttgtcccccaactcccttccactttactcttcatcttatttacaggcataccttggagatattgtgggttcagttccagactgctgcaataaagcagttatagcaataaagtgggcaacacaaaattttttgtttcctaatgcatataaaacttatgtttgcactgtacggtagtctactaagtgtatcatagcattatgtctaaaaaatgtacaagccttattttaaaaatatggttaaaaaatgttaacaatcatctgtgccttcaatgagttgtaatctttttgctggtggagggtcttgccttgatgttgatggcttctgactaaacaggctggtggttggtgaaagttgggtagctatggcaatttcttaaaataagacaacaatgaagtttgttgattgactcttgaatcagtttatttgcttggtaataagagtagtacccaataggtagtttttcaacctatactcctctccattcctcccacccctagtagtccacagtgtctattgttcccatgtttatgttcatgtgtagtcaatgtttagctcccatttataagtgagaacatgtattgtttggttttctgttcctgcattaatttgcttgggattatggcctccagctttctccatgttgctgcaaaggacatgattttattcttttacatggctgtgtagtatttcatggtatatatgtaccacattttctttatccgatccattattgatgggcacccagattgatactatgtctttgctattgtgaatatcctggtgatgaacatatgagtgcctgtgtctttttggtagaatgatttattttctttcaggtatatccccagtattgggatggatgggtcaaatggtagctctgttttaagttctttgagaaatagccatctgttgttttttgacttttagtaatagccattctgactggtgtgagatggtatctcattgcggttttgatttacatttttctgacttttagtgttgatgggcattttttcatgtttgttggctgcttgtctctcttttttttttcttccaactcttatttcaggttcaaggggtacatgtgcacgttcattacatgggtaaattgcatgttgtggggtttggtgtctagataattttgtcacctaggtaatcagcataatacctaataggcacattttcagtcctcacccttctcccaccctccaccctcaagtgggctctattgtctattttcttcgttatgtcctggtgtactcaatatttcacttgtacttatatgtgagaacttgtggtatttgggtttttgtttctgcattaatttgcttaggataatggtctctagctccatccatgttgctacaaaggacatgatctcattcttttttatggctgtttagtattctgtggtatatatgcaccccattttctttatccagtgcattgttgatgggcagctataataggttgattccatgtctttgctattgtgcatagtgctgcagtgaacatacatgtgcatttgtctttatggtagaatgatttatattcttttgggtatatacccagtaatgggattactgggccaattgacagctctgttgcaggttctttgagaaaccttcaaactactttctacaatggctgaactaatttgcagtcccaccagtggcgtataaacattcccttttctccacaatccacaatctcatgaacatctattattttttggtatgtcttctttttttttgagacagtctccctctgtcatccaggctggagtgaagtcctggctgactgcaacctccgcctcccaggttcaagcggttctcctgcctcgcctcctgagtagctgtgattacaggcgtgcgccatgaggcctggctaatttttgtatttttagtagagatggggtttcaccatgttgtccaggctggtcctgaactcctgacctcaagtgatctgcctgcctctgtctctcaaagtgccaggattactggtgtgaggcaccgcacctgacctgctttttggtatgtcttcttttgagaagtgtttgttcatgtcctttgcccattttttaatggggctgttttttgcttgttgaattgtttaaattccttatagattctggatattagacctctgctggatgcagagtttgtgaatactctctcccattccgtgggttttctgtttactctgttgatagtttcttttgctgtgtggaagttctttactttaattaggtcccacttgtcaatttttgttgttgttgttgcatttgcttttgggggcttagctaaaacttctttgcccaggttgatatcaagaaagttattttctgggttttcttctaagacgtttatagtttgaggtcttacacttaaatatttaatctaccctgagttaatttttgtatatggggaaaattaggagttcaatttcatttttctttatatggctagccagctatcccagcaccatttattgaatagggagttcttttcctattgcttgttgtcagtcttgtcaaagatcagatgattgaatgtgtggctttatttctgagttttctattctgctgtattgatctatgtgtttttataccagtaccatgctgttttggttactgtagccatatagtacagtttgaagtcaattagtgtaatgcttccagctttgttctttttgcttggtattgctttggctatttgggctctaaaattctatatgaattttagaatagttttttcctaattctttgaaaatgacattggtagtttgataggaatagcattgaatctgcagattgctttgggcagtgtgaccattttaattatattgattcttccaattcatgatcatggaataatgtttcttcatttatttgtgtcatctctgattttttcagcagtgttttgtagttgtccttatagagatctttcccctccttggtttgatgtattcttaggtattttatttactttgtggctattgtaaatgggattgtgttcttgatttgattctcagcctggatgttatggttgtatagaaatgctactgatttttatacattgattttttttaaaatcctgaaacttttctaaaactgtttattagccctaggaggcttttggcagagtcttcagggttttgtaggtatgaaatcatattgtcagtgaagagagatagtttgacttcttcttttcctatttggatgcctttttatttattttttatttttttgcctgattgctgtggctaggatttccagtagtatgttgaatagtagtggcgagattaggcacctttttcttgttccagttctcaaggggaattgtttcagctcatactcattcagtatgacattggctgtgggtttgtcatagcttttattattttgaagtatattcctttggtgcctactctgttgagggtttttttaatcacaaagggaagttggattttattgaaagctttttctgcatctattatgatcatattttttgcttttaattctgtttatgttgtgaatcacattgattgatttgcatatgttgagctagccttgcatctcaggaatgaagcctacttgatcatggtgtattaaatttttgatatgctgctggattcagtttgctagtattttgttgaggatttttacacctatgtttatcagggatattggcctgaagtttgctacgtttattatgtctctgctagattctggtatcaggtaatgctggcttcatagaatgagttatggaggagtccctcttcctcaattttctgaaatagttttagtaggattggtaccagttcttctttgtatgtctggtagaatttggctgtgaatccatctggtctaggctttttttttttttttttttttttggttggttggtagggtttttaaaattattattattactgatttaatttcagaactcagtattggtctactcagggtttcagtctcttcctgattcaatcttgggagactgtgtgtttccaggaatttatccactttctctagatcttctaattagtatgcatagagttgttcaaagtagtctctgaggatctttcgtttttctgtgggatcagttgtaatgccatctttgttatttgtttactaatttgatctctctcttttttgttaatttagctagcagtctatcagtcttgttgattctttcaaagaaccagctgttggttttattgatctttcgtatggatttttatgtctcaatttcattcagtttttctctaattttagttatttctttttttctgctagctttgagggtgtgttttttctgttagttgtaaagttagattgttaatttgagatatttctaacttcttgatgagggaatttcgtgttataagctttcctctcaatgctgttttagctgcatcctagaggtttttggaagttatgtttctattttcattattatcatttttttatttctgccttaattttgatgttcacccaggacttattcaggagcaagttgtgtaatttccatgtatttgtgtaattttgagagatcttgttggtgttgatttctgtttttattgcactgtggtccaagagtgtgcttgatatgattttgaattttttgaatttattgatacttgctttatgatcaaacatatggttgatcttagaatgtattccatgtggagatgagaagaatatatattctgtggttattgggtagagtgttctatagatgtctattaggtctaattggtctagtgtcgaatctaagtctagaatttctttattagttttctgcctcaatgatctttctaatgctgtcagtggggcattgaagtccccctctatttttgtttagctgtctgagtcttttcataggtcaagaagaacttgttttatgaatctcggtgctccagtgttgggtgggtatatatttaggatagttaagtcttcttgttgatgtgtaccctttatcattatgtaatgcccttctttgttcttctttgttattgttttgaagtctgttctgtctgatataagaatagtaactcctgcttgtttttattttccatttgcatgctagatctttctttatctctttacttggagcctgtggatttcattacatgtgaaatgaatctcttaacagcagacggttgagtcctgtttttatattcagcttcccactctgtgtcttttacatgggatgttcagctcatttacattcacggttagtattgatatgtgagattttgatcctgtcatcatattgttgcctggttttcatgtaagacttcattgtatagttgctttatagtgtatgtaggcgccatgcttaagggtgttttgtggtaacaggtgtcattctcttgattccatgtttagcactcccttataggcctcttataaggcttctctagttgaaatggattccctcagcctttgcttatctgagaaggattttatttttccttagtttatgaagcttagtttggtgggatatgaaattcttggttggaatttcttttctttaaggatgctgatagtaggtcttcactctcttctggcttgtaaggtttctgcttggaggttccctgctagcctgatagggttctgtctgtacatgacctgacccttctctctagctgcctttacaatttttgtcttttacattgactttggtgaatctgatgtctgtgtgcctcggggatggtaatcttgtatggtatctagctgagcttctctgtatttcttgaatttacatgtcaacgtgagattagggaaattttcgtggactgtatcctcaaaaatattttccaagttgcttactctctttttttctcactcaggaatgccagtgagtcatagatttgatctctttacatgcgctcatatttcttgaatattttgttcattttttaaaattcttttttcttggtgtctgactgagttgattcaaagaactggtcttcgagttctgggattctttcctcagtgtggtctgttccactgttaatacttccaattattccaattatgaaattcttgtagtgaatttttcagctctagaatttcagtttggttctttctgaaaatggctattttgtctttcagctcttggatcattttactggattccttggttgaggtttcaactttctgctgaatctagatgagcttccttgccatctagattctgaattttatatctgtcatttcagactggttaagaaccattgttggggagctagaggactcatttgtagttaagtggacactctggctttttgaactgccagaattcttgcactgattttttttctcatctgggaagtttggtgtttctttatctgtgatgcaggttgagtatagtcagttggcgtcatttctgggtattttcagagggtcaggactctgtacagggtctttgtggctgaattcttgcccctggtttcatggagttaggggggcatattaccaaaatatttttggtggtgtacttcaggctgtgatctggtagatggcacttaagagtaatgatcagtagctaggcttttattcatctgtgtgtcttctttgtatttcctcatgttgcagtcatgccctctgtcaccagtacgttggggagagagatgacctttccaccaggtttgcttctgggccttgggggagccccctctgatcactgttaccatgcctgcctttcttttgctaggtgttctgggccatgaggctctcttgggcagaaaccatggcagggagataggccacaccctttctatattgaccttgcagagggatgcatgccctgcttttatgccaacccagaaacccacacatctcaccccctcagtgctctgtgagtatgggctcctcctctgctccagtgccagccacataactcgacttggcactcccgagctgtccaccacagccctggggtgccgggactaacttggggctcatctgctggaccctcagagttgggttttggatattttgggggatctgaagtgctcccaggctgctggaaatgtactcaagaggagcagagcatccaggctggacaggagaggctgcactgcacacatgctcttgcagtggggggtcagggaggggccctggaaggagatggcaggcaagtggtcctgtagcacagatgtgcccccatgctggccctactttctcctgcctcagcggtcagctgggttagagcttcttggagggagatggggagccctgggagatgggtgtctatggctgtgctctgctggcctctcccacgcacagaggtccttggctccatgctggctgaagccctgattctgtctactccctgggcatatccctttgccagctcaaatatccatggtggatgtgggttcccctgtagctaggattccagaggtccacagtgatagtgtgcagtcccacagtctcttcattaaccctctcccgtggagctgttcagggctgggaagtagccctaggctttgggtagctcacacagggttcccagcttcctgtctcatcagtctcagtatctctgtcacatctccatctactttcagtgtttcttctctgaagatccgttcaaattgtgttggtttacttgaaattttggtctctcttgtggggagcagtgcttcttggcttcatctagtcagccatcttgtcctttttcaaactttttttaaaatttgggtcagtcctctgaaaccctgccactgctttatcagctaagtttatggaatattctaaatcttttgttgtcatttcaacagtgttcacagcttcttcgccaggagtagtttccatctcaagaaaaaaagtgttatccataagatagatccataactctttttggtaatccataagaaataaatgcttttctctcttttgttcaagttttatggtgagattgcaacaattcaatcgtatcttcaggctctacttctcattctagttcttttgctgtttttcccgcatctgcagttacttccttcactggagtcttaaactcctcaaagtaatgcatgacagctggaatcttcttcactcctgtgcatgttgctattttgaccttttccagcgaatcaggaatgttctgaatagcatctagaatggtgaatccttcccagaaagttttcaatttgctgtacccagatccatcagacgaatccgtatctgtggcacttacagcctcttgaattgtgtttcttaagtaataagacttgaaagttgaaattaatcctcgatctatgggctacagaatgggtcttgtgttagcagtcatgaaactgctattaatcccctggtacatctctattagagctcttggttgactgggtacattgtcaataagcaatactattttgaaatgaatctttcttctgagcagtaagtctcaacactggacttaaaatattcagtgaaccacactgtaaccagaggtgctgtgatctaggttttgttgttctatttccagtgcacaggcagagtagattagcataattcttaggagcctcggatttttggaatgacaaatgagcattggtttcaacttaaagtcaccagctgcattagcccattttaaaaaaagtcagcctgtcttttgtagctttgtagccaggcactgacttttcctctcaagctatgaaaatctgagatggcatcttcttccaatagaaggctgttttgtttgcatgaaaactctgttgtttagtgtagccaccttcattaatgatcttatctagattttctggataactttctgccggttttatatcagtacttcctgcttcaccttgcacttctataatatgttatggaatggaacggcttctttccttaaacctcatgaagcaacctttgctagctccctacatttcttctgcagcttcctcacctctctcagccttcatagaattgaagacagttatggacttgctctgaattaggctttggtttaaggtagtgttgtggctggtttcatcctctgtcagatcaccaaaactctccatatcagcaatacggctgtttcactttgtattatttatttgttcactggagtagcagatttaatttcccttaagaacttttcatttgcattcacagcttggctaactgtttggtgcaggaagcctagctttcagcctatcttggcttccaacatactttcctcactaagcttaatttaaagtaagagacatgcaactcttcctttaacgtgaacacctagaggccactgtagggttattaattggcctgatttcaatattgttgtgtctcaaggaataggaaggcctgaagagagggagagagatgaaggggaatggccagtttgtaaagcagtcagaactcgcacaacatttatcaattaagtttactgtcttataaggtgtgtttgatagtgcccctgaacaattacaagattacatctgtattagtccattttcacactgctgataaagacatacctgagactgggcagtttacaaaagaaagaggtttattggacttacagttccatgtggctggggaagcctcacaatcatggtggaaggcaaggaggagcaagtcatgtcttacatggatggcaggcaggcaaaaagagaacggggatcaagtgaaatgggtttccccttatcaaaccatcagatcttattcactaccatgagaacagtataggagaaaccaccctcatgattcaattatttccacctggccctgcccttgatacctggggatgattacaattcaaggtgagatttgggtggggacacagagccaaaccatatcaacatcaaagatcactgatcttaaatcaccataacagataaaacaatgaaaaatttgaaatattgtgaaaattaccagaatgtaacaaaaacacatgaagttggaaacatggtgccagtagagttgctcagttcagtgttgccacaaaccttcaatttgttaaaataccagagaggctggggtgggaagatcgcttgaggttaggagtttaagaccagcctgagcaacatgaagaaaccctggtgtctttaaaaaaaaaattgttcaatgaatcaatgaatgaacggcagtttcagatattttccactcttctcaaacatcttacatgtcatttctatcttgatcctcagcaaataactatttccaagtcaatggtaagaatagaaatctgagatggaaaatttcttcctcatttaccatcaaaactacaaatattctcccatgattattttcctctgttgcttctgctctgaatgatatgactttttttcttttcctaaaaccctaggttccatccacattcaccttagaaggattttgatttttctctgattctatctttctcccaaattctgtatgtagcctagtgattatgagcatggactttacaatcaggctttgtgtctgatttgactcaaatttgtgtctgttactatgaaatcttgggcaaattatgtatctctcagcctcagttttcttgtgtgttgaagataataatacctaggtcatggagttgtcgtgaagatcaaaagtgatatctttaaagtgctaagcatagcaggtacacagtaagcatgcaaaataaaggtccttgcattatttttacctccctttctagtggctcctaaccttattaagagtctcttgtcttaagaaattgttctactacttcagtatttagcactctctctctctcttcaccatcacagctattctccactttttatctcctatttattttggctctcacatcagcctggcttcccaagcatttcaaattttatttttaatcttatttcttttccacccctttctctccaaatttgctctgcttccaataagttcatctatcatggctcaaatcagaaaaatagcagatgcccttgttcttttgccctctctacatttaatcatcaaacagagttctgataattctgctgcctaaatagttcctaaatttttctacatctcttctttgggtgctaccatttcagtccaaggcactatcatctcacacagtattgtgacaatagccttctactattctcccctttgccacactattccatactccacactatagatagagtgataacaagaaatgttatttccctttataaacattctaatgagttttcttgctcttagggcagagctcttcttgatcaggtcttatttatctcttctttcagctctatcttataccactattaccctgtgcatgccctagctctgatgagtttctttcagtttcattcagatctcttatttcagcttttccacatagtgttcctctgctgccttcctgatccttcttggggatcattgctacttggcctctggtttcaacctaaactttacttccttgagtgaccttcgcttaggctaggtacttctgtggtctgttctttattaccgtatcatcatggtgctcatgacattttacagttccttatctccccccaagattccagaaggcaggagccatgtctttttcattctctaccacaatgcctggcctatagtagacacccattaaaattttgttaaatgttgttaaataattaaagcaagagaaaaatcatcctatataacatgttagggtttagaactacatatggtattcctgtatttaactttgaatatttctttaaacataagtaaatgtggaaaataataatgctgcttttcagcacatgctcttatttttctatcttcacacattccctaattttaaaatctctttatgtttgtttttattccagactacaaacatcaaatcttttttttttctatttggatgcttttaagtataaagtgtcacttaatatcagcacttctgccaactcttattcatttttccagctgtatttggacaacatttacatagataattttgtgaaattttcaactagaagttgagttgagataaatcatgcagttttcaattcagtgtatcctgaaagataacgaaactcactgagctgcctggttttccaacaagctacatagaaagcatgaggagggcagaaggctatggcttccactgttttgaccacttcacagcccttcccgcagactgcttggagatggctcaagtggaacctgttgataaattaatgatcctctttttcccagtcaccattgagccaaagtaggctatggggctgaatcatcccagacagggatgaatgaatgttctgaaaagctgaaacataaactgtcagttaagatgcattttcttcaagtttatttgtgacagatgatggaaggtagttgatattgactgagtttgattgtttcttaggaacaatcacagtcatttgattgttgttcctaagaaagtagtctttttaaaaaaacaaaatctgagatacaaatgaatcactatatgttaattttccttgcccttcttaggtgaccactgactatattttaccagttgttaatgtagctttgggggggattttgttcatttttttggtgcaccttggataaaaaataattggaaatatttctcattttgcaattactgacttttcatactactggaatacaggatttgtcagagttcttatctgacccagaatagattagacacgttttaagatcagtaagaatcatctgctttttttttttttggtggtggggtgggaacatggtcttgctctattacccaggttggagtgcagtggtacactcacagcttactgcagcctctacctcctgggctcaagcaatcctcctacttcaggctcctgagtagctgggactacaggtgcttgccaccatgcccagttaattttgtattttgtggagtcagagtctcactgtgtttccaaggctggtctcgaactcttgggctcaagtgatcctcatgccttggcctcccaaagtacaagtattgcaaatgtgagccattgtgcccagcctatttgtcttcttaagcctacaataagaatgttgaaaagatagtttatttatataaccccatttgatacaaaattcacatcaaatagagttaattaaataatggatgtcccttgttcatcatttcaggcagatacaaataccacttttagcaaaaaaggtaaatctcttgttttaagttacccagacgaagattatatagaaagttagggtaatgacattcccaaggcaaaagttcttcagggaaaaatagtaagccatttcagtttctcaatttctggagggcttatctgaagggattgggatgtctaatattgcaaattaggcaaattgtgcacatttatcaccatgcaccttggatttcaagcagaaataagaggaggatttgactgaagggaattaactttggtcttccaaacttaaatatataccagatgtgtactgtggaaggatcttcctggttacagtataacctctggttcttttggactcttgctaacttaatttacccagttcttttcccgtatagaaattagactgtggattgtttctgtggattatactcatggatttctgtggattatactcatggattttattgttttatcttatttacagattctgacttttttcttttctttctctttttaaaaataacttaagatgtttgtttggaagattggcaggatgttcgttttacagtgttcaaaaatgagttgtttgtgttttatgtatatgcccaaatactctgtgaaaacataaactgataaaaggaaaattaattcctatctttataaagtgaagaattgtttttttttaacaaattaacatatcctgagttacattcttgagtgagatatgagaatttaaacatataacatgaatacccccagttttgagtgctaatatgcaaggaaaggctttcctcattactgttttacaacttttatgctccataaggttgattctcagtgctagttctctttcagagagaagattcagtaaaaaacactgtataccagtccttaataacttaaatgcaaatactggcatatatccagaagctaaggttcaattaggtgtagttgtttcatcttacaaaattattttaccagcaagaaatcttggcagttatattgatgatttctcatgaaagaggcaaatgggacgataaagaggcctgaagactattttttaatactaattttctaattcctcatttttttaaatgtcagaagccaggccttagaaatcaagcacctgagttttcctctgattttctaatcattactgtggttattctagttgtctcttatctgttcggaagtcataatgtgtaatgatggcataagtgaatgttaaagaagtggaaatttgatatgatctagatggcagtttattggtttagtttcaaagacaattttacctggaaaataaataagaaagcttatcaagcttttccctgttatccgtggtttatctgttccttgtgtttcatcttgaccaccactggtcttccagaaatcgctaaaatctctcctgcctatgtcatttctttttccttacaagatcaaagcttttatgagcattatttattgtagcctcacaatattctagagagcaaagtagaggttatgtgtctccatctttatttttaaagccaagtgaggaacagataaatctcttcgctaacgttacaaaatgaagcagtggtagaggcagaaataaactcctgaggcagaaacatctcctaattctggcccttacgtctaagatgcagtagactgtttggcctttctctaaacaggcctttgacatttagggtatgtggaaagtatgtgctcccgtcagagtttcgctgtttagttattctttgcctgttaaagtaatgactagaagactggagaaagcagaaagaacatccaagtcttatttcagcctctgcgtttagtacatgtgagctttggacagagagtgcctttatttcctgggaattaacttttctctctttatacttagaaggaatttttctttggggcactgctgatattgagaatttgggggaaattattatttttttcattcaagttttatgtgtgaaaacatatattccaatactagaccacactgagaggatttggggagatgactgcaaagttttacattttaaaatgtaggtttagtgccttttttttaaacctgaaagtcattgcaaaaatcgattaaattttaaaattgacttaattcatcaatctatattgctataaagttttttaaaaactaacaacttgtttgccctatgacaaatatttttaaaaataattttcaactgtatttttatttcaatatttatcaccctgtggttattttattttatgattttagctgtttcacttttttttttctttagtatccataattgctgattgggaatttttaacacaagacaggaattgttaccctccctccccccctcccttccttccttccttcctccctcccttcctttatcctttctcctttctcctttccctcccctcccctcccctcccctaccctcccctaccctaccctccccccctccccccctcccctcccctcccctcccctcccctcccctctcctctcctcccctttcccctcccctcctctcctctcttcttttctttttttcctttctttgtcttgctctgtcaccaggttggggtgcagtggcacgctctcgctcactgcaacctccgcctcctgggttcaagcaattcttgtgcctcagcctcccgagtagctgggattacaggcacgtgccgccacacccagctaatttttatatttttagtagagacagggttttaccacgttggccaggatggtctcaatcttctgacctcgtgatctgcctgccttggcctcccaaagtgctggaattacaggtgtgagccaccgtgcctggctgcctctttctttttttaaagggctgcttttcatattgacctacatgactaaacctgagttataattcagaagaaacagttgaactattgtgtgccatcttgtcataaagcgcaggttagcacaaatgtcttgccaatgtcttaaatgttgcaatttttgtaaaatcttccgtgtgcctccaacatctccagttggtgaacagatctcactgtatttatccctgttgtgttcttccacatgtttgttttgcagcataataacacttgacagttgtaaatttttccgtatgttctgttttgtagagataaacaatgtactttctgtgtatttccctgagctttgaagacttaacttttgaaataaacaattccataggattttataggaggctttggtacgttattcacacaaactattctccttgaaagggaaggtagttgaatgttcatccttttgatataaactggttaactgaacttttccaagggatcaagcacaacttaactgcttttagctttgcaaccagggcaatgcagaccagaccagtgtttgaaagtctttaaaagtattatttgacatcataaatgaccattctgtggaataagctctctaattctctgagtggtttacttcagttagagggattagtgaattagctttggatttgcttataatttcctcttttatcttttacaaattaaaaagttggtatcggcatgtaatgatagcatctaaaacatttatgttgtggtggttgtatcatagaaaacattctttaggattcaattataagcagcctccttccattagcatgtcaagtttttctgagcagttttatttgtgaaaaatcagtacagatatttttattcatagcttgatatcctttttttttttcttactcaaatgaatatctgtttcctacctttctccctcaagatgcagtggtgcttttattatttgattttgtaaagcctgaagggcagaaatatttcttaagttttccattgttaactacaaacttggctatataaaatatacaaatcataatatctgtatggttatttttattgtcatttctttaacacacaaaatttatcacatttatgcaagaattttttaacttagaaaactcaaaattgatatgtaaattgggtggtagcaacaatgtgtgggatgtggtacgtggccaatgatgtgttggaggcagcccccaccagctcccaagatctagtgattaaattttcagaaattttgtgagccagttatcagtaaaaattaaactatataaacttacaattaaataaattatttaaaaacaaagataatactcaaaactcagtaattatgttttactacattttattatctatgctcttgaggttatttgtgtctcttgtatctgtattggaaatactatataatggtgtatactattgtatatctcttcacaacttcatgttcattaacatcatgttgatagcttcaaattagccatggtagaagtattaacaccatgaaaatcagcaaacacaaccaatcaggggctgatttattgttttgctgattgtctagacttaagaaagtgatggaaaaaatgttaataacacatattaaaaagtgtgttatatctggccgggtgcggtggctcatgctgtaatcccagcactttgggaggctgaggcaggcagatcacaaggtcaggagatcgagaaccatcctggccaacatggtgaaaccccatctgtactaaaaataaaaaatttgctgggtgtggtggcgcatgcctgtaatcccagctactcaggaggctgaggcaggagaatcgcttgaacctgagaggcgaaggttgctgtgagccattatggcgccactgcactccagcctggtgacagagcgagacttcattccaaaaaaaaaaaaaaaaaaaaagtgtgttatatatctataaccattatactatgaatagcaccaaaaacttgagaaaatattctttcaggacagtatttgaaaactattatctaattcattggagaagtggttcacgtcacagacaagtgaatgactgaagtttgggcatatgcctgtgtttaccttttatttattaactaaacaaacccatcagccttctacagcaaaattgtaagaatgagatgttgcttcaagtacatcagacattagatgctacatacatcaggaagccttttatagttctcttttgaaaactgtactactcataatatgctgtttcctactcacctatgaccctagacttcctgtttgctctaatggttgctgttaaaggtatgacaaattcagctgtaaagtgtttagttatccacatccatctctttgaccacaaattacctaagaatggtgttacactacttttgtgggaaaagagaaacatcataatactggatacataaaatcatagcttttcctttccttgggggaataattctgttatctacccactgttgggaggtagtttagattggttaatgtaagtatcaagggggaaaatggctgtattcaacagaatttgtttcccttaatcttatggatagcttcacaattcatgatagcatagttatgcaacatatatgaataaggatgaagatgagtatcatttgattaaagtatagcttctaagacttaaatgaccagaaagaattgaactgcgtttaaactctaccacacacctgctccttatagtaggataatctggtcaagcccttgacttcaaggagcttgctaaccctggtattaattgatgtttcccaaactttagtcaactgagtatcatcctcaccatatttgttctatctctgtaccgcttgtacttttatttactttgtaattttttaaattaactttttcttttaaacttagctttatcctaagtgataatactcatgaaatcttgggtttaaggtaatagttatgttttttctagtatctattaaaatattgcctaacaattacaattttagaaagacttttctttttaccaccaatggtatgtctattttgctttgggaactattgtgctagtgatgataatagctaggcattaagttaaattgtcttgtttgttcctcacatcaatgtgataagcgttgctctctctattcagtaaatgaagacaccaaaaaatcagagaagttcaacaacttgtccaggtcatgaggcaagccagaacttacctgggtaaggtccatatgagcccttggtcctcacagcattcttagagaatcacccgggagctttttgaaaatgcaaaatctctggcctcactccagacctcctgaatcagaatctgcatttgaacaagatcctccaggtgattctcatgcacattaaagtttgagaagcactgagcttaacatttgggtattctgcctcccgtaggagaagatgggtgactgggtcattagtttggttgttctgtgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgtaagtttcctgaggcttcctcagccatgcttccttaacagcctgtggaaccgtgagccaactaaacctctttctttataaattacccagtctcaggtagttctttatagcagtgtgagaatgcactaatacagtctccttgtctctctgtagtgttattttcttcatgccatgctattctgagctgcaactatttttgagccatgtgatattgatgctaaggtagaagataatattctcaatccttttgattattttttctctcctaaagtcataatttgtccactttccttccttccttaattggagtaccaggactagcctgagggtcaacatttatactctcttttttttttttaatccttgttttcttccccagcagccacaggtcaagttcttgccccttctaatggtctggtcatttcttttcctgtctgcctgaaactggcagaccctgagaactgtctacaggcctatagctaattctcagtttttcctggatagttttaatagtatggatgtcatcctgactcttagcttcttttccttctcccaccagttctctgccattcagctattttaccgctgcttttctttttactaagatgtgcctatctctgcatccatgaggcctctgtttccattctaccttgcagccatctgcttctcacttttgctgttgttgctcgtaattgtaagtttaatataagcagcagcctcaggagaccccatgaaagcaatcttctggaaacagtcaaagtgctgggaatttgatggttggatctgggaatatcaataatgtctacaactgatgaatgtagctggctatagattctgaagtactccagtgcgtcatcagcatttcatgagtatactgtctgtgtgattttttcacagagtttccctttgaattttatgtctgcagagtttctaaacactgcacctggctcatacagttacaagccttctttctcagtatttatatagttgtttattcagtctccaagatgattagttatttgagatgagtagaagttgcatctattcatgtaatcagagcttgttttcttgctcactggtggccagatacaggtcataatagtattttattttcttaactttgaatagcgttaaaggggagtggactcatttgaattacaggaggtactgaaagaaaactatattattcattacattttgtaaagcaaggaacaaagaggaatagttgtttcctaccatggtaatttcagactctgaaagatctgtttataagccaaatgtagacatacctatccctaacccagatttttttatggtcttcaattttgtaattatttagaattgaagggttttttttcctttctgccacatatttttgtacacaccctttctccctcccctttcccatgcttttgtttccttgagaaaaggagcgtccctcttagagcatagaataaacattctttgtgaagtgtgacttatttatgcttcaggggttgtcagtgtatacacaatagagaaggtgatggaggctccgaggcatgccaagtcagcactttgtgcatgttgaggccaaagagcatgttaagcaggcttaaaaaattttaacaagtcagaacattttacaatttccatatttatcaaacatgtcaggggatgggatcacaaagccttccagggattaactgcctctctgacttgaactgttttattaagatggaagaagccaagttctcaacaccctgtgatttgctctaataaccacaagaatcagaatgtaggtgatccttgctgaatgaaagcaatcctaaggctaaatgctctttgaatggggaaaaaaaaaaactctctcaacagatgaactatgtgtgaaactttctaacagagcttaggagtttgaagtttatttacctagagcttcagttttattaattctctggttggtggttcttgacctttgacacccaaggacttagactgtgaagcctaaatagaaggcattcagaaacctgaagacattctcaaagaggggtggccattggcttttttggggttggcaaaacatcctagagttattatttgtttttacatgtttggggtttggcagatcctaagatgcattttgccaagcactttcctttgaattttagtacaggaatatcttgggtggaatttaattcgtgattcatttgcattatactgatcagaatgccattttggaaaagatatctgatgactgagaaatattaggagatttacaatttttaagtaccaactttttcttagatgggaagaaaaatggaattcaagccccaattattttcagtgagatttggaacttggaatcttgaactaagtagtagtttccaaatgtgtctgtattactttctctacaaaagcgaaccagactacttccctggcttgatctgcaaatctttagaaaagttacagagctgatatgcaaccttgggctggtatttaatttgaaaactaatgttaaaaaggctttctgataagtaagtagggagagtaaccctcttctgaagaaatagattggaattaaaaaacaaactaagactaagcataagtgagatcttgggtttgaaagccaaattgccaaagatggcaaaacccctagagggctaaagttatgtgaagtgccatgaggtagcttttccattactgtttgcagaaaaggttgtaaaagaaggaactgtgctgaaactttacaaatgagtaccaaaccataaactttttaaagaacagggaaagcacatagctaaatatggtacccaacattattgcccatcaggctgcaacaaagcatgatgacaaaaacaggttttttcttgtctactgtcagcttcctattgtttgtaactggcccaggaaaagcagtgccagcaactcaaatgactgctctcactgtcttcttgagaaaacagcagtgcaagcaagcgtccatcaggaaaagaaagaagcattttaaacaaatttacatggatatctttaggttcaaattattttgaaaccaaaggatatgaagtgttgggaattctagttctgaattctataaatcagtgtaaggagaaggacagtgtgatagagactcttttatttgcttcaaatagtggggtgaataagttataagagtatcactgggccagtgttgatgattttcttttctctcttgttccccatgttcttcaaactgcttaaaagtcaaaacacaagatgtattttgagttcttgaccttatcctggccctgacttagtttgtcagaatattaggttgtctacagagatccaccctggtttccatctaaatttttttagattttggtcaactttctatatctttatttaaataactgtaagtattcctttcagtataataaaaatttatgtttttcttcttcttaaactttggtccttgtccttgttactttaaaacagagaacttagtaaagataactttttcttttatttctcatttttctctttctctctctatacccctctttgcttgcccccgcccccaaccttgtctctttcttactggctataatctaattagtgaatgcttatcaatgaccaatgagaacattgtcacattttacattttgcttgttactgaactgtaatctctgttgcagaaagcaggatttttgtgaggttgaaaggaaagtgtggcatcccatgagtctgatgctattacgttttagaaaattgaaatgactggccaggcgtggtggctcacgcctgtaatcccagcactttgggaggccaaggcgggtggatcacctgaggtcaggagtttgagaccagcctcatcatggagaaacctcgtctctactaaaaatacaaaattagccaggtgtggtggtgcatgcctgtaatcccagctactcgggaggctgaggcaggagtattgcttgaacctgggaggcagaggttgtagtgagccaagatcgcgccattgcactccagcctgggcaacaagagcgaaactctgtctcaaaaaaaaaaaaaaaaaaaaaaaaaaagaaaagaaaattgaaatgacttactacattattgagagcatatcttagctttggataataaagaatatagataaacattttaagagcagctcttgtttcatacttcttatctcacacacagtgccttttacacaataagggctgaataaaattgttacccattttagttcagttaatttttgaatgtgagggcagatcatttaattccgtatcttaatatataatccaggactggtgaataatacttcctgccaaaaatccattaaccttacaggaaacaaaacccagtgaggatcatagaagtaaaaataacttaatttagatttcataagttgttatttttttagagaaaagcataaaatgttctgtacctgcacatttgaaaataaaatcaagaagcaaaacattctcatgagtaagaatatgaaacaataatttgaaaataccaaaactcagtatttattactgttctacagtagatattagtgactagggaaaggacaaggtggctatggggtagtagaaaagggagccagatatgcaaacctttggggatgatgatttaactgcttcatgacagttaagaaaagatttattttttttagggtttaaaattactatatttaaaaatatataaatatttgagttttttcctcaagtctggaagcagaagcattcctcagtctttctctccttcgacatggcagcaacagcaacagcagcagcagccaccgctgctgccacggccctggctccacctagggaaattgcagaagaccctatctcattctagtgaggaaggttctatgaagtagatagttcatcttgtagactttttagaccattgctgtaaaagacttttatattttttattttttgagacaaggtctcactctgtcacccaggctggagtgcagtggcacaatcatggctcactgcagccttgacctttcgggctcaagcaatcctctcacttcagcctcccaagtagctgggactacatgcacatgccactctgtcagctaattctttttgtagagacaaagtctgactttgttgcccaagctgatcttgaactcctgggcttaagtgatcctcctgccttggtctccggaagttctgggattatagatgtgagccaccatgcttggccctaaaacttttagagccatcttcaaatgttgtgattgtctagctggacatggtggctcatgcctgcaatcccagcactttgggaggccgaggctggtggattgcttgaacccaggaattggaggccagcctgggcaacatggtgaaaccctgtctctgcaaaaaatttaaaatagttggggatggtggcgcagcctatagtcccaactactctggaggctgagatgggaggatcgctcgagcccagcaggctgaggctgcagtgagctgtgatcatgccactgcactccaacctgggcgacagagtgagaccctgtctcaaaaccaccccacctcccaaaaatgctgtggttttctgtataaaatgggactaactattgacacttctttataaatcagataaaattatattgaagtccagtttaagctcattggatgaaggatattgcatttcagtgtagtgtttataagaagtctactttaaaaatatatttttaaaaatgattgtaggatcctgtttttttgttttgttttgttttttgctttttgtttttttttttattctaacatttcctatgttcccacaatattaagagaccatttcacatcacagtctcactgctggagacttttactataatatatatttatctaaataaggttttatttatttgtagctgcataaataaggtttctacttagaaggaagcctcttgagagcctatatttgttttttgtacattttaaacttctgttctttaacaccagaaagcaaaagaatgaatagcaggtgaacaactctaaaaaagtagagataacaagtagaaggaaaataatgtttatgagaagaaaagtggtcttgttattgagggagccaagctgctaaacagagtgggaagagaacatttgttcagtctctacttgctggggcaataaagccttctatctgcccctgttctgtgtaaaatcctgttaatattagatattttaaatttatgatgataaaagaaatgtgcaccttttgtgggaaattcgaaaagaacgaggaaaaataaagaagggcaaccacctctaacaccaccacccagaaataatgacagctttcaagtgtgtttctttctaatcttttctgtgtaatttaacataattgaaattatacggaataaacagtttcttggcctgctattgttttcatggactacaattttgtactctcattttgagtaattataatgtgccaggcactgtgttaaacattttacaaatattaatattatctcttctcagcactatgagggtgggtatagttataccttgagcttatatttcagggaatgtctacaaatgagtctactgctttaagtaggcttcactgtatgaagaaaatgcagacagcagaaaagaaagctagacgtttttcatggatgcttctttctttctttttcttttttttaggttttattttggagggaaggaagaagaacctgtcttctttaaaaaatgaaatatttttaaccgaaatgttatctagtgtttagtgtgtcaacaagttctaaattgtggaaaagtcttatcagaagaaaggctgctttgaaaacgatatggaaatatttgttgggtgttcactccttcaacgtctaaatgaaatacactggggagtaactgaattttacagtatttagatagctacatagtgagcaatcaaaacattctttaagtatttaataagaggttaagatcggcccgcctaaagcttatataatagaactgagtcagtgatgatgagcattttttcatgtgtctgttggctgcataaatgtcttcttttgagaaatgtctgttcatatccttcgcccactttttgatggggttgtttgttttttccttgtaaatttgtttgagttctttgtagattgtggatattagccctttgtcagatgagtagattgcaaaaattttctcccgttctctaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtgtaaggcaatcagagaaatgcaaatcaaaaccacagtgaaatatcatctcacaccagttagaatggcaatcattaaaaagtcaggaaacaacaggtgctggagaggatgtggagaaataggaacacttttacactgttgatgtgattgtaaactagttcaaccattgtggaagttggtgtggtgattcctcagggatctagaactagaaataccatttgacccagccatcccattactgggtatatacccaaaggaatataaatcattctgctataaagacacatgcacagatatgtttattgcggtactattcacaatagcaaagacttggaaccaacccaaatgtccaacaatgatagactggattgagaaaatgtggcacatttacatcatggaatactatgcagccataaaaaatgatgagttcatgtcctttgtagggacatggatgaagctggaaaccatcattctcagcagactaccgcaaggacaaaaaaccaaacactgcatgttctcactcacaggtgggaattgaacaatgagaacacttggaccaggaaggggaacatcacacactggggcctgttgtggggtggggggagcggggagggatagcattaagagatatacctaatgtaaatgacgagttaatgggtgtagcacaccaacatggcacatgtatacatatgtaacaaacctgcacattgtgcacatgtaccctagaacttaaagtataataaaatatatatacatatgtataaagtaatagaaatgagtccaggaatcagtaacttggatactttgttagctgttcgagaccctgggccaggccaacacttcctaaaggtgccagagcacacagagagcatagagattgcactgattgcaaacctatccaagggccccagctcctctgctaacacccaaggcctctccacctgtttttctccgagttgctcgtcaccctgtcctttaccttctagattccccagggctcctggtctccttggaattaagactttgagattttgttgtaagagtttccaaacaattcttcacaatatctcttgggtttgtccttgtttatccaggcctttgttactcccacagcctccttgccagcctttttgatgcatcctttgctgctcactgccttaatacccatgccatctccaggtctgtatttctaaaacatttctcttgtgtcattcctctgctccaagaaggccttgaatgtcaagcctgtttttcagcttgtcttttgaggtcttctgtaatctggctgtacacaaccttacacttttatttccggctccaacgtaaagcttcctatgaagtccagtggtgtgaatttcaacttgtataccttgattgtatttttcacaggtctagaaaatccttactttacaatttatttaaatctttctaatcttaagttctattttttctatgaagtattccctgattcagtctacctaggtcttttctttctctgtacttctcttacaggcagtatcataaagatgaagtcatgtttttatggaagccatttttccccaacgagattatagctgtgatggtaaagctggtacccttcaaaagcttattcctttcctttccctttccctttcttctgttttctcttttcttttttcttttcttttcttttctacctctgtcctcttccccatcacccccttgatattaacatcattgcactatatatccttttcctcccatcatctttcattttctcctgactcatcaatataccagcataacataggatgtatcattttttagtcgacaacaaaaagattttatttttttcttcatagcattgcataatatattttcatgtaatacagttttgaatcctacagaaaaatatgaagaaataaaagtacctgaagagccatcactgtgagtagtccaccatcaaaattttgataactgtctttttaggcatctctattcacacgcatgtgtgtgtgctcacacatcgacatgagtaccatactgctttctcatgaatatcttttttaaaatgcagattttttttggagaaggaagtttacctgccctcttctcttccccctctccccaccatctcttaacgcatttatgttaacaagctgtgtgtttttgcattcatcaaacccattttattatatgcaaatacattatatataatggtataaatggggagggggagtgtgttttgccaaaatgggatcaccttatatacagttatttggatcttgcctttttttttatttatttataattatatgttaagaaaatccttctaagaaaacattttatatccaactccaggagaaatattaaaaagggaaaaatttgattggatgagcagatattaaatatatatatatcaataagattttctctgtaccattaaataactaactttaaaaaataaagaataattgtcattcatagtagtgtcaaaaatctttaaaatgcctaagaataaactaaaagggaaagttaccagatttctagaatcctgattttcttaaaaactggataaaataatgttaaaatttatatagaaaaattaatatttgaaaagaaccaagaagttcatgaaaaagattatctacttcttaaatttaaataaaaacatatattgcctgttttcttggcactactaaattattctacaacatgacttaatgactgcagagtatttcaacatcggaatgtactctcatttattttactagtctacttttgaaatttaggttgtttgtttgttttcaacatatatatttttgctatataaatatgctgtagggaatagccttatggacaaattcttatatacaaccctggttgtttttataaaataaaaacctagaagtgaaattgctaggtgaattttcacatttttaaaacttttgccacaggagtgctcattattgcactttgctaataatagagtttgttaatctaatttttttttttttaagagtcaggatcttgctttgttgcccaggctggaatatagtataagcatgatcatagctcactgtaacctcagactcctgggctgaagcaatccttccccttcagcctcccaagtagctaggactacaggtgcacatgaccatgcctggctaatttttttcatgtaattttgtagagatggggtctcactgtattgtccaggctggtcttgaactcctggcctcaagcgattctcccatacgcatatatatcctcccacatatgtgtgtgtgtgtgtgtgtgtgtgtaaaatgcagtgtttttaggaaaaatataaagaggtcaacttactagctttcaaaactaagaagaaaagaagaacactcccttgaggtttaaggcattttgacatgtaaattgtacaccaatagataggcacattacatgtaataaccagaccatagactcttaattttgttgaacatgcccaaaagctctgtgtctctttatctcagtctgcttcagtcactagggcaatgaggacattaactatcacatcttgaagtaacttacaaacaacactttgacatttggagcattctataccagaaatctcttaaattacaatttgtttcttaggtctagcatgagtaacaccatcaaagtgtatttctttggcttctgctataatcaacaataatagtaataataactaacatttaatatatacaacaaatgctgtgtcaggcactgtgcactgtaactgaggtggtatatttacttttttttttttctttttttaactgatgaggaaacttacccgtaagagcatttaactaatttgccaagccagcaagtgaggatagagccctggagttggtcccattaccactataatcacttcctctagtcattctttccttactccaaagtttacttcatcatctctagccatttctagatacctttattcttttcttctcttgatgtcttcattttatctgtctcacttccatgacttcttcttcttcttcttctttttttttttggatgaggtctcactctgttgcccaggctggagtgcaatggtgccatcatagctcactgcaacctctgcctccgaggctccagcgatcctcccacctcagcctccagagtagctgggactatgggtgtgtgccaccatgcctggctatttttttgtgtttttttttttttcttttgtagagacaggtttcaccacgttggccagcctggtcttaaactcctgagctcaagcaatctgcctgccttgggctcccaaaatgctgagattacaaacgtgagccaccgtgtccggccaatttcttgtatggataccaaactgtgtcttatcctgcctcttttagttctatgtcttatcacccattagttttacaggtagccatatttatatttaacctacgcaaacttgatcttcatctgcagaaaaagggaatcaaatctactgctcatttcattggaaagaatatttatttatcttgatgtttaatcgagctgtgggctctgccttttaaatactgattagttctccaatagaacagttcttttgggaactgggaagcttttattttagacatttagggtatagttttgaattaaaggctatttttccataagcggttctgaaaggttaagttttgtacgaaagaatgggctctagaaatttactttggaacttagatcacttcattgggaatgcctaagtgaatctttgacataagttgtccaggtgtctttgctttattctttggaatgaaaaaatgtatgggtcaaacagaacccatctgtttggaatatctttagtatccagactctgacctccatgtttttggttgtgagaatgtcagcatagtacctggcttctagaaaatgctctataaatataaattgcctgggtgaataactgaattaatgagtgacttaatgatagagactgagaatgagaagatagaatggttgttctggaagtgattgcttctctccagctaagcctttaactctgggctgtaccatcagtagtccttgcatactgaagtcagacttttctggtcaagaagaaccttttaggttcttgataaaataccttttattcttaattttcctgtaagtacctgaatgtattatcttgaataactccaattcaggtccttagattcctcacgttacttgaaattctttgtttcctctaagagttcactgtatctcacaaatatcctgatataattctgttggtaaatattgatctcactttgctctgagatcaggctgatgtatatgtgtggtaggtaataatccctatttaggctgatacattgttcacatatgcacatattataatacacgcaaacatacagaaatacacactttttccctctgaatttttggaattgaagacatgatactcctttatccttaaatgtttccatgcatgtttcctgaaaacaaggacagtctcttatacaaacatgatgtaattatcaaaaccaggaaattaacattgatacaatactattatctagtctgcagactgtatttgggtttttccagttgttccagtaatggcctttataacaagttaaaatccctgagcatgtgttgcattcacttgtcatgcctcttaatctttagtctggaacaatttattctttgtcccctgcaacttgacattttttatgagtgtaggctttttattttataaaaagctgctcttttgattttctctaatgatttcttattattagattcaggttatgaatttggggaagtaacaccacagaattgatattttgtttttatctgttgttatgtaaaactatgaattcatattgataactacaatttcctttcagcatcacactattcattctgtgattcctcccttccatgtttttagcttccttcttcaacagcaagaagcctggttccattaccctcaataaatttacttatttactcaatcctagatatgaaaaagcaacttcagaattgctaacccatacatctttaaaaaggaatcctgttaactagtattcagtatttgtttagggtgctttttggttttagtctgaggacatatagtgtaaatactatctttaaataaagttacttgggttagtttttcgttctctcttctacccccaactctgtccgttggaagcataggcaagacaacctggggcttgtgattgatcatcagaagtttggtggggggcggttggtcttggggactgagccctcaaactatgggatctgacactatctccaggtagagtcagaattaaactgaagtagtggacacccagctggtgtctactaaagaaccgattgcttgcttggtgtgtggggggaaaatccccacacatttggtcacagaagtcttcagtgttgatggtggtgtgaaaacagaagaaaaacagtttgtgtttttccactcagtgtattataataatcccccttaacaatttaggaataaactgatattcctgacaagcaaaaataacttatctaaacatgtaatcatttgggctttagttttcacattcataaaaatgaaggcattggtctaggtgatctgtaatgtgctttccatccttaatatttttgaaaaaatatctgtgacatgttcagtatagctaattttgattaaataaacatattttaaacctatttttagaaccagttttggggagaatttttgcctttagtgatagagaatttttcccttaatgtaggtagtaaatgttataagattatattgtttatctacaaatcagcaagtataaccagggttctgaattctcatgtcatatgtaaatcagtaacctttcagagattaaatgagagcaatcatgtgatagcagcagcaaaagatcaatatgcaatgctagatatagaaatcttcttgtatctttaatatatatcttaattttagtccttgtattactgatcttgtgccatgtaacaaattaactcaaaacatagtgattaaaaacaacattaatatgtatgagcactcatagtttctggctgggtacttctagcattggatctctcatgaggtttcagttagatataggttaatgaaacacgcatctgacagcttgactgagcatggaagatcttctgtgttggtcactcgtaggctggcatgttgatgcttattcttaatgctggctctacacagtgagcaaagagacctagtgttagaagtcacaaaacgtgagttttatattccattggtcacactgaccaactccaattcaatatggaagaaaaactacccaagagcatgagcatcactgggagtcatcttggaggctgggttttagtgtctgtccttgtttttgttttcagtagaagaaatgacttttttagtgcccttgaaataattgctaaaatggtcctcaatgagatataatccttttgcacagataatggtacatttttttcttactagaaactagagcttacttactatatttacttactagtcctagagctcagtgttatttgctaaagaaaagttttcttttgttttgtttttgagacagggtctcgctttgtcacccaggttggagtgtagtggcaagatcttgtctcactgtaaactctgcctcccaggctcaagtgatcctcccacctcagcctcccaagtagcagggatgccaccatgcctggctaattttttgtatttttagtagagatgggtttttctcatgttggtcaggctggtctctaactcctgagctcaggtgatccacccgcctcggcctcccaaagtgctgggattacaggtgtgagccaccacaccaggacttaaagaaatatttgtggggctaggtgcagtggctcatgcctgtagttccagcactttgggaggctgagacaggcggattgcctgagctcaggagtttgagaccaacctgggcaacacggtgaaaccctgtctctactaaaatacaaaaaattagccaggcgtggtgatgtgtgcctgtagtcccagctactcgggaggctgaggcagagaatatcttgaatccgggaggcagaggttgcagtgagccgagatcacaccaccacactccagccttggcgacagaccaagactccgtctcaaaaataaataaataaataaaaataataaataaaataagaaatatttacggccaggcgcggtggctcacacctgtaatcccaacactttgggaagctgaggcgggtggatcacctgaggtcaggagttcgagaccagcctggccaacatggcgaacatggtgaaaccctgtctctactaaaattacaaaaaattagcccaccatggtagcagatgcctataatcccagctactcaggaagctgaggcaggagaattgcttgaacctgggaggcagaggttgcagtgagctgaggttgtgccattgcactccagcctggacaacaagagtgaaactccgtctcaaaaaaaaaaaaaacaaaggaagaaggaaatatttattgggttgggtggagtaggctcagagccatgaatgttccaaatgatagtaaaattggatctcagcttcctattttatggcaaacgaggtgattactggtaaaataaatgaataaataaaaaataataaaaataaagcctttaaagagaaaatgtaatagttctttccaatgatctttagattttttaccataatcatcagaattatctttgatggtttctaaaatgtgttgtattaatgtataatgtaaactttaataaatgtgcttttaaatgccagttgctgacattaaaatatatctataatgaagttcaaagataaatggaactttctgaaaactcctttgcaagttaatttagatataggaggtaggatttgaaaacaggatcacattataaactcaatagtcctagaattattatttaatatataaaagatatcaaaatgcatttgtaaacatttgaaagataacagaattggaaaattattgttcatttaatacaaaaatgctttcagaatctcttagctttttttgtcatttactagaaaaattgctggtttctgtattttttctttttcttcttctaactttttaatttattatacatcattgtactaacagtaaaggaaatttaaatgatgaaaataaaatctgccatcttatcaagttcaatgtgactgtaaccttttagttctttgtgtgtgtgtgtgtgtgtgtgtgtgtgtgtgtgtgtttggttggcttttattgatgtatataaaaagattacagacagcaagagaagataatcagaggccttttcgttcttatcaaattaagttgctttatagttgtatttttcttttatattttaatatgcatttgtaattgatagaggaaagaatttgtctttcctctgtctcctctaattttgtgccaaggaaaatctggcacagaattaatcaaatttttgcctaatttttatcatgatataattaaaaaattgagtatatgatactcaattttatctttattgtattttattagcaagggcttatttattaatgtatactaggttttggagaatgactttcaagtataatctgtttatttattcacaattggtttaccagtttcctgatgtttctgtccctttgcatttttggtcacatacctttgaccctttttggcctttccagtagaggccaactatagatggagaaaaaattcaatgcatcatttgccttccagtttaatcagtagagtaggcaatacgtgtacattttttgtttgttttttaaaagtctctctgccatgacatttccaatcccctagctccctctttaccactgttatcagtctcagaattatacttccaaagataatctgtgcacaaacaagcatgtgtaggcatatctgtttttcttgtacacagttagttgcatatcatacatactcttttgcacctcactttttttacttataaatctgactcattttttaaggttgtatagtataccatcatatctctttggtatcatttctttaaccaaacattattgctggacatttaagttatgttttgattgttagtgaacaatgcagtatgtatatccttttaaattcttagtgtatatatgtgagattatctgtgagatgaattctgaaaaacgtaatttctagtcaaagaacagtgcacatttaaaattttgttagattctatgaaattgcctaagaagttgaaccaatttatatttccaccaataacacataggcatattcttttgccaacacctgccaattgaagatatttcaagggccagcatttgatgtcatacaagagacatcaaatataccacttagtgaaaaatactttgttctatcccaaagaaaactattgataacccctctaagcctccaccctcctaacttttttttctttcatgggttattcatggctagtgtcctcttccagcaagcttaagcccccaaatcagtccctttcttttgtcctccacatcacttatgcgtgatcccaattggatttcacctctgcatttagtacctcctttccatttccactgccactgccctaattctggcctacttataacatctttggattattacaaagccaactaatcttccgttaaaaaaattctcccttctgtaattccttctcccaagtgctgtagttatcttcacaagatctgagtatgtaactgcattactttttaactatttcttacccacgcctagagttttcacgttgaccttcaagacacaatggcctggccttacctttccttttcaactttattacccactactctctctcatgtcttccttgcatgcacacatagctgcaattattctggatttttcatcatttcctggatagccctccattttcctgcgtaatccctttgcttttgttatttgtaacatatgcccgtaatattcccttttgcatttctgctaggtggaattctactttttaaaacttaggtcatatacgactccttccatgacatcctgtttccctggccaaaagtagttttttctatatgcgtcataataatgtattttgagatattgctagtatcaaacatatttcattatgtattttagttgtacatgtctttttccctcaggagatcacaatcactttgagagcagtggcaatatcatatccattttcatatacttctctatcccacacataatgtatgtttctagtaaactgaattataaatcctgtatttaaaattttttattttatagtgattttagagttttcctctttgttacagtttttagaatgctttaaaagatttaaaagtttagtatgtgcagagaagaatgtctgaattaaaacctgaaatatctttcagattcagtgccagaaaggcagtgtgatgccagaggaagaataaggtcttggaagtcatgtatatttagacaagagtcccagtgccatgaccactttttagctatgattatataaaaacccgaacctttttccttgtctttaaaatgaggtgactggagtaggtcagtgtttcttaacacatttctgttataaagcatatgccagattatatgtatgcacatgttcccatcagcatacttagattttgatagaagataaaagaattaaaatgttttaattttaattggattttgtagttaccacaactatttctgctatacttggtatagcagtaagtggccgacttcagaatgcagcacaggaaagatagattgctagttatatgtgagcctctctcttgcttcccagtgagctgcagctactttctcagaatgcaagtgggttagtgaggttgttataggaataactttgaatgtaatctaagttatgcagacattaatcaaaacagtcatagtattttaattatttataggaataaattacttcttacagttgatcttggctcctgatcttgttacattgttatgagctgctgaacaagaagatcttgaaattttcgtccaactttccaattctgattgtttattctcctttccaaagtatagttgggaataagaagacactgaaagttttcagcagttctttttgacctgggcttatggtaacgtaataggggaaaaaatgctttcagttaaagtaattggacatctaattagcatttcctattgaaggttaaatattaaatatttttcccagcaccatttattgagaagacaattcttttcccaatgtgtgtttttagtgcctttgtcaaaaattagttggctataaatatgtggatttatttctgggttctctattctcttgcattggtctgggtctgtttttgtgtcagtaccatgctgtcttggttactacaactatattttaagtaaggtagcatgatgcctcaagctttgttctttctgctcagaattgctttaggtatttgaggtctttttttttttttttttttttttcttttcttttgagacacagtcttgccgtatcacccaggctggagtgcagtctctcaatcttggctcactgcaacctctgcctcccgggtttgagtgattctcatgccccagcctcaccagtagctgggattacaggcatgcgcgccacacccagctaattttttgtatttttagtatagatggggtttcactatgttggccaggctggtctcaaactcctggcctcaaatgatccacccaccttggcctcccaaagtgctgtgcttacaggtgtgagccaccacgcccagctatttgagatcttttggggttctatacaaatttgaggattgtttttgtctaattttgtgaaaaatgtcattagtattttgagggggatcacactgaatctgtagattgctttgggtaagatggtcattttaatattttttagtctgtcaattatgaatatgggctgccttttcatttttttgtgttctcttcaatttctttcaccagtgttttatagtttccattgttgagatttttttcacctcctttgttaagtttattcctaggtattttattttattttatagctactgtaaatgggattgctttcttgatttctttttcagctagtttgttattggtgtagagaaacactcctgagtttcgtatgttgattttgtatactgcaactttactgagtttgtctattcattctaagaggttttttgatggagtatttaggtttttctatatgttaaattatgtcttttgcaaacagggacaatttgactttctccttttcgatttggatgccttttatttctttcttttgcctgattgctctggctaggacttccggtactaaattgaataaaagtggtgaatgtgagcatctttgtcttgttctggttcttagagggagaacattcaactttttcaccataaggtatgatgttggctgtggatttgtcagatatggcctttattttgcttaggtacattccttctatactgaattcattgacagtttttactataaagggatgttgaattttatcaaatgctttttctgcatctgttgagatgatctttttttgttatttattctgttgatatgaggtgtcatgtttattgatttgcatatgttgaaccattcttgcatccatggaacaaatcccagttgatcatgatgcataacctttttgatgtgctgctggatttaatttgttagtgttttattgaggatttttacatctgtgtttatcaggactattggcctgtagttttctcttttggttgtgtccttgtctggttttggtatcagggtaatgctggacttatagaatgagttttaaagaattcccttcccttcaatttcttggagtagtttcagaagaattggtgttagttcattgttaaaagtttggtagaattcagcagtggaggctaggtgcggtggctcatgcctgtaatcccagcactttgggagggtgaggcaggcggatcacttgaggtcaggagttcgagaccagcctggccaatatggtgaaatcccgtctctactaaaaaaacaacaacaaaatacaaaaaaattagctggccatggtgacaggcacctgtaatcctagctactcaggaggctgagacatgagaatcacttgaacctagggggcagaggttgcagttagctgagattgtaccactgcactccagcctgccagcctgggcaagagtgagactctgtgacaaaaaaaaaaaaaaaaagaaaaaaaaaaaagaattcagccttgaagccatctggtcctgggcttttctttgtagggagactttgtattgctgattcaattttattactcgtcattggtctgttcatgctttccatttctttctggttcaatcttggtagatcgtatgtgcccagaagttgatccatttcctctaggtttttaatttgttagtatgtagttgttcatgattgtctctaataatcatttacatttcttctgtattagttgtaatgtctccattttttattttattttggggggttttctttctctcttttttggctagctaaatggtttgttgattttgtttatctttttgaaaatgcaactttccatcttggtcttttggttttttaagtctctattttgtttatttttgctctaatctttattatttctttctaatatgatttacatatttattcttggccaaatctcatgttgaattgtaatccccagtgttggaggtggggcccactggaaggtgattggataatgggggtgaatttctcatgaatggtttagtttcatcactttgttggtgttctcatgacagtgagtgaatttttgggagatctggtcatttaaaagtgtatgggggctgggcgcagtggctcacacctgtaatcccagcactttgggaggccgaagcgggcggaaatcatgaggtcaagagattgagaccatcctggccaacatggtgaaaccctgtctctactaaaaatacaaaaattagctgggtgtggtgatacacgcctgtggtcccagctactcaggaggctgaggcaggagaatcacttgaacccaggaggcggaggttgcagtgagccaagattgtgccacagcactccagcctggcgacagaatgagactccatctcaaaaagataaataaataaataaaaaggtgtcaggcacctcctcttgtaggaagcatatagtcggatcttgttttattatacattccaccagttcatatcttttagatggggaatttaatccttttacattcaaggttattatttacaggtgagaacttactcttgttattttgttatttgttttctgctgttttatatgtcctttttgtctttttcctttttcttaattgtttatcttgcagtttggtggttttttgaagtgatatgttttgattccttttcttttctcatttgtgtatctgcactgtcagtgttttatgcttccccatgttttcatgatggtagttatcattcttttgcttacagatgtaggactcccttaatcatttcttgtaatgccagcctagtggtgatgaattctctcagtgtttgctttcttaggaaagactttatttcttccttatttctatagaatagctttgatcggtatagtattcatggctagcaatttttttctttcagtgctgtgaacatgtgattttattctctcttggcctgaaggtttctactgaggagtctcttcttagtctaatggggattccctaatatgtgacctgatgcttttcctatgctgttttacaattctttctttgtctttgacttttgacagtttgactataatgtgcctcggagaggaccttattggtttgaaattttctagatttttgagcttcctggatttagatgtctatatctctcccaagacttgggtagttctcagctattattttattaaatagtttttataggcctttttccttgttttctttttctgggattctcatagtattaatatttgttcacttaatggtgtcccaaagtcttgtaggctttctttgttcttttttatttccttttcttttcttcctgttttttctcttttattcttttgtctgagttatttcaaaaacttgttttgaaagtcagggattcttttttctgctttatctaatctgttattgagatttttctgttctatttttatttcatccactgaattcttcagctccaagttttctgtttggttctctttttattatgtctatccctgcattgaatttctcattgagataatgattttcttctattttatcgaattgtctatttgtattattttgtatcttgctgagtttaagatttttgctttgatttccttttttggcaatttataaattttcattttggtgggtaaattactggggaattgtgtctcattggtggtgtcatgtttcattgcttttcatcttggatccctgtgttgatatctgtgcatctggtggaacagttgcctattccaattttgtagaggggctttcgttggggaagactttcacctgcagatgtgttttagggtctcagttgggtggggtatgttgctttgttttgaaggggtagcatagtgtagtctccatgcagtttcttcagctgtagtcagtgttggcaaatgcctgcaagtgtctcagtggcttaagctgcagagttgtgtgaggctggcctacctactcagggtctcctcccttgagagtggggcacttggttggttaatgctccagggaagtgtggggctggtcagctgacagcttggctcaggtgctactcccctggggccatgtgctggcctggtctgtgctcagggaaaacatggaaatggttggcctacctcttggcttgggcactgcttccctaggggtgaggtgtcaggctagtccattctccaagggagtgcagggctgattggccatcggaatggcttggatgctgctcgcctaggggtgggataccagggtggtccgcactccaggaaagcagggagctagctggctggtggttctgcttggatgccagtcccctgtgggcagggcacttggaccaaaggtgttcttgtggatttaggttttgagtggctgggattgaggtgctgcaacccttgggatggggaatatggagcaccctgggcagcttgttttcaggagtttggaagctgtatcatctcagcttggtacacacttaaaatttaggttttgtgttttggttatgtttagacataatgcctaatactatatatgatatgggaactctcatatacttctggttgggaatataaaatgatacaactttactggaatgtaatttggtgttataatatcagaagctttacattgtctcatatatcttcttttacttcataattatttgattagaaaatatgtcttgagggaataattatatgtatataaatatttatctgcaaatatatttattgcattatttatgattaataatctaaaacaacccaaatattcaacagtgattaaatattattttatatttatacagtatagtcttatgaagtcattaaattatttacaaaacattttaatgatgttggaaaacacttacgttgtaatagtaattaaataaggcaggataataaaactgtaaagaacatgatttcatatatttgagagagaagagagaaaatttgaaagagtgtgtttgagtgtaatgggggatttggtaaaatttaaaaaaaagattctgatttagttttcatttctattttctgttttaaaatttttttcctctaaagtccatgtacaattttcataataagaaaagctaatgcatcctatttttaaactaacattgttagaattagggagaagatggttcatttataggaaaggatatcatgtttgcaagaaaatttgtaatggcatgaggaaacataataaagggagaaatctacgaaagtattaataatgcattgacaaaagtatagaagggaatacagaaacatattagtctttcttctggttctgtaatatgataaaaacatttataaagctgggcatgctggtatacacctatagtctcaactacttgggagagtgaggcaggaggatttcttgtgcccaggagtttgagtctagcctgggcaatgcaatgagaccttatctctaaaatataaaacaataaaaatataaaatttaaaaaatttttctgcttttcaatttttctggaaagaaatatatcttaattaaaggaaaagaatttaaaagcaggctgatactcgagcattttgaggtcatatttgatgtgaaatgacattcaaaatttcagggagttaatttttttctagcagcacattgaatgatgctaaaaggaaacaaaatgggaaaaaatggaaagagcattagactgttgcacaacgttgatttagtatattttgtttattcatatggaagggcaaactcattcagcaaactttgtaagagtaccttgtaggtgcagagaaaagtactgctcacttatggaatgaagtgggaaaaaagtaaaaacatttttacttttccatttttctggaaagaaatacataatgttttggctggtcatggtggctcatgcctgtaatcccagcactttgggaggccgaggtgggcagatcacctgaggtcaggagtttgagagcagcctggccaacatggtgaaaccccattttctactaaaaatataaaaattagccaggcgtggtggcaggcgcctgtaatcccagctacttaggaggctgaggcagcagaattgcttgaacccaagaggtggaggttgcagtgagccgagattgtgccactgcactccaacctgggcaacagagcaagactccatctcggaaaaaaaaaaacaaaaaaaaaaaaacaggaaaagaaaaagaaatacatcatgttttaattaaaggaaaagtattgaaaagcacactgatactagagaattttgaagtcacatttgattatgcacaaagaaggcatgatccttgttctcaaggttcgtactattcagtatggaagataaaaggtattcacaaagaactaataaagttaacgtatttaaagtgacatatttgggtggccaaggattgcttgaggccaagagtttgagaccgtcatgggcaacacagcaagaccccatctttacaaaaaatacaaaaaaattagccaggcttggtggtatgcacctacagtcctagctactagggaggctgaggcaggagaatccctcgaacccaggaggcagaggttgcggtgagtcatgatcatgccactgcactgcagtctgtctgacagagcgagactccatctcaaaaaaaaaaaaaaaaaaaaaaaaaaaagaaggacactatggaaatagtggtatttgaatgggctcttagagaatgggtctgatttcaacagtttttcatgaaaaggatgtgcatttcaggtagaggaaagatatgagcagagaaacaaaggtgacaaggtatgggagcaatttttagatcaatgaaaactttttttaaaaccagcttttaaataatactttcaatgtacaatttagtggttttttagtatatttaaagagttgtgcaaccatcaccaatacctaattgtagaatatcttcatcactttaaaaagaactctgtaccattaatagtcactctgcatttcttcttctctctcacccctggcaaccacatccattttctttccctgtggatttgcctattcttgacatttcatagaactctatcatacaaaatgtggccttttgtgactagcctcttttctctttgtagaatgttcactcatgttttagtatttatcagcactttatttttatgacttcactgccaaataatattccacaatatggatataccacatccatttgtttcccttttcatcaattgatagaaatttggggtgtttcaactttttggctgttatgaataatgctgctctggatatttgtttaaaagttttatatggacatgttttcaattctcttgggtgtatagctgggtgtttacttcctaggtcatatgttaattttttgtttaaatttttgaggaactgttaaattggtttccagagtagtggtaacattttatatcctcaccagcaatgcatgaagattccgattcctccacatacacaccaatacttattattgtatatcttccatggttacatgacttggttttctagtgtaccttggagttggagaatggaagatgggaatagagaaaattaaaatgccatagagctctctattcttagcaagattcactcatttttcttgaataaacacttctcgattattgcaagtctttggttaatttccagagctccagaagaattgattctgacaattttgctggtgttcttgttgcttttaggaaacagcagattttctaagattcttacactaccattctaaagttgctttagtattcttctaaagttgaatactcctttttgttcgtttttatgccaaaggtaggttgatgccagacattgatgagaattgctctttctttttaggctactgagcaggggtatgacctgctatgccttgatcagagctatggtttataaattggagcaaggaataaaggcctctgtatatttagaggtgctttggtttttgttgttggtttttttcctttccaacttttattttaggttccagatatacatgtgcaggtttgttacatgggtaaattgtgtgtgtgtcacaggggttttgtgtacaaataattgtgtcacctgagtaatcagcataatacccaattaagtagtttttaaaatcctcaccatcctcccactctccacccttaagtaggtcccagtgtctgttgttcccgtttttgagtccatgtgtactgaatatttagcccccacttataagtgagaacatgcagaaccaaatactgtttttctgcattatatcttaggattatgaccaccagctccatccatgttcctgcaaaatgacatgatctcacttttttaatagctgcatagtattccatggtatgtatgtaccacattttctttgtctaatctaccattgctgtgcatctgggttgattccatgtctttgctattgtgaatagtgctgtgatgaacatatgcatgcatgtgtctttatggtagaatgatttattaatacatttctttgggtatataccagtaatgggattgctgggtcaaaaggtaattctatgttaaattctttgagaagtctccaaactttctacagtggctgaactaatttacattctcaccagcagtgtacaagcattccctttcctctgtaacctcaccagcatgttattttttgagtttttaataatggccaatctgactgatgtgaaatggtatttcactgtggttttgatttgcatttccctaatggttagtgttattgagcatttttttcatgtgcttgttggccatgtgtatgttttttgagaagtgtctgttcatgtactttgcccgttttttaatgaagtttctcatttttggcttgttgatttgagtttcttatatattctggatattagaccttggttggatgcatagtttgcaaatattttctcccattctatagggtgtctgtttactctgtttacagtttcttgccattcagaagctctttagtttaattaggtcttacttgtcgatttttgtttttgttgcagctgcttttggagtctttgtcttgaagtctttgcatgggctgatatccagaatggtatttcctagattttcttttagggtctttatacttttaggttttacatttaagtctttaatccatcttgagttgattttggtacacagtgaaggtaaggatccagtttcaatcatttgcatatggctagccagttatccccaaaacatttattgaatagggagtcctttccccattgcttgtttttattgactctgttgaagatcagctagttgtaggtgtgtggatttatttctggattctctaacatgttccatttgcctgtgtgtctgtttttgtaacagtaccatgctgttttagttactgtagccttgtagtatagtttgaagtcaggtagtgtgatgcctccagctttgttctttttgcttaggattgctttggctattcaggctcttttttggttccaattgaattttagtgcttttttttttttctaattatgtgaaacatgtcattggtagtttgataggaacagcattgaatctgtgtattgcttttggcaatatggccattttaacaatattgattcttcttatcaatgaggatggaatgtttttccatttgtttgtgtcatctctgatttctcttagcagtgttgtgtaattcttgttgagagatctttcacctccatgattaggtgtattcctaagtattttggtttttttgtggctgttgtgaatgggattgctttcttgatttggctctcagcttggatattgttgatgtatggaaatgacattgattttgtatgctgaaactttgccgaagttatttatcagatctaggagcctttgggcagagactggagtttcccaggtatagtatcatattgtctatgaagagagatagtttgacttcctttcttcctatgtggatgccttttatttctgtatcttgcctaattgctttaactaggactccctgtagtgtactgaataggagcagtgagagtgagcatccttgtcttgttctggttctcagggggaatgcttctagtttttgccccttcatatgatgttggatgtggatttgttgtaaatggtgcttcttattttgaagtatatacctttgatgcctagtttgtttttagcacaaaaggatgttgagttttatataaagcctttcttgcggctattgagataatcacgtggcttttgcttttagttctctttatatgattaatcacatttattgatttgtgtatgttaaaccaaccttgcatcccaggaataaagcctacttgattgtgatggattagctttttgagggatgtgctgctggattgagtttactagtattttgttgaggattttttacatctatgttcatcaggaatattggcctgaagatttcttttttcatttcatctcttccaggtattggtattaggatgatgctggcttcatagaatgagtaagggaggagtctcttctccccagttttctggataggtttaataggataggtagaactcttcttcatctggtaggattctgctgtgaatctacctggtccagggctttttctggttgatagtttttgtattaccgattcaattttggaactcattattgatctgttcagggattcaatttctttctgcttcaatcttgggatgttgtatgtttccaggaatttacccatttcttctaggttttctagattttatatatatatataattatatatatttatataaatatataaatatatataaatatataatatataaaatataaaaaatatataaaatatatatataattatatatatattttatatatatttttttctaggttttatatatatattttctaggtttctaggttttctaggttttatatatatatataaaataaactcctatatatataatgcttaataaactgtatatataggagtttattaagcattatatatatataggagtttattaagtattaacttacattatcacaaggtcccgcaataggctgtctgcaagctgaggagcaaggagagtgagtccaagtcccaaaactgaagaacttgaagtccactgtttgagggcaggaagcatccagcatgggagaaagatgtagactgggaggctaggctcatctcgtcacttcatgttttctgctttacattcgctggcagctgattaaatggtgcccatgcgattaagagtgggtctgccttccccagccctctgactcagatgttaatctcctttgacaacaccctcacagacacatccaggatcaatattgcatccttcaatccaatcaagttgacactcagtattaaccatcacaggtactataaactttcctcttaatactgctttagctctgtcccagagaatctgctatgttgtatcttgttttcattagtttcaaataatttcttgattcctgccttaatttcattgtttacccttaattcattcaggagcagattgtttaatttccatttaattgtatggttctgagagattttcttggtattggtttctgtttttattgtgctgtggtctgagaatgtggttggtataatttcggtttttaaaaatttgttgagaattgctttgtgttctagtgtgtggtcaattttacagtatgtgccatgtgcagatcagaaggatgtatatgctgtttttgttgggtgcagtgttctttagatgtatgtttagtgtatttggtcaactgtcaagtttaagtctccaatattctgcctcgatggtttgtccgatactgtcagtggggtgttggaagtttcccactattatcatgtggttatctatgtcttttcgtaagtctctaggaattcatgttatgaatctaggtgctccagtgttgggtgcatatatatttaggattgttaagacttcttgttgatttgaaccctttatgattatgtaattcccttctttgtcctttttgatcattgttggtttaaagtcagttttgtctgaaataagaatagcaacccctgctcttttttattttatgtttgcttgttggatctttctccatccctttactctgagcctttactttcccactgtatgtgagatgggtctgttgaagacattatagcgttaggtcttgcttatttattcaacttgccactttgtgccttttaggtgggatgcttaacctgtttttcttcatggttaatattgatatgtgcagatttgatcctgtcatcatgttgttggctggttgttatgtagacttgtttgtgtatttgctttatactgtcgatggtctttgtatttgagtatatttttgtagtggtcagtaattgtccttcatttctgtagtactcccttaaagatgcaaggacttcttgtaaggcacatcactagataataggtaataaattatcttagcatttgcttgcctgaaaagggtcttatttctcctgaagctagtttggctggatatgaaattcttggtttcaatttattttccttaaggatgctgaatataggcctccatactcttctggcttgtagggtttctgctgaaaagtctactgttagcctgatgtggttccctttgtaagtgacctgacccttctctctaggtgcctttaatattttttctctcacattgatgttggaggatttgacgactgggtgctttggggatggtcatgttgtatagtagctcacggcagttctttgaattttctgaatttgtatgtcaacctctctagtgaggttgggaaaatttttgttgacaatattctcaaatatgtttttcaagttgcttgctctctctttctctctttcagggatgccaataagttgttgatttggtctctttacataattccatatttcacagagactttgttcagttttttaaaattcttttttctttatttttgtctgagttaatttgaagaactagtctttgagctctgagattcttttctcagccttgtctattctgctgttaatacttccctttgtgttatgaaaatcttgtagtgagtttttcagctttatcatctcagtttgtttctttcttaaattgagtgttttgtcttttattctcttgaatcatttgattggattcgtcagattcattggaataggtttcaattttctgttgaatcttgattaatttcattgccatccagattctgaattctacgtctgtcatttcggccacttccttctggttaggaaccattgctggggagatgttgtagtcatttggaggtaagggagacactctggcttttagaattgtcagagttcttgcgttggttctttctcatatgtgtgggctgatgttcctttaactgcgatgtaatttgagtgtagtcagttgacttcatttctggatgtttttagagggccgaggctttgtgcagagtctgtatttgtgcctgaattcttgtccttggttccccagaagcgtatattagcaaagtatttttggtgttgatgtttgggctatgatccagtagatggtgcttaaacataatggcctgtaggtaggttcttgctcagccatgtggctcctctgcatttccttgcatgtgcagctgtgctccctttcagtggtctgagaatgtcagctcctctcacacttgagtgctggctgcagatctgtttggcagtgttgtgctatatactgtagccctggatggagctcaggctttgtgctccctcccaagcttggaaccttggcagtggcgatggcagagagcctttcacttgtttcttgaggctccaccccagagaaacacaaagctgcctgacaatcagaacaatcaacctggggtggggtgggtgccttgtaggcccaagccaggaaggcttgcctggtgacaaacagaggggagtgagagattcacagggaagaaagacaggcctcttccttgtagggtggctgtggcatactggaggtatgagtaaagtactcagggtctttatttctttcccagtccgagggcagcaagggtagtaccactgcagtggtactggcagaggggctttcagttgcctctgggagctccaccccagaaaaacagagctgttgccagtgggaatgttcagctggggttgggatgcctatgctgcagaaccaagccaagggctctgcctggtgaagactagggaggtggaggctgacaaggaagagagactgggctcccctccacatggtggctgcggtgtgctggaggcacaagtcaagcactcatgtctttgttccttcctcagtctgagagcagtaagggcagtaccactgcagtggcagtgacagaggggctggcagctgcctttgggagctgcacccctgggaaatacagagccattgccagtgggaattttcagccagggggtgggatagctgctttgtgggtctgagccaggggcgctgcctggtaaagaggagggggtgagggctcacagggaagggagactgggctcctctctgtatggaggctgtggtctgccggcaaagcaaacaggcaaagccctttgttccttccccagcctagagcaataagggcagtcctgctgcagctgcaatggcaggggggctgtcagttgtctctgggatgtcctctcctgagagatgcagagttgctactgaccgaattgttcaggccaggccgagaggccctgcccactgaggagtaacatgggcagggtttaggggtactttctacagactaatgaaaatcatttcatggggaaatcatggctccatgacacactggatggacctggggttaggaaaggaaatactgaggagagtatcaagctttactattgcttgtttggaattgggcttctatgtgtcagtttcctaactgggatgattttacctctccatccagaaatattctgttggcctagagaaactttttcaatgccttgtcttcacagatggaggagctataagtagagctttctttagtaatcacatctcagtaaccatgtgcagaaatcaattatcttaatatataccttatcaagttaatttttcaagaacaggtaagaatgagtgagcttagaaagtttaattgggaaaagagtgaatataagaaggtgataggatacctccttcaaaaggctaaaagattaacacatggaaagtaaaagaaacttatttaaatttctgtagaagatagaagtaggaccagtggatcaaagttacaggaaggtggatttttagatctatctaaaaaaggaccaagaaattagaactggcttcttctgttcaaatagtaatcagtgtgagtcacttagggaggttgtcaaagaaattcctgattgggagttgtttgaactaacacacccaaggacctttcttacttgaagaatatgtatgatattttacatgtattgaaacagctgtaaagagaaatgactcgccacaatttcttgcttaaagctttagttcatttctatttattacccaaaagtgtaattttcatttaagaatataagaaatgatacatctcagaattcaaggaaatattatatagataggccttaaaaaaggagggaccagtatggttctgagaaactcagctgagcctttcttttaatgctctaccactgagatgtttagcttccagttgacagtctatgtgcctttaaattcaaattctcaaatgagatactctaatttatttagtttaagttataagtctacccttgattcaatcatctgtagccaaaggagtaagggtcatataacagcaacagggttaaaatggtggtagggatgggcttttttctctggatggtggtcagttgctgctctaagtggagagatgaagtaagtcatgggctagatatctcataagatatttattagatttccaaaaatgttaatggtagaagactatgatttagactgtttgttgtcaatttcacacaaccagtatttatcatatggctactatgtgtaaggcaccatgctggatgattgccagaatgtagaatacaagatattgtccctgccccagggtatttacaagcactctgtccagtagactggtcattatttaataaatcatcctgcttaggttttactttggaagggctagctttctgattatgtagaaaggtgccttattaacttttgaaaaagtttcaagttgagtattaaagatgtttgccttttctaagcatacacacatttaatgtttgtgtagaccaagcctaaaagaccatcacaagctcatactccgagaacaaaaccccaatccgttctccccaaacaaacaaaaatatgagttgaatatcttatttgctagcagtatgttacattaaaatttgtgcttggccaggagtggtggctcatacctgtaatcccagcactttgggaggccaaggtgggcggatcacctgagatcaggagtttgagaccaacctgaccaacatggtgaaaccctgtctctactaaaagtagaaaaactagccgggtgtcgtggcgcaagcctgtaatcccagctactggggtggctgaggcaggcgaatcgcttgaacccgggaagtggaggttgcagtgagccaagactgcgccactgcactccatcctgggtgacagtcagactccatctcaaaaatataaaaaataaaaaatgtgtgcttgttcttatatgtacataaggtggaaggtaaacattttaagtgtctgtgagctacctagtattctaggcatgtcatatatgtaacatgcatatgatatgcagatagtgtatgcactattataataatataatccaattatagtctttattttcattatcttaaggatatttatatagttcaattgagtcgctaggaaataaaaaaaagttttttaagggtggggccttgctatgttgtcctggctgttcttgaactctgggcctcaagtcatccttttgcctcagcctcccaagtagctgggactacaggtatgcaccactgtgcctggccaagaatatttctttgtttcctgtttctgtgtttaagctgcatttagtttggcagtgtttgaaaggtatcatttctggtttacattcagctcttgtcctttctaccagctgagtgacttatgaacagaaaattatagagtaaaaataatatgacatatatgttaggctctaagcccttcaccttttttttttccttccaaataaagatgaagcagcttgtctaggtgcaatgccatgttaatatcctgtaaagataattagtagctgacttagcatattgcttggaggtttcctgagagaccaactttagctataatgcaagagatatttgatttctattaatacttgaataagtcattggttttatcaagatcctatatttaattataacttggggctggacacggtggctcatgcccgtagtcccagcactttgggaggccaaagtggaaggactgcttgagcccaagggttccagaccagcctgcgcaaaagagggagcccctgtctctacaaaaaaataaaaaattagttgggtgtgatagcttgtgcctgtagtcccagctattcaggaggttgtggtgggggaattgcttgagcctgggaggttgaggtttcagtgagccatgatggcaccactgcactcccgcctgggcaatagagccaagaccctatctctaaataaataaataaatcctggtctatttaaaaccctggatttgttttaaatagccatctaatttttatgctacaaaagagttaacatactttcttgtttttggaatctctctgaccttagaaccatactaactttgccatggatatttcttggggcctatttttccaaaataatcattctctttttttagagtctactgttcattttaattaaattgtttcccactatgctggtatgatttcaggaaaggagcatttaagtcatatgttcaatcaaaacttctgcaggtaaattataacccacttttcttttttatttcatgtggtcttggcaaatcatgttttaattgtggtcaaaatctgcatagaaacatattgtttcattgatttgcataatattttggggcattttaaaaatatacatcaatccccagagatcttaagctctacttgacagtatttagcatttacttctgcttaaactctgatatatttgagaaagcagaaggtaccacagtataatggtatttttccctttattattagttgtagtatataatattactagcagtattggtaaatattttagaatgtgaatgagcctgcctttcaaatgaaatctaaatctttatgttggtttttattttattactactgcatccagtgttatctgaatatttaaagtatattaaaaacattaaagacaaaaagacaaaagttttttaaagtatatattttttctcactgcataggatattagactacatatgtgccatctattttaaaactaatttcattcatcaccatctgttttcaagaaagatttaaggtggcgtatgtgcgctcttgtacttggtctcacaggctctgtctctctaacatacaaatctcctggaagtcaaaggtcatgtcttttcttctttctcctccatcttttacatctggctaaaattatattctgtatgcatgaaaatgataattacatattacctggtagttatcagatagttcacaaatttcctggagaagacataggaacaaaacagggccttctgtgatgaagaaagatgagaaaaatggagtatgacatcaggacacttagccttagtgttcttactcattacttttgtaaacctgtaacattttttcccatgctgttcccttttctgcttcatgtcttgattttcccatttgcaaaataaggatggaaacagttgcttcctgtttatttgatggggaatttaaggatgaatgggctagtgtttccttccccagatgtatcaacttaatcttatttattttctgtccatacttctgattccataatgtccaattgtatatgtgttttcaattcttttatttacattcttttccttttctgggattcttcaaaatcaaagcatgttaatcacatttcatagtgcacttgagtacccaagatactcttcagatatgggctaatgtttgaatagctctatttgcttttgagtgtctatcaaaacccaggccccagaccatcaaagcatgtaatatgagaggtgtccccagcctgaaatgcagatcagtttccaaggtgttaaagctttttctgaaagcctcactttggtctgctcagatgccttcttttcttttaacctagttgagcagttatgaaccaatgccatgatgaacagttgggtttgatcagtgcaggggtctattcaggagcattaactgaaaagtctactttctcatctgaaaaacagatgttttaccgtgatcctcaacatgtatgtgcctggcctctctgatactgattgagaaaaagaaaaacagtttagtagtcaatatctggggtcttcatcagctccaaataaactattaacagttaaatttcaacataagaaaaaatagagggccttgggactctgaaacaaaccactcattgatagaatttcactgaagatcagagccaaagtaatgcctaacaatttataaggttgtgcaggggaagaaaactggtcctgatctgatgtagggagtccagtgagagcaagcacttagttggagactcaaagttctgtagcatggcctggaagaaattagcttgtcctagaagattttgaagttaggcgctaacaattataagcatctatcactttgatatggctctcaaataattaaagaaattttgtcctataatgaggtgcctaaaggatataattgtttagtaatatttgagtactatagaatgtcttccagagagcataggttttgggttgccataactgatactgagttgttttttgtttttctgtctgaagtggccagagattcaaatgcctcttgagcctcctcctcgcatgtgcaagtaggactgtggtcctggcccacaggagcctcttcagctttcctccagctgtggcacaggacatgtgttcggttcactcgatcacattattaagtaacataggtattatttaaaaggagaagagtgagggcggagtcctattttatggcatttaagtttggaaccacttatgtcaaaactcatttctgtgtttatatgtacttcctaatttatttataataagcatgttgaattatgaaggagaatgttatttcaaaattctattggaggctacttagaggctgtggtgacactgaatgagagctctgaaggaaatcatagtgaaacaggaaaagttcccttgtccccgtcgcagggcatgcgacaagggggagtggcttgcttcttcagtgccccactgctcaaacctctaggggagaacacagatgggcaggctgtggggctctgaccccacggcagtgtctaggggtaaatgtttacagctgaagccccagtgaatgttgaagaatacgctttgacctacatattgacagaatttactgagttatagagtgataaatacttatttttttttcctaacaattatgtgatgttttggcaaataatatttcttttttctttttctttttcttttttttgagacagagtcttgctctgttgcccaggctggagtgcagtggtgcgatctcggctcactgcaacctccaccttctggattcaagtgattctcctgcctcagcctcctgagtagctgggactacaagtgcatgccaccatacctggctaattctttgtggttttattagagatggggtttcaccatgttagccaggatggtctcgatctcctgacctcgtgatctgcctgcctcggcctcccaaagtgctgggattatagatgtgagccactgcgcccggccgcaaataatatttcttaatttcagttgcatttatttttaaataggaaatacattcacctggttcagaatttcagaggttacagagctgtacgtaggaagaagttttgttttctcccaattccgcaagccatctgattagcccccttgaaggtagctcaagttactagtttcttttatttccttccataaatatttgatatgcataggagaaagatatatatatatatatgtatttatgtatgtatgtatgtatgtatatgtatgtgagaatgaatggataaataagcattcctctttcatacagttacttgcttaccatacctgctgttctataccttgcttaatttcacttaacactatgtcttggaattcattccatgttagtacataaaatgctgcttttttctttcttgtggttttgtggtatctattgtatagctgtattataatttttttttaactaggtccttactgatggacatttatgttgttgccagtcttttcattacaatgactaatgttgttttcttagttttcacttttcaattcatttcctaatttagtctgagcctacatattagtgccaagaactgaggtatttattgtgttctgacacatctgaggtatttgcatatagacatctgggtacatatgcacactgctgaactgtctaataatagtctctttccccaggacactctcctaaggtaaaacctatatattggaattcttatgctgtacatatatgctggatcacaactcttactgtcagactagagagtttcaacttttaacctgtgatttcagttattgtgacatatcctatgtttcaattagaagagacaaactttatttggtgagattcaaatagcgttcatgaaaacggtatcttttaataaagtgaggttaaaaaaatgggaaccacctaagatcttagagtgagaggagtagagattatgaaagcagttttactttttgattttagggtctttctatataatttcagcctgtatcagataattccgtttaggacacagctggtacatttaatgatcacaaactctgaaggtagtaactggatgcaataatcacacaacaaagtcattgagtaggtttgttgacttatgtcagattactctaaatcttgatgatattgcctggagcacaaaaaaggaatattgtcacagcaagcaatggaggttttgatactcgatcactggagtattcttttcccctaaattttgcgctcgttgtatcataactgctggtttcttagcctactctgatgttgtgcagaaaattgtacaatacttaaaaacgtgatatctaggaaagaaaattagtagaaaaaagccattagaactgatatatattagcattggtttggtggttacttattaaagataaaaatggagaatatttcatatttcttgatagaaaaaaagtaagttgccattcatgcaagtaaatcatattaatttaggtttttggcattttttttgttttctgagagaaacatgaagagttctgcttatttattttttatcttgagaatgggaacacattaacaagtacaagcgacaataaaacttactccataactacattatgaactatattaacttactctacaactcgataaccaacattatggttggttaaataaagagagtgaaaaagacagagagggaacgtgagaaagaaacaatctttttgtttcccaaagctgtaagaagcaatgataagacattgagtgtgtacgtgtgtgcatgttggggtattttagtattgtgtttatttttgttgggagtgagcagaaaatgaagccttcagtaaagaaattaataaatcttattagaacttgttgtaaatattttttaaattcctaaagttggaacactaaggcattatttaaactttatctctgttttttaaaatctgagaaacccattaacttttaccctagaaaatggaaagtgtcatatctcattttacagaggaagttaacaggtttattgtcttgttgtaacatcctaatcctgtgacattttgaaatagtgcttttggtagtgccttgtttttgaaactatagacctctggggcactatggacattttgtactagataattccttgtcactgggggctgttctgtacattgtaggatatttagcagcatctctgacttctacccactagatgccagtagcagcactcccttgggggacaaaattgtccccagttcagaacaactgctgtggacatacatggtggtcctacacaactggagtttaaatatggatcctgaacagctttcatcagtctgatgcacttccccaatatttgtaatcatgaggagcagagcaaaacaaaggcataaatgttggggtaatattttgttttccaaagaccactgctcaatttgggggaaatttttgaagaaacagcaaaggtaacccttggagtctggattggttggttggttgattgattcattcattcaacaaaaatatattgaacccctgctatatatatgcctgcctcaatactgatgacttgtacgctgctgtgtgtgtcttatggcagtatgttaaaaaaaatccgtggataataagtctgatggtagaccagttaagaagctgctagctataacattggtgagaaatgatggttgcctgggttttggtagtgacagtggaattataagaaattttatacagagatatttagaaggtaaaacattaggatttggtgattaactggagaaaggaaggcgtcaagaataatttccaggctttcattaagatgaggactagagtaggaaaaactgtcctttcttttggaataggagcagataattgacttcagcttttgacatttccaattggagctgcctttgagacatccacaaggaagagttagacagtgaacttgggaaataaatggattgtgtctgttttgttccttattgtacctcctgttctttagacagtgtctgcatttctagagacacagagagatttaggctggatgtatagattgggtgttcttcagggtatatagctagtttaattgaaatcaaggaagtagataacattatccaaggagaatgcatagagaagagggcctagtatagcaaccttatgagcagctttttcaagggactgaagagaggagggactggagaagtatgaggaaaatcaggagtgtatagttaaggaagccaaaggaagagagagtttgaaaaagaagggagtgttttatggttctgaattcagctaagagttcaagtaaaatacaaaaagattgtttaaattaaaaaagccattggattttgtaactaaaaagcatcagtggccttttagaagcctttttggtagtctggtagtttcaggagttcagtaaatttggttaaagagttaagtgggaggtgattggataggatcatgggaggtgggaggtcatactttcatgcattctggctacaaagaagagactgaagatggtatgtgaaggtggtattgaaatgggaaaagttcccttgtcccccttgcagggcgtgccacagtggggagtggctcgcttcttcagtgtcctgctgctcaaacctctaggggaggctagatgggcaggctgtagggctctgaccccatggcagcgtctaggggtgaatgtttacagctgaagccccagtgggcgtgtgtcacagagtgctcttttagttttgccgtctgtaggcggcttctgttagctcagttagactcccttccttatctcaaggacagagggctttctgtatcctggagttcttgccttggtgtaatggaataattgaatcactcgtgggcttggagaatgagcgcaaggttttgagtggaggtagctctcagcagatgggggaagccagaaggggaatggagtgggaagtttttcccctggagttgggccgcccagaggccggggctctccaacgactgccccagccaaactccgcgttgttggcttgccggtgtgctggtgcctattagtgcgttcctctcgctgtccagctgcccgtgtgttcctcggctcgtgtgctcctctcaacgtccagccaccatgtgtccgcctgctagggtctcggggtttttataggcacaggatggggggcgtgatgggccagggctgtattgggaaatacaacatttgggcaccaaggcagaagtgcctatactcacctaggcctgtgggcccaggtctgggggtagagccctcgccagggaccacgcgctccccttcccatcacttccctgccccctttctgtatgggatgcagggagggcatgtgggcttgagtatatttaaatgctgataaggagtcaaggatagaggttgatacgagagtggagaaaatggggcaacttgagatgggatgaatccaaagcacagggagaattaatcttaggatggataccctccaaagtcaagggatgttattggtgatgagaaaggcatattctgttaggattaatttctaatattgggggcttcttgagggaataatacttctggggtttcctgaaagttcagaatggcaggcattaaaagatgcctggggccaggcgcggtggctcatgactgtcatcccagcactttgggaggccaaggtgggtggatcacctgaggtcaggagttcgagaccagcctgaccaacatgatgaaacctcatctctactaaaaatacaaaattagctgggtgtggtggtgcatgcctgtaatctcagctactcgggaggctgaggcaggagaaccactggaacccaggtggtggaggttgcagtgagccaagattgcaccattgcactccaacctgggcaacaagagtgaaacgccatctcaaaaaaaaaaaaaagagagagagagatgcctgtgacagcccatactatttctgattccctagggtccactgatccccagagattccattaatttgataatgctctttattttgggtagctggcatataccagaattggaccctgaacctatggattaagtttgggtttggggcctaattctagtctaataatcagagtagcagggtgttctgagaccctctggagacttttcccattgtcaaagtacctctagccagtctaccttaattagcaaagatatcattcccattatgattcatcatgattgactggtctatatgatggattactgattgtagaaaactctggattattatagtattatgcttagaaaaccattctgttcaaatgttaaagggttgacaacagctcactttcttctgtggtttaacggaaagaaagttcgctgtggaaccagaaaaaaaatctggctccatcggtgattgagctatggggccttgaacatcctgtgaggatgttacagagtcatttactctctgtaacattacctggtaatgcctaatgtgcatcatggttagaattgaaggtcatgtatatgtaccattacattgttgatattaaataaataagaactgatagtatttttattgacttaaaataattattttattgacttaaaaataatatttttaaatatttaattatataattattatatatataattatataatatattatttatataattatataatatattatttatataattatataatatattatatataattatataatttattattatatataattatataatttattattatatataattatataatatattattatatataattatataatatattattatatataattatataattatttaaataaaaataataactattatttactactctagggccctaagtgagcacttattgttagaatttattgttagaattccagatcaaaatcaaggatctcatttctccatgaatctaagagctattattggtgatgtctttggtataagtttttgtaaggacaaaggttttgttacagtcctggccctactaaaacgtcttttattgacctgcatgctatcatagtaaatagagagaaaagagataaaattctagactttttaaggtatatggaaataaatcaaatttacttacttacttttttaccgtgaccaatttggatcgctgtcattttccatgaatgtgtctcaggtttttgtttttttaatagagagagttagctgtttcaacctctctttctttcgtctaataactcctcatttttttctccctcttttttcatcttcttcctttctttcagattattggaaactttctcatgttgcagcatttgctgctatcaattatgccagaaaagctttctgtgtactagcagtgttatgggatcgtgtgtgtgtgtgtgtgtgcgcgtgtgtgtgagacagagagagagagagagacagagagagagaggtgggggggagattgagatggaaagagtggcgggggatgaaggaagtgggggagagaaataaatggtgtctggggtaattgtgctggtgttttttcctgcatgagagaagcttcagatgtctgtctggctttggctcagttgctgtatgggcgtaactgaagaaggaggttggggtagaggagaaggcaattaaaactttgaacaccttaaatgcccttcctaattaagtggtgaggatggaaaatgaaataccttcttatgcttcatttctgttctccgtttaaaagtctgtggagggatcagagctcatgtccttagaaaggacagaactttcaaaataacaactctgaaaaacaagtttaaaaaaaatttctcatcattttctgcttttcatgaacttttaatataaagccatcattatttttttttcctgggcccccttacctatatcctctccccactctcattagtcactccaactttgaagcacccaattctctggagtattaatggagacagttcaagtatctaactgctgtttcctttgttcaagttgcttttggtccttgctgggaaatgctctgaaaactgaaccagctactgaacacaaaggctgacggtgttgtccctcctggtaatgtactgtgtgatttgttcccctctcctgttcatgactcattagtctctaagtacagaaaaggttgctcctctggaataaaaggaacggacccagctcggagtcctttttcgccttttcctgtgttttatatgggtgcactcacagttctccatcttcattagtgacccagcagggggctggcacagggttgagactagcttttgctggttccctggggtgtatcagagacctcagaactcaataccctactataaaaataaaatactgtgcttcaaacgaccttttgatggaacaaagccatacatcccaatctgcctgggcctctcaaattgagaccatgccaagtgccagatttgcattttgcacatgccctcccaccatcccctttcccccttcctctaaatgtggttcttttggtagcctcagtgtcaggtaaatgtttatgtgtgtgtgaaaacgcagactttggcaaaagaccttttgtatttaaattacacttcaagatagtagtttcttgtaagagatgtaggcagcagatatttgtgggcttttatgccctaaatgatatcattttagatttatatatgtgggcttttatgccctaaattatattattttagatttatatatgtgagcttttatgccctaaattatattattttagatttatatataaagtttaggaaagtaagcggaaactagaagtgctataaaaaactgagttacatattaaaaattcaagttattttttctggttttccagagtggccaaattattttcttatttaaaacctaggcaccctagagccatgtgtgtgcatgtgaactctactaaagtgagacactgacatgaacatagagtccatcagacctttatatcaagagcttggagtactcagagcatcgtatctcgttaatcttccagcattgatgtgctttagctcttgggaacagattactatacttattttaaagcaacagggcaaataaaaatagggatcttttggtattgaatgaccagcataactttagaaaatccaactctcttatccttcatttttacatcatagttacagtaacaggttaagattagcttttaacagattgttctaaatttctttaggtttcaaaacatattgctatgacatttaagtaatacttttaagactgtatgagacttagggccttggtttgtagagaatattcagttatttaagaaaagttcactttgattctatagtaaaataatgtacaggtgcaaatgtgtgatgttatttttggtttgtacttcaggtttgcaaacataccctaattttttacagaaagtatatggtagactctttattttaaaaaatgttcatagtctgggtctgtatgattttatttattttatttatttatttattattattattattattatactttaagttttagggtacatgtgcacaacgtgcaggtttgttacatatgtatacatgtgccatgttggtgtgctgcaaccattaacttgtcatttagcattaggtatatctcccaatgctatccctcccccctccccccaccccacaacagtccccagagtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggcgtatatgtgccacattttcttaatccagtctatcattgttggacatttgggttggtcccaagtctttgctattgtgaatagtgccgcaataaacatacgtttgcatgtgtctttatagcagcatgttttataatcctttgggtatatacccagtaatgggatggctgggtcaaatggtatttctagttctagatccctgaggaaccaccacactgacttccacaatggttgaactagtttacagtcccaccaacagtgtaaaagtgttcctttttctccatatcctctccagcacctgttgtttcctgactttttaatgatcgccatactaactggtgtgagatggtatctcattgtggttttgatttgtatttctctgatggccaatgatgatgagcattttttcatgtgttttttggctccataaatgtcttcttttgagaagtgtctgttcatatccttcacccactttttgatggggttatttttttcttgtaaatttgtttgagttcattgtagattgtggatattagccctttgtcagatgagtagattgcaaaaattgtctcccattctgtgggttgcctgttcactctgatggtagtttcttttgctgtgcagaagctctttagtttaattagatcccatttgtcaattttggcttttgtggccattgcttttggtgtgttagacatgaagtccttgcccatgtctgtgtcctgaatggtattgcctaggttttcttctagggtttttatggttttaggtctaacatgtaagtctttaatccatcttgaattaatttttgtataaggtgtaaggaagggatccagtttcagctttctacatatagctagccagttttcccagcaccatttattaaatagggaatcctttccccattgcttgtttttgtcaggtttgtcaaagatcagatagttgtagatatgtggcattatttctcagggctctgttctgttccatcggtctatatctctgttatggcaccagtaccatgctgttttggttactgtagctttgtagtatagtttgaagtcaggtagcatgatgcctccagctttgttcttttggcttaggattgacttggcaatgcaggctcttttttggttccacatgaactgtaaagtagttttttccaattctgtgaagaaagtcattggtagcttgatggggatggcattgaacgtataaattaccttgggcagtatggccattttcacaatattgagtcttcctatccatcagcatggaatgttcttccatttgtttgtatcctcttttatttcattgagcagtggtttgtagttctccttgaagaggtccttcacatgccttgtaagttcgattcctaggtattttattctctttgaagcaattgtgaatgggagttcactcatgatttggctctctgtttgtccgttattggtgtataagaatgcttgtgatttttgcacattgattttgtatcctgagactttgctgaagttgcttatcagcttaaggagattttgggttgcgacgatggggttttctagatatacaatcatgtcatctgcaaacagggacaatttgacttccccttttcctaattgaataccctttatttccttttcctgcctgattgccctgaccagaacttccaacactatgttgaataggagtggtgagagagggcatccctgtcttgtgccagttttcaaagggaatgcttccagtttttgtccgttcagtatgatattggctgtgggtttgtcatagatagctcttattattttgagatacgtcccatcaatacctaatttcttgagaatttttagcatgaagggtcgttgaattttgtcaaaggctttttctgcatctattgagataatcatgtggtttttgtctttggttctgtttatatgctggattacgtttattgattttcgtatgttgaaccagccttgcatcccagggatgaagcccacttgatcatggtggataagctttttgatgtgttgctggattcggtttgccagtattttattgaggatttttgcatcaatgttcatcaaggatattggtctaaaattctctttttttgttgtgtctctgctaggctttggtatcaggatgatgctggcctcataaaatgagttagggaggattccctctttttctattgataggaatagtttcagaaggaatggtaccagttcctccttgtacctctggtagaattcggctgtgaatccatctggtcctggactctttttggttggtaagctattaattattgcctcaatttcagagcctgttattggactattcagagattcaacttcttcctggtttagttttgggagggtgtatgtgtccaggaatttatccatttcttctagattttctagtttatttgcatagaggtgtttatagtattctctgatgttagtttgtatttctatgggatcggtggtgatatcccctttatcattttttattgtgtctatttgattcatctcttttttcttctttattagtcttgctagcggtctatcaattttgttgatcttttcaaaaaaccagctcctggattcattgattttttgaagggtgttttgtgtctctatttccttcagttctgctccgatcttagttatttcttgccttctgctagcttttgaatgtgtttgctcttgcctctatattgcatttacaaaaaagtagattgtctcttcctccttgctactgcaaacaatgatgtgaggaacatcctggtactctccagggtatgtactgaggggtaggattgtagggtcatcaagcatacacaccctgatggtcactaaatcctgccagatttcttcctggaatggctgcaccagtctgcagcccaccagttgtgtaagaacactcctgctgccctacttctttgccaacattttatatgtttagactttctcttttttccaaactaatgggtgtaaagtggtatttaattttaagttgcatttctctgattactaatgaaattgagtacctctttatattactagttagttatttggctttttattgttgtgacgatttaagatttcatgttgatgtagatcttaattttgagttggtcaaacatatcactttttaaaatcttatactttataattttagggcccagggccacagagttattttctgacgttttgttttctgttagtcacatttacattcaggccttgattcatcttgtggtcacctttggttatatcagcatcgtttgaggtagcacattcacactctcaaatacagtgtgatagtttggtatgcactagagggccatgctgtatcatggattcattttgaaagagtatttaatgaaaaatataaaagaaggctattcatagcatattgccatttatgaaaatttaaaacacacacacatatatgtaaaacaacacttaatatttttcaaagaaacactccatatccaaagacagatgccagacaattaagtttttgcttatgaaggtttaggaggaaatgggggagtagtgataaagggggtaaaaaaataaaataagccaacagaggccttggacagactgataataatagtataccctgaattgaggagtatgattatccccacagtcagggtgaatataatttaggagagatgacctcctaataggttagtgatgagcaaagctggaaaaagttaattgaagaaaagtagaaatcaaatatttcagttgttctgaatcatgagtaagatgcctataaggaagaaaaattctcctaaatgactacatctggtcatgccttcttagcttttaaagtattttgtgatacacaggaatttatgtttttttcctgaggtgaagctctctgtaagaaggaaagcagatgtttctttttaagtgcttgtatacacctgccacaaggcagactgagtagttcatatggagagcaggctcgggttattttttatgttgcttgtgaaattaaaattcttttcctggcaagcataggtttataattaagtaatttatcataagagttcttttagctatatcaaaaatttgatgatatacagaagcaatatgtgagtggttacttagaaattagatgaatgagttatttcattggcatttatcatttgatgtgtaggtttttcctatttataacaaacattgaacactgactaattacctgcaactgaaagagggttaaaaaaaaaaagtcttagttgagaactgtattctcaacttattttcaacccaccagtgctcttgaagagtatgatgcactccgattaatagaagttgtgctctcttgggatcatgcttaattgtgttacaatataaagaagtcttcctccatggtatttatgggtatgaaaaaaaaagaagtctttctttgccagatatggattttgtacttccctcccttcaatttcatgtatactgttttttgtttttatttttctgattagttcccttggtatctgccctgccccatccccattcattttggtattcacatacccaataccatagtagcactttatatttactttgtttacgcctaattacagcctgcatattctagataaaacaaacagactcagccaggcacggtggctcatgcctgtaatcccagcactttgggagcccgaggtgggcggatcacgaggtcaggagatggagaccatcctggctaacaaggtgaaacaccatctctactaaaaatacaaaaaaattagccaggcgtggtggcgggcgcctggagtcccagctactcgggaggctgaggcaggagaatggcgtgaaccagggaggcagagcttgcatgagccaagatcgtgcctctctccagcctgggtgacagagtgagactccgtctcaaaaaaaaaaaaaaaaaaaaaaaaagaaacagactcagaaaggttaagtgatttttcgagggccatagagtaataagtagcagaaccagaatgtgaagccaagtctaactctaaagcccatctttttcatacttgactatcctatatttttcatggatattctacaaaatccatatttttatagagtatgatgtcttcattacgctcctcaatctttgaagaggattttaaccctgctctttggttcagctattgctgaatattgacacctttaagctgcaccatagaaaatttgtattcaggctccttttagagatgagtacttcgaactctctgctatccagttgctcaaaagtctgtttccaaatgtatttatagaatattgtgtgaatgacttattctccatccatttttctggattgtctgcattttagtttcaggccaagtcgtaccgtccaagagctatgtgcttaactcagctgcttttacctcttgcagaggtactttcttccttcctcctactccttttcgatattaaatcactggccttcaatgatggatgttatagcaaacagctgaataaaattcagtattctttctgtggttgagctttcattgaggagcccacctagtacaccacatcccatcgtttttgagaggacttacagatgaaattcttctcagatctcaaggtcaggaaacaacgattcatgtttttaaaatgcttattatgaatcttatatttgattgtattttcctctttactttggttgccaggaaggctagagccaaatttgcaagatcatctctaatagctgcaaaggaataaatgatatgtgtgtgtgtgtgccagtcttactcctggcattattttcttatctatgttcctgtttgatttcatctttcttaattatttattttgtcagtaatgaatgaattgtcataaactgccaaaaatcattatgctggtgatggatgcaaatatataaataacatgtgtaaggacaattaagctttcctgacttgatagttaaatctcattcctcctagaagtatcacatgtatacatccatcttcctcatttgtttttctcctttattttacttcctacacattttcagttgtttattatggatttctctcttgatgaatgcattcatacaattttagaattgttgagtatcaatataaaaagctattttttctgaaaattagtctccttataatttgtatttttcttaagttcatattttttagtaaaagtgtaaatttcataatttttattaaaacatttgcctccctaaagaaatttaactattttggttttttttttaatctgagaataggagtagggaaatttggagtctctaaggcatgccatgtagaagtttttgaacatttatatagaatggattgactttttctgcttgttcttctgtctgttgcctagtagatgtctctaactggatattcaaatgacacttcagaccatctgaaacttcacgtattatttccctcccaagtaaactagtcacccaaaccatatacacaacagtcagactcatttgctcacagctttaaagcaggttcttttccatttccactgctattacctattccaagtgccttgcacaactttgcctaaggagacactaagaattcttcattgaagagatgaagaaatgaatgaatacagggatgagttttcttcatttcattgcttctgtctagaccactggaaaaacgtatcttcctttattctgacctcttctaattcatgttctacaaagttatcaaaatgttattcttaaaatgcaaatcattcttaaaatgatatacaaacacacatcattccaggattcatttagtttagtgccaaggcctttcatgctaagttccctgcatctttctggtcttacctcccaccatgtctctttactgactttgttgcatcatcacgtggctgcatactccatttcctcccatgtgctgttcattctgcagaacatctcactgaagctttacctggagaactctactcactttgcctgtcggattcagatgtctttcctacttgttctcatagacatttatgtacagtctcgtgactcttttcatattaaactgttatcatgactgacttacttatctaggggctttctcttaatcaacacaggttctttattcctggatggtatccaacattccctgaataaccagtgattgtttattggctgtttgactgaatatagaatagaataagtctgtagcttatagtccattctaaccactcattcttttcataacttttattgagtgcttactatgtgccagcttttgtttaagagattggcaatactatagtgaacaaaatagtacctgcccaggcaattaaaaagtaagcaattagacatacaatgttgggtagcattatgtgtatattaatccagtttcactctgctgataaagacatacctgagactgggtagaaaaagaggtttaattggacttacagttctgcatggctcgggaggcctaagaaccatggtgggagatgaaaggcacttcttacatggcagtggcaagaggaaaaacgaggatgatgcaaaagtggaaacccctgataaacccatcagatctcgtgagacttattcactaccatgagaacagtatgggggaaactgccccaatggattcagattatctcccaccaggtccctcccacaacacatgggaattatgggagtacaattcaagatgagatttgggtggggatacagagctaaaccatatcacagtgttaggaagaaaataaagagggataaggaaattctagagcatatgctcaagcaaggcatatctaaagagggagcctttgagcagagacctgaatgcaatgagagacaagttgtgtccatggcggtgttgctggggaggtggttctgggcagagagaacagcatttctgtgctcctattatgtaccaggctctgttctaggggttctggagacagcaatggagaaggttgttaaacatcagcattgtttattatttaaccatgcagtctgttctttttcaatattatgtcatagttcaaaactcctcctttctttaattgctaggtttaacgaagttgaaaaaccctaacttgggaaagtctctttgttctccccagctgctaatcacttcctactctttgttgtggaagagaacacataaagtcttattatttagaggcccctaacagaataggatactggtcctggggacagatccccaactatctgaatttaatcatgatgctcagggatgtgtgaaagtgtcttaggtgttcatgtctttgacgtttgacctaggttatagatgtctgtgaaattctgtcaccataattagatatagatactactgatttccttttcccagtcttccaacccagcctatgaccctgagtaaaaccttcttaaattcttttacttcagtagcacacaaaaaatcataattttggatcctgttccttgctctgtcacctgcttgctgcagttaagtctgctctgtggcagttttccatttgcaagcagggcacccttccagttaagttgtaaaattttatgtttaagtaagcccctgtgcccttgaagaataggagctacaggaatgtagagtccaaagagaaaaaaaaagaaagagcattcctaagaaaactgtgtaaatttgcaaattcgttttcttctggtggcagctgacaggtggaatgacaacccaaccaagtaacactaggcccttgtgataggagggaacttaatgctgcggttgttctgcttagatggaattgtgtggggctgtgccaatgcctgtattgagaaagcccagtcgagcagaagagtttttggtttctgcatttagaactgccgaacaactgaggaaaaccgattaaatctggaaggtggcagctcacttgacaggcttctccaggcacctttgaggagaatcaaagataaataaacacattttatgagaggagtatggggtgagagggagtgtttggacaagagttaaaatttcaaagggagggggaagttctttttgacttttctcctgattagactcttgcctcatgtctttgttaatgtacaaattagagtttgtccctgtctacatgggtaagcttgatgggaaaggaagaagatagaagtatattttcaaagacctcaactatagaaggtagaaggaaactgatcaaatatgaatttctttattagaaaaaagtggctttaaaaactattttataagtcatattggatactcatgtgcctgtggaacatgcaaaaactctggcctgttgcacagaggtttgattttgaaactgtctaattttatttatttaaatttttttagagacagggtctcactgtgttgcccaggctcttgaactcctgatctcaagcaatcctcctgtctcagcctcccaaagtgctgagattacaagcatgagccactgcacgtggcccaaagtctgtaatttttttcagtaaagattgatggactttcattacggcctggtctagtgtgcagtgagttgccttgaggtcaggtagtacttgacaccccttatttactgggtatggaccctgttctctcatccttccattgtgctttactctttttttctccgtgaacaatttttacttgagcttgacttacctcaaaggggctatgaatattgaattggctaaaaataattcataacattctagatatatggagccttagagatcattgccctcttccccattttgcaaagagtaaataaagtgaagcccaaaagtgttaaattgctgctggcctaggggcattcagctaccaaatatgtatgcaggaactccacccagatcctgaccacactattagtctgttctcacctgctaatgaagacatacctgagactggtaatttataaaggaaagaggtttaattgactcacagttctgcagggctgtggaggcctcaggaaacttacagtcatggcagaaggggaagcaaatatgtccttcttcacatggtggcaggagagagaagaatgagctaaatggggaaaagccccttataaaaccatcagatctcgtgacaactcactcagtatcacaagaacagcagcatgttgtaaccacctccaagattcaattacctcccaccaggtccctctcatgacacatggggataaggggaactgtaattcaaggtaagatttgggtggggcacggccaaaactttatcattccacccctggcccttcccaaatctcatgccctcatacttcaaaacataatcatgccattccaaaagtctggcaaagtcttaactcattccagcattaactcaaaagtccaagtccaaagtctcatccgagacaaagtaagtcccttctgcctaagcctgtaaaatcaaaaacaagttagttactcctagatacagtgggggtacaggcattgggtaaatacacccattccagatgggagaaattggctaaaataaaggggctacaggccccatgcaagtccaaaatccagtaagacagtcaaatcttaaagttccgaaatgatctcctttgactccgtgtctcatgtctaggtcacactgatgcaagaggtgggcttccatggccttgggcagctccacccctgtggctttacagggtacagcctccctcccaggtgttttcacaggctggtgttgagtgtctgtggcttttccaggtgcacggtgcaagctgtcagtggatctgcctttctcaggtctggaggacagtggccctcttctcacagctccaccaggcagtgccccagtagggactctctgagggggctccaacccgacatttcccttctgcactgccctagcagaggttctttatgagggctccacctctacattagacttctgcctggacatccaagtgtttccatacatcctctgaaatctaagtggaggttcccaaaccccaattcttgtcttctgtgcatccataggtccaacaccacatggaagctgccaaggcttgggacttgcactctctgaagcaatggcctgaaatgtaccttggccccttttaaccatggctggaacgaagcagctgggacacagggcaccatgtcccaaggctgcatagagcaaggaggccctgggcttggtccacaaaaccatttttccctcctaggcctctgggcctgtgatgggtggggctgccatgaagacctctgacatgccctggagacattttctccattgtcttggcaagtaacatttgactccttgctacttaagcaaatttctgtagtctgcttgaatttctcctcagaaaatgggtttttcttttctattgcaattttttaaaactttatgctttgcatcctttttaaacatagattccaatgccaaaccatctctctcaagttcagggttccccagatctctagggcaggggcaaaattccaccagtctgttttctaaagcataacaagagtcaactttgctccatttcccaaaagttcctcatctttgtctgagaccacctctacctggacttcattgtccatatcactatcagcattttggtcaaagccattcaacaagtctctaggaagtttcaaactttcccacatcttcctgtcttctgagccctctaagtctctaggaagttccaaaatatcctacgtttttctttcttcttctgagccctccaaactgttccaaaccctgcttgttaccacttccaaagttgcttccacattcttgggtatccttatagcagcaccccactctactggtaccagtttactatattagtctgttcttatgctgctaataaagacacacccaagagtgggtaatttatgaaggaaagaggtttagttgactcacagttccacagggctgtggaggcctcaggaaatcatgacagaaggggaagcaaacatgtccttcttcacatggcagcagaagagacaagaatgaacaaaatgaggaaaaagccccttataaaaccatcagatcatgtgagaactcactatcagaagaacagcatgggggtaaccacccccatgatgcagttacctcccactgggtccctcccatgacacatggggattatgtgaactacaagaaaagatttgggtgggcacacagccaaaccagtcaacccccacaccaatgcatgtcttttgagttgcttagagctcaatattgcataagtggactatagcagtttactttattgacttataaaacataattaataaaataattaaatgtattccctgtataattcaaaacctcaggagttatcataatagtttcaatctctttttctatcatacctcttatgagaaactagaaaataaattaccactttgagtttcagtttgtgtttattttcttgccatgaagagtatgatgataaaaaaacataaaatgaagtggcccagaggcaggcaaccagaaggtgaggaacaaaaccaaaagtaatagattattagatgccagtaactaagattctaaattattactcttacgaatatagtgtgggttgctttaactatttcgttataatgtttatgtctgcacccatttctcatttctttttcctagtgtgcaaagttaatttaaagtgttagtacaaattgaggaagggaagtctctccagatttcattagaggatagactgaataagaacatgtcctacccgcaaggacaaaggagaagaaaatatattcttgactgtttcagaccacttcagataaggaggagacaatttaaaaaattaatttaaaaaaacacattaggatcaaataacccctccaaagaaaggtgttctatggatgagaaatgtaattactgctgtaaaaatgtagggaattttgcacgtttaatatagtttgtctcctattagaagcactagttggcatttttcagtattagggttgtggcttgccaggcccaccctcctgctgtgtttgtttcagggaatagaacttacccagtcgcaggtttcagaagagctgaggtaacctccttcaatgtgacacaagtactgtttatgttggagacaaatcccagaaactcaaggtaacaacgtacacagagtgagagagtatatgcaagagatttttatttggcatttttactgctaacagtctacagaagttttagtatttagtgccagttcaggcttaaggggtagtttctatttctgtgtgattttgaaaggtttaaagaatcagcaaattattatataatagataataaagaataaagattctggcttctatggaagcttgcaaagatatgagggagggcaaacaactgcttctacgtgttttgttttgttttaagaactcaaaaaagcatggtaggttctttgagcaaggccttagttgtcaaaagtttctgaagccctcaaaccaataaatagtattattactaattaaaagagcagataaactgagaaacaaagcacttagacctagggtgacatggtgagaccaaaactgaattctgtgtcttaaaattcagttatctaatctccccacttcattgcatattctactagcagtcattcagtaaagtacctttcatcactgcaggagtctctctgaacacagtggctttggaatagggttatctccagacattgttgacatcatgtctctgctcacataccaattgagtgaatattggcccacatgattcttgtaagtggattacaagaaatccacgatagacttcattcacttttgatgaaaccaagaactttccctcttgagctacctaatgagatactgttatttgtttattatgcagggtacaggttggggcttgttagctctctgaattcttaagcactcaactgaggaaatcaaatgcatgattttactatgcctgcacaggagttggagaaattcataaagtttatactttactagttttcttaagaatacagatgtaaataggctgttaagtctgcccaggcagaactgttgtttcagatgaaacttaatgaccacaccctcccaccccaatggagattgaaacagttggagaaactttagtttgaaaaatatttactttaaactaaactccaggaatcttttttttttttttccccttggtgagaaagatattctcaggtctattcggagatagcaatatctttaaaatcatgcaagaaacaaaatttcggagcttctcagtggttaggaatagcttcggacaatttacctaattgggcttcagtttcctgacctgtataaaacaagaggattggtaaatgctctccaacattgcttgaagctcctaggttctctggttactttgttatcgtcataaaatgataatttaaaaattgatgtatatgcatgattttatgtatgtatgttatatatgtatgattgattatacttgcctatgtatggaaaatttcaggttgttaataagaaactcgtttcttttggagaggaggactatgggcctgggggtcaggatgggagaattttgcattattttatactttctgtttgcttgttttttactaagtatgcattgtttaaagattttaaaaatagattggttttgttattattttaaaaggatgaaaggaagactttcaaattattgtaaaatctatacccaggataataataattggaatttcatttcagactccaagtttaaagtatttgtaattataagtagacttttgcttttattatagtaagaaaagtcttttaaattctcttcttcaatgaaagcaaccacttttgtttggtgaaacaagcagcatttacaagcacagaaacaaggtttagcaatattagtgacaggattatataccttctatttattgggtcctctaaaagatcatcttcctttgatttgcaactatgggaatgaaatagaagtgggaaaaattagcttttaaaccaattagttagtaatgactagtgccaagtttaaagtgtttcagagtgttattgcggtgttttaaatgtaaaacactagctccctcttaatctttttagaagataaaactgcaggaaatgaaaaagtggtcagttgaaacagcagaaggcattttagaggctgcatatagtaactggacttggattttggtttgagcattcgttttgttctattttcctatttttacaaatatttgtattaggttttgagaaactataagaacccagaaactagatgtttctagcttgacatatttgtggggttctttttatttttatcatttctacttttgtttcttacttaaaaaaatgaacttaaggaaatatacagaaaaaataactcaacaatcattttcatttaaaaaaaattagagtactttctagcatggttaatatatcattataatcaatatgaagtagatgtggtaggtttttttatttccagttgttctgtcaaaccttgaacattttgccctatctggcacaatgttttctagccttttccatattcaacaatgtcaagtaagtaaaagttaatttaaaatgaacttcagtgtttgtgtcacattggagttgttaaagttctcctttgttctttccaggtttgcattgcctctggctaaatttatttgtatttccattccatgcagggtatggtagcactgtgattcagcttacttagtacttcattggaacgttgggttatttatgctaaagtcaataatctcatagtgatgatgatgatgataaccattgctgtcacttattgagtccttacttttggtagatactacattagacttttaaaaaactcatttaatgggtattcattgaacaccttttatgccccaggcattgatttaggagccaaatacataatagttaacaagacaaagtcctggcccataaatatattgtttctaatccacataaaaccttgcaaggcaggtattgtcttaattttatagatgagaaaactgaggctacagaaggagaacaaagttttcagcattttatagcctgtgagtgaccagtctatttaattccagtctgtactttgctctgttctcctgcctcaagatagatcagtattatttccctcttcattaagatgtttataaacattcaggactggtataaacatgcttggctatgacacagttaagctgacagggatataggatgtgaagtctataaacaattattccttttttaccttagtgctccatgagagctagaagagacgctaaaacctagtacttttcacatcaaaaaacgtaaaatactaaggaataaattgaacccccaaaagtataagatttgcacactgaaaattataaaacattgttgaaagaaattaaagaagcctaaataaatggaaagatgtcatatattcatgaatcaggagacttaatattgttaagatggaaatactatctacgtggatctacatagtcaacaaaattcctatcaaaaccttaaccaatactaaaattcactgggatccagaatagccataacaatcttcaaacaatcttttaaagaagaagaaagttggaagactcatattttccagttttaatactcagtataaaactatagtaatccaaacagtgtggtcctagcataggataaaaatacagatccatgaattataaatgagagttgggaagtaaactttttcatttttgattaattgaatttttacaagggtgccaagacaattcactggagagtagtctcttcaacacataatactgggacaatttacagccacatacaaaagaacgaagttgaattggtactttacagaacacatcaaatggatcagacacctaaatgtatgatctaaaactataaaactcttagaaagaggccatagagcacaatctttgtgaccttgaaagacagtccacagaaaagaagaaagtaattgcaaatcttacatatgataagggtctagtatccagaaaatatggagaacccttataatataccaatagaaagacaaataattaaaagtagattaataattttaatagattttttccaaagatgatgtgcaaatggccaataagcacatgaaaatatgctcaacagcatcagtcattgatggaatacaagtcaaaaccataataagataccactttttaccactaggatggctatgataaaaaagatagacaataacaagtgttggtaagaatataaaaaaaatgggaactcacattcctcaaaaagttaaacatagagttaccataggacctggcaattccacacctaggtatatacccaagagaactgaaaatatgtttacacaaaactttgtacataaatatccatagcagcattattcataatagtcagaaagtggaaacacctaaatgtctctcaactgatgaatggataaacaaaatgtggtatatttgtacagtgaaatattatttagtaatgaaaggaataaagtagtgatacatgcgtcaacatggatgaacgttctgttaagtgacagaggctaatcacaaatagctagatgttgtataattccttttatacaaaatgttcagaataggcaaattcatagagacagaagagagataagagattgccaggatctagagagaggcaggaatgggaagggacagtgactactaatgagtatcgggtttcttttcagagtaatgaaaatgttctggaattagatattggtgatggttataaaactctgtgagcactctaaaaacactgaattatatactttaaaagggcgaattttatgatatgtgagtaatatctcaataaaattgttacgtatatattttttaaacctattaatttggcttcggtggtttggatttagtccaccacttcaattatctgtttgtgtctgggttattgcaattcaagtacaatatagtctcaacctttattgtctatgaggatcttcaattttcattattttatcaatctgcttgtctattgccttactttataccagctagacttattatatacaggcaaaaactgatacagagcaatatgatatattttcttcttgattccttttttaaaaacttaatgttatattacttttcaaaccaagagtggcatattgttgtaattatatcattaaaaaatgtgtttattttcaagagtatggatttgatttagaaactgcttttcctgcattctctattattcatggcatttgatgaccacacacttgaagtgctccctggccagagcgtaagagtcttgggggtggggtcagtatagaaatgattaatggtttgttaaaatgcaggcaagttgaatatgacttttataatgtggctgtgagaccagcttatggtatgaattcatacatgtctctctcttttgtaaacatgttatcgaagtaggttttatttcttgaatgctctggcctggtgctaatgagatgtgtgagtgtcctacccaaagcattatgtaacaggaagcaaagttttctgagggaaataagaagcttactagaaagagaagataaaatctttgctggggaatggttcttttccattagcattcccagtgcatttctccagaagtgtgcctaggaatcctctgctgtagttgctagataatattccctctttttcagggtgattggagaaagaaagcagttatttggggcctggagtatatagatagcaaggagccatggttctgaatgtggtgattggcccaggcattcttgctagtgatggaaatagagggctgaacaggaaagagtgggcagcagtacttgataacatgaggcactggtaataccaacttcatgtctggtcttcccatttaaaatggattatattttagcctctcgtcagattgaatgctaagtatccctacagtcaatgcctgcaaaatctttggcgtacttacttcaaccaaaacttaaactcaaagaggaatatagtgtaaactttggtttaactgaacatagaaagatcacacagagagccctggttttattgcttggaaacatgatgagatgtaagtactgtcaatagattggagactctaggcccaaatttcactgaagttcataaatgtctgctaatttcagggaccatcatacttaggagctagtatactaagaaattggaaagtaagtttaacatgtcttttgtgaaaggtggaaatttaagatagggacacagctgtctgcaagggacagtaggcttgttttttgaggcactctgtggcattcaagatcctaggggatttgaaactcagagaatggtacagtgaacataagaggggtggaaaaaagtggaggatgaagtggttatctgtgtcaaaaggaactgaaaggtgttcatactgttccacaatcccctcttcttaccattattagttaggtaaagagacaaaactgaatggcttccctttctccatctgtctcaagattgtttcctgccttggttgaaaggaaaagagggagggagcaaagtggcattacttactttggtctctctttttagatctttgggtcccaaaagtcttattggtgagaatatctggtttcataagcagaagtgggaaaaataattattactacttattgaacataagaactgtgctaaacaccctaataacattatttaatccgtacaacttttttgtataagcatttatctataagttaatacatgtgaagcacttagaacttagaatgagagcccattaaatgttaatacccattttggagataagagaactataccttagcattggtagaattttaatacatgattgttaaactcaaaagcccatgatctattatgcgatactgtggctctcttccttaagaactcagcttcctttacaaaaatcttccctgatattctcctctatatgcatttagaatcatacctgtttttcaattctatattttgactaattccaggttgtcagtcctaaatcctcttactctccctgcacttatccctgaggaagttcattcttcagattatcaaggtctggaccaaatttatttagtgagaatgtggaatttttcttacaagattttaaaatgacaagtaagataattacatgaaaggatctgtctaggctctttttgcattgtagggggtggaccaagtaacctttggatcacttccacttgtataattcaccatttcggcaggacagtaacatttcaggccaaagttcaacttttttttattattaaattcttttattgtcgccaggaaactagagaaaatgaattcttcacagtatgcttgtgcatgcaacttgaaacggtttgcacactaaatgaaattaaatgaaagacagctgtttgagaaagagctgtcagaaactgattgggttctattagagaagaatagaggccaggaataagttttcagaaacaggatatcagtggttttaaaagcaagcaaatttatacacacaaaagctctcatgtggttgtgctgttacatgtcttttcagttcatccatcttaaattatttgcttttggtgagtaggtgtctgctttcaaggctttctttcacatattgaatgtgtgacagttctctcttttctgagaagtaaatacaacacaaccccactacaataccatcctacgtactttggttttgggtaaactgaaaatccagtaatgttcaccaaactacttcctttgtccagtacctctctgttcctgccaaaatacaaagggaaaggaccatcttgggcaggttgccagaagtgccacctgggtctcctgaaatggctgtcagcaagaagggagcaattacatcccataacagactcaaagcagatggtcacctgcggtgataagtattacattattaagcctttgatttgtgattgtactttgtgctttccaggcactgaagttatgttacttgtgcgatgttcctctctgttcccctagacctcattgctcgttgtttggccatgtgttcccatggcttatcctccaaaaagctttattctgcaatcttctaactctcctgcaagaggctagctcataataggatctctgccaggccctccagcagtaggtatggtgttattacatggagttacctttaaaggaatttttaaaagcctttggggctttactgtggaagcataacttagtcacagtataacctcatataggaaattcagttagtgttcagagttaggagtcctagtataacattgcactcattgagatttagtctctggagtctcttcttccattgaatttttatgttttcagccctatttaacaatggtcttccataatgcattgaggctcaatctcaactgtcctcctttgagatctcgcttgccatcccctccacaccttctttattttctgaagatttagaatacaaatttatagtctctcctatagctgaagttaggagtcacttgattcatagggtgcctagctccctggactaagatagatggcagaatgtgcgtagagatacatgatgacacagtcacaaatctaattcttcatgcagatagtctttcaaaattcttagcaaattttaatttttaatattgtgagcctcagctgtagtaattcagatttaattatcatgtgatcatgctggggtgattgtttttagtgcagacataggaaatcaaagttggcagctgggctgcagctgtgccccagctggttttatctgagttgaattcagagggagaagtggcagcatgctcaccagctccagaagatagtcttctttggtcatacaaagcaatacctgctagatgctttttgagctagtgcaattaacacccaattagtgagacttcactataaaggtattaagaacatagtccatgtgtagtggacatgtcatcattgtttctttacaaattaaataaacttgctacgtagaaaatttactttatataattagacagtgttttccctaaattacaaaaacatgctcttaaatttggctgtcttaaagttctctgaacttgtaagattttgacctaccatatctaatttttgcctgaaaatattttatagatgctgagtacaatagcatatttatgtttaaaaatacgaaattggtttattgattttttaaattaattcttactagaatttacatcagctacttctggctttcctgcaggaaaagaattcttgcagcttagattaatcaatattgtccctattgtaaaagacactatattgaaagctgtaatataattttcaccatgcataataacaaagagtgtctaatatccataattattaagaattttacccatcgaagaaaacaactcataagaaaaatagctaagagttttgaacaagtagttcatagatgaagaattataatttgcaaatcataaagtcactaatatttaaagaaatgcacattttagtatgttctacaagaaggctcttcctcatgcattaaactctcaatgtaaatgtgatacttaatgaggctggtgcaaataaggaaaggttccctcataccaggcattcctacaaattctcttgggaatgagttctcacagtacgacttctggttgaaggctttcccatatacaacatattcatatgatctgtgcaacatgaattctctgctttatgattagagctgattactgtgagaaggctttatgactttcaggaaacaaataagtttttttttccatatatgaatgctctgatgcatactgagaactgattatctggataccagggtgactgaatggagcccttatcacagtcactgcattgataggctttatcttaagtatgagcatgctgggtttcttcatatttgacatttgaaggcttcctcacagttagttcacatataggtttctctcctgtatgaatttagtaacgtagttgaagatgtgatttcttagcaaaagacttctcacagatgccgcattcatgaggtttctctgaagtatgaatcttctgatgagtaggcaactctgatttctgtctgaaggcccaccaacattcagtacaaacaaagagtttctctctagtatgaatattttctgggatgaaagaagacttaatcttttggtgagagttttccacactgaatacatatatatggtttttctcctgtgtgaactcaactgtgccctaggagttgtggtatcaggcttgttttcttattttattctaaatgcttgtgatcattgctagtgacagccttctagtcctgagccacagccaacccttcagcctcactgaacaatgtgattggtactagattatatatatttttgttttatatttgaatatattaaggtgaagttggattattttctgtcacataattgaaatggttccacattacattattggaaaatcatttgttttatactgacccattacctgatattttaccattgaatggcatttttagtatctttgtgtgattgtctttcaattgaagtttttgagggatatatgcagcattttgtcattaaatttgtgcagatacatatgatggtttctctgttatattttataatatataaaacgtgctaaaattgttacagcaagaatatttgttttcttaatcttgttactctcattgtgataagtttcttattatcaaaagtggcctaaatagttatcaacttatgtttcattgtcatgggtttaatgtacaaatagagatattattaatagtatttcccaagtctttaatatttcatttttattggatgtgagatcatctgccagagataattaatttcatattatttgtgtaagtattatttattgagtgttaatacatagcagatactgtgaagaatattttatgtaccatctcatttaatcatcttagtaatttttagtatgaaactaggttttcttaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataactcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcgtgtcctttgtagggacatggatgaaattggaaatcatcattctcagtaaactatcacaagaacaaaaaaccaaacacggcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaaaaaaagacaccaccattcagaacacaaaaagctacagaaggtccaggctactgaaaagcatcaagaccaagctgttgtaagtcaaactgcttttatgattgcattctttgatgaagacaatcccagaaaaagaaggtcatattctttaactcaaagtgcgggaatcttgtgtcagggaactacatattcaacaccacatacaaaacttgagaaagcaaagtcttcaacagcagatgccaaagtggtttctttgtctttacagactagctctgtgcatcacagagtggggcatggtgttccacatgggaaactgttaaaacagaaatcagaggagccatcggtgtcaatacccttcctacaaactgcattattaagaggttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattcacaaggtaaataattgaaatttgagtgtgatcttagttgttgtgtggtgtatttgactggtggaaattattggagagtcagcatgagatgttgtcatgcagtcagtggtatgtgaattttagggttttattagggaactgcaagactaacagtaagaccaacatgctttgtgattttatttgctgatattctgaatttacctgagtttcatacataaagctctgtacatttaaaaggttaaaaaaaaaaaaaaaaagaaactaggttttcaagttggtaatggtttcagactgtctatgtaaagcataagtagcatgatttgaagtgattcattcaaaaaatgtataaaatcagagtaatagaagctaaattactcaaatcttgctcagatataaaattttttttcagctttcataggaatctgcccttcgattagtgagaaaatacggtcttctgttgaagcagagaatttgacagtcatgacattatattgtgaacctttaagttttactgctttattttctgtaaattactacatttctatagtaatttcgcagtgtaaatgctgaatgaatgtgattagctatatttgcaggcttagagcatctgtgaatacttcctggtttttggttagttgtgtttattcctagttctatgtcctattgaattggactttgcttatttaaagaaaagtctataaagctacaggcaagaaaagttggaatttcttccttggggaaatctcaaatgtagagttttaagtaaatattaaggttcaaaatgggcaatataatgagcacatttgaggaatttgtaagtatttatgtaacacttcatgtttacaaaatgttttacagccatattcattaatttacataagtcccttggaaggtaacaatgttattacatgtgttttattaagcaagacaggtaaaatttaggcaaattaagtggcagaaaggaagagacattaaaacatttattctgtgacttgcgcctatatcatagagcgtgctcctgcattagggaaataaagaaataaaatgcttctcttttgttatagacttgatcatggtgcctatttgggtaattgtttatatatattcatatagttttatatattttttattttttgattatgagacacaaaggccttccaacacaaatttcaatgtatgaaatatctcaacttaatagctgaaggataagatcctgggttataaattctccattaaatgttgcagttatcatgatcaacagattggtgaatatgtctggtggctgctcagtattggtctagatagaatatactatgggaccaaaaaagatatgaccgtggagagctcactttggtggccacacactgcctgcaggctgcttgttctctgccactctgttttttgggaggactttcctttccctctcatagaatagcaaatttctgctaaaaagtaataaatttgctcaaaatatcaaaaaggtacgattagaatatcttccatagtaaaagagattaaaaataacctagactcttgcattagaaagcagagggagacatgacaaattattgcattcaattaacttttcttttacttactgagtgcccagaaattgctttaacaccctgaggtgtgaccataaggtaatgaggagtgatttttaaaaataaatataccataaggtacactgtttaaatgagtgctattcttcaatgtagccactctttacactaatccaacgatgctgtcattgcaagaaatatttttagaacttgtcctttcgaattgccgttagaagccatttatggactatagaagaaaacagtctcacattgacttaaagtcgcactacattttttaaatcaacccctcccctgcaaagaaatttattacccaaatagattactgaccttttcactaacctttgttctgcatttttttcttttcaaaatcagttctataatttaaaaaataacaatttgccatcaacaaggatatttatttcctttttattttgaaaagagttattaaaaaatctatatcagaaaacagtagacaaaatagtagtttccatatatccttcacccagttccctctaatgttaacatctaatataagtatagtacagttaccaaaatcaggaaattaacaccaataaaatactatttggtaatcagtagacatcatttaaatttctccaattttccccactaatatcctttttctgcttcaggatctaatccagcatcccacattgcatttagttgtcatgactccttatgctgttccaacctgtgacagttctaatgaggacatttaaaggaagtgtgcccctcgcccaccaaaaggaagaaagagccatagactctgaatgtaattccaaaaatatctttgtctctgtagctgtcttgtcaactatgtcttttatttattggattttttgtaacctgtgtaccaaatttatgcagattgcagcaataagaagaagggtaagatgtgcttgggcacaaaggagttgtgaggacaacacatctgtccatagccattgtgcaggtgtattttgagctctgcggatttttttataatgctttcacatttggttcaaaatattttaaaatcttcattatgatttctcatttgatttgatcctcatttataatagctcgtgtgtgtgttgtgtgcatgtgtatgtgtgtgcacatgtgtgtgtgtgtgttcattcatttcaggaactttatctgttaaaattctttgaggccagtgtttaaagtatgttcttcaagggaagattcctatttgctcccatcagatgcttgtgaacacttcaaatgcaggggaaccgccaaacaagttctttttttttttattgagacaaagtctcactctgtcacccaggctggagtgcagttgtgcgatcatggctcactgcagcctcgacctccctggcctcaggtaatgctcccacctcagtctccccacgtacaggcacgtgccactcactaatttttctaatttttttttgtagagacagggtgtcaccatgttgtccatgtagctgagactataggcacgtgccaccgtactcaactaatttttccgatttttttgtagagacagggtctcaccatgttgtccaggctgcagttcttgatgttaatttctttttttttttttacaactattttatcatttatttattttttattttattttattttattattattatactttaagttttagggtacatgtgcacaatgtgcaggttagttacatatgtatacatgtgccatgctggtgtgctgcacccattaactcgtcatttagcattaggtatatctcctaaagctatcccacccccctccccccaccccacaacagtccccagagtgtgacgttccccttcatgtgtccatgtggtctcattgttcaattcccacctatgagtgagaatatgcggtgtttggttttttgttcttgcgattgtttactgagaatgatgatttccaatttcatccatgtccctacaaaggacacgaactcatcattttttatggctgcatagtattccatggtgtatatgtgccacattttcttaatccagtctatcattgttggacatttgggttggtcccaagtctttgctattgtgaatattgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgtcattctaactggtgtgagctggtatctcattgtggttttgatttgcatttctctgatggccagtgatggtgagcgttttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcctattttgtaggttgcctgttcactctgatggtagtttcttttgctgtgcagaagctctttagtttaattagatcccatttgtcaattttggcttttgttgccttgatgttaatttctaagctgcaggtttttaggccatataagtggtttaagtttctagccctaaatcacattaggcaggttttagatagaaattctcattagggcagagatctttgttacccagtgcctggaaaggtgcctaacaaaaactggccctcaatacatattcattgaatgaaaaaatgaatgaatggggaagacccttgtcccctgccttttttttcctgatatattcagaaccacatctgagaaggacaggtcttctgcttcaaggtgggtttttttttcttagtttgccaactgagggtgtcaccctttgggagcctggaagtctcaactttaagtaagggtcctcatttaatctcttgtcctgcttgggcccgggctctgtctgctatcctcccaactctcttgccatgtgcccatttagaacccaggctctagttcattaaggattggcaactgctctcaggaaagaatcctcccaagtttttttccttctgagaaatgttatttttttcagttgtttctggcttacatttatttctgttactctctggctgaaccatgcttaaaaagacatattttatattttaggtgtgatgtactagtcttctgtcatattgctaggagtgtgattctctgtaacaatttctttagagaaggtataatgtaaagtaaaaattaatatggaggaatgggttatagggaagttagtgtccctgagatcatgaaattatctctttacgcactggaagttatttttttctctcgtgtttcaagttagaactttttattatgtcatagattaatcacactgctgtcacttattgagtgactcttgtgcatcaggcattttacatatattatttctaatcatcataaaagctttgcaaccagacttagcagctttattgcaaaagtgaagaacctgaaagccagagcatttatgaaacttttccaattattccaggcagtgagaaattgtagtagacatgttttatggcacctgcttgccatgcttctaagaggcgttattcctccttgttgaggagtaacagccctggtttgtaccatatgaccccatccccatcttctagtcaagtgatctaaggatccacaatccttagcttggtaagtgccctcttgctaacctaaaaacgaaaaagtcaacagcttgctttatagggaattccagaagcatttccataaacttattaagccaatgatcacccttattcctactatcatttagtattgttatagtagcactagacaaaggagtcttacaagaaaaagaaattagaaataaaaaaaactagaaaggaggcatattaactataccttctaagtaatatgattgtatatttggaaaaaccaagtgattcaactaaaaaatttacaaaaataaaagaattcataatgacagattctgagaaagaagaacattgcggtgggactagaccaatttttgtaaaatgtattaagctacaataacttaaagactgtggtgctggtatagatagttaaatggaaaaaaatgggacatccaaaaataaatgtggaaggagtataagatatatatacatatcttatatatatatatttcacataagataatgttggcattgcatatcacaataaacactggagcattcaataaatcttaccattaggcaaagaaatggagttgaatttatatcttaagccttatccaaaaataaatccttgggggcaacaatgatttaaatgtgaaaaataaaatcaaaaaagtattggaagaatatctaaggttatttaagataatttctacattagaaagtcttttcaagtataatataaagcacagaagccataagataactaactttaaatactaaaaaacaaagtttatgcataacaagaaaatccattgtaagcaaagtcaaatgacaaatgaaaatctggagaagatatttcacatgtatcacaaaccaagactattttccctattgaatagagagcatctacaaataaacaagaaagcaatgaccagcgatgggtaaaggataaggacagatcacagaaaagtaagcacaagtgcttttaaaatttaagaaaaagatatcagacttccctcctgatgaaaattaaatggaaaacatgatatatcatattattgaagataaagaagcttgatcaaaactggctataaagggtttgagaaagcagttggttttatactttttggtggaatgataaattgttagatacaacttctgtgaaggccaatctataaaaaaaacttaaatgcatgtatcctttgactaagcaattccacttaaggaattttcctacatttgtgtttttcatttgagcaaaatgactgacataagtatagttattgcatcaatacttataatagcagaggactggaaacaacttaattgtcatcaataggagactgaatcagtatattatggtactccatggaatatactgtgcaacttgttaaaagaatgaagaagttctgcagtggtaatggaacaaaatccaagatgcattattaaataaagcaaaatgagaacagtatgtctaacatgctctcctttgtataaaacaaacacacacacacacacacacagacacacacacacaaatgcatagcttatctttgttgtaaggttgtttccaggggggggttttgctgtgtgagaaacaggaaaaagagactttcttttcagtgcaaatccttttatgttttatcattttcaggctttgcctgttccataaaaataaaattaaccatataaatgtcaggaatgatcttttcttttctttttttctttctttctttttttttttttttttttgagacagagctgtctcctccagactggagtgcagtggcatgatcatggcttactccagcctcaacctctcaggctcacatgatcctcccacctcagcctcctgagtagctgggatcataggcgtgtaccaccatatctgactaattttcttcttgatttttagtacagtcagtatcttattatgttgcccaggctggtcttgaattcctgggctcaagcagtcttcccaccttggcctcccaaagtgttgagatcgcaggcatgagctaccatacctggacaggaacttagtcttttaaaaagttagatgatatcagctgggcacggtggctcacacctgtaatcccagcactttgggaggccgagatgggtggatcacttgaggtcaggagatcaagagcagtctggccaacgtggtgaaaccccatctctactaaaaatacaaaaattagctcggcatggtggcgcacacctgtagtcccagctactcgggaggctgaggtgggagaattgcttcaacccgggaggtggaggttgcagtgagccgagattgcgccactgcactccagtctgggcaacagagtgagactccgtctcaaaaaaacaaaaccaaccaaccaaacaaacaaaaaactgttggttgcatttcaaaaatctaactgaaaagactttgtgcacaagcaactgcatggaatttcatttatccatcttggataaaaagcctagttggtcctgctatgatttgactctgtgtttcttcaggctctaagtattccaaaatgatgcattagctccctggactctctgtgcatcagagacctaggatgtgctatttaaatcatctggcaaattgatgtgtgggggaatggaactctttcccccattttttaaaaaaaattaaattttgtaatggtggcacattgtataataagcacatatgaagattggagctatcattttggaaatgaccttaaatagaaggaggaaatgatagactcatagtaccatccaacagtgtgggttcagcctattttccattcctaccacagagctgctgggtgactctgagtaagcagtttcatccaattttactgtaagcctttgcattcctaatagaggcacaatagtattggtacctgtcttattcagagagtggcagattaagaagactttgggtgatttctaacttctagcagccgtacacacgaaaaagtctgtacaatatagtgtgtttttgtactcagatatttcatgtgatggctctattttttgaagccatagaataattcttccttaagtaaaacagcaaactagctccttgatgtcactgagtttgtgaattattttcgttcattttgattagtacataggcctcacaagctattaaggagaaaaaagaagacaggttttcttattcttattttaatgatgagatatatacagttgaaaggaattatgtaaggccgggtgtggtggctcacacctgtaatctcagcactttgggaggccaaggggggcggatcatgaggtcaggagtttgagaccagcctggccaacatggtgaaaccccatctctactaaaaatacaaagattagctgggcatggcgggcacctgtaattccagctacttgggaggctgaggcaggagaatcacttgaacccgggaggtggaggttatagtgagccgagattgtgccattgcactccagcctgggtgacagagcaagactctgactcaaaaaaaaaaaaaaattatatagctttctcaagctctcatgagaaacaggtgacgaagtgaaattttcctgcataatgtcacattggatgagaaatgtatccttatttaaaatgttacatcagggagtcatatgctttatggtgcactcatgccagcagtaacattgttgagctccatatgagacacacagcaaagtggtttaaaaattgcatagggctgtagcattcatttacacaacattcaaaacaaaacaattactgaatcaagcaagtggaaatgcagaatctaagggggtgaaaaaagattgtcttgtgtttacttcttttttaattctctcattgtcttcagttgatattcctctcagatgccagatacctgtcattgttgccagatgactggactctgctggctcatcaaggggctgtggcagtgcttgtttccatgagagctggaagaaaaactgcaatggaaaagcacacgcagtcgttcataagtagctggctgtgtaattctcagtgccctgtgttcatctgaatgtgaacttaatctgatattgcttagaactggggcttcatcaatgcaaatgactgtgcttgcaagctgaacttcaatatttgtgagcagtggcagagcactttggttaatgtgtacatattcaggtttgtagaaaaaaaatctgtgcaatttgactgtggtcagtttagttgccaggagaattggatattcctgggaaaagaaaaaaagtgtctcacttctggagccattgtaaccatgtaggtatttaagaggtttttgttttgttttgttttgttttttcaaagataaatccctttttggatgattagtcagttgatcttaaatatcatgtaattggccatgaaaattgatggaaggctctgttcttagaactgtagctccattgaaactcattctcatggtgtcatttagaaagcaccaacgtcccataggatcacatgaaaacagagtctaaaggagttatcaaaatgatacttaagaagttgaagtaagtcatcccatatctgatcttcatgatgactatcaacacttatgttagatgggcactctcattaatcctggtgttttcccatgatttctctggtgctagatctgatatgaataacttggttgcaataattataatagaagggagattgaattatatacatctttgttttatagctatacctttttttgtgctaataattttttactgtagtaacaacaaaaatcattcttttatcagcttttaaatattcgtattcataatagcacttcccttagtttatgtagccttgtttcctgagcatgtttgctgccttgattctattgttgtgcatgctcttgttctgggggagccatttaggttttgtgtatgccaaaaaaaagtctcatactcagcagttacaaaattactttccttctttatggattactttatattcaagtcctccagtcctaagtcgttgtcagcaaagattggaagcagcagtcagaagtgttctactcctttgaataactgcataaaactatagcccctcaccaaagaaaatgggttttcatgtatgacacgttgatcagcatgagattgctgctgagctggagaagagactgtgcagtgacttacttgacagcagaggtgctttttacttccttagtactcaaactgcagcatctgttccataccagaagtgagcagcttgttttccaatcaaaatggattcttctgcaattgtaccttttttggaaattaggtacactttctaacatatatgttttgaggcccttgagtatttgaaacatttcctagtctactttcccagacttaaaagatatcatgtgtgaaatatgtggaatgagaatctcaaggtgtttgggtggattcgttctacggagaatatatttgcttattgcagtttctcaataaagactttaaagtagctgagggaaaatctaaaagcacctcttcagaactgaaataatttatgtctgctggtatacatagaaccttccagagtataagctaatgagccacctcagataccacctcctttgtgaaaccttctccagcacccttaaaagaaagtagttatcctctgctctgcttttccaaagcactttgaccctctgtaaaagggcttatctcatatatgtgcctcaaattatattttttcatctctctccctatttatcatggaaatcagaaaggagattttgtcttatttatttttgtatttcccaaactactccacccagaccattgaatgtagctatagatcaggcaacaaccccaacccacctggtttcctcctgagtggtctgttcactccctgtgctctgctaggattatatgctcttaaaagcactattcacatactgtttcaacgatttgtttatatagctgtctcttctattagactgcaaattccatggggataggactaagtcctccatctgtattaacccagggcctagcataatgctgcaacacagagtactcattaatttgtattgaatgaatgttggatttattcagtgaatggtggccttgagtatatgaatgggaaatataggggctcatattccagttagcggtactgtatagtgataattcataaataacaattgtacattgtaacacacacacacacacacacacacacacacacacacacacacacacacacatacacacagtaatgctttttgtccctggaaaaccacaagtaacaatgaagtattctgctttattatgttgatatcatcatgataggaaggatatgttgcttattcactcttactttaaaacccagagatggtattctgtcatttcttagaaggttaagtagaattgatctgttatcagatagaattaaattttagagttttcattgtatctcatgatggaattgcctgttagtttgtgtcccctaggaatgtaagttccctgtgagtaggtgctataccttctatgctgaggttcctagcatagggcttggagagcatggtagatgatcaacaaatatctattgaatggaacataaaaatgaatgtatgatacaattagaaaaacccataaaaattcgttagctttaaagtgaaaattctttttaccgcttgggaagtatcactgggaccaaatggcttttaagagaaatgtagaaaccttctgaacatggcagtatttagaagctggaatatgagtttggttttgattgttccaagttcttcctttggaagatcaaacttcattcctttagaagcttaatcctttttgtgtctctatctttagcttagattctcacccagagaaatagaccttcaataaagttaatgtgaagagaagtcaattagatcgcaagaggagtttctttgcaatcaaattacctggaattttcaggtcaaacctgacagagtgtaggtttcattaaaaaggggcttataggccaggcaccagtggctcactcgtataatcccagcacttaggccaaggtggatggatcacttgaggtcaggagttcgagactagcctggccaacatggtgaaaccccatctctaccagaaaatacaaaaaatagctgggtgtggtgttacacgcctgtagccccagctacacgggaggctgaggtgggagaaccacttgaacccgggaggcagaggttgcagtgagcccaaatcatgctgctgcacttcagcctaggtgacagagtgagaccctgtctcaaaaaaaacgtgagtgggggggcttgtagatactgctctgtatctctgctctcaaatgatatgaacttggtaacagatacacagctcttactaagttagcattcataattttaatttaaactctcaagctagttttggtagctctctattttaaaagagttaacatgtagtttttcattgaaattaatttttctttactctgaaaggtaatttcctagagatgagaaggtatctagcctttttctcttcttaggagacacaaactaagccagttgcagtatcatttactactttgtatcttgctcttttttgtcatcaagggcactggtcttgcttctggaagaattcactgtgaatgagaaagccacagaaggatttagctgtaggagatcctttgcttagaggcttttattttatagatgaggagatcggctctgagatgttaacttatttgtttaaggttacacagcaagtccatagtagagcctaaactagaacctaggtctcttggctgcttgttcaagcctctttctactataccttacgagttttctttgtatactgaggtaggatgctcacttccaggcaaacactgattgctgaaactgagaaactgagaactctatgagtttagagtttggggtgacaacacagctaaaacttaaagacttacacatgtcacattattctttaactagagaataatttagtttaacatcaatttggtagtttaactacaactgctacattgtacctagtgtctggttcagtgtagataccacagggcaacagcagtgaggtgcctgtcacttaaaaggggaaattagattttcccctaaactagaaatcgataagcacagggtcacagtggaaatttacacaattttcttaaatactatgatcttgaaagaataaaagacttgactgcaaaactaaatagcagatattagtcagaaaagatgttggtcatctatagaagcatggacaagatcaaatcgcaaggtaaaggttgcctgtgcctacaagcagagtgtactccagtggttctcaaactttagtatatactttagaattaactggaggccttgttaaagtaccaattcctaggccctatccccagatgcttatggcccaagaatttgcatttctaacaggttcctagatgatagtgatgctggttggggaacaacattttgaggatcattggtctataggtgtgttagttttctactgcggtgtaaccacaaacttaacagcttaaaacaacagccatttattagctcacatttctgtagatagaaatccaggacagtatggctgagttttctattcaggctgaaatgaaatcaaggtattggttggcagtgttcttacctggagctcatagtcctcttccaagatcattccttttattggcagatttcattcctctgcagctttagaactgaagtcttgttttcttggtatcagccagggactgctctcaactcctagaggttgttctctggtccatagagggtgccttcagaggagaaaatacagtagtgtggctgactcaagtgttcctggtctatgtagcaattgattttctctgaggagattaataaatcaacattcttattatatacatcagcctctgtgaatctgcttaatgtgggtctcctcttgctgtgtttaaagattgggttttgaaactgattagctgagatttagatcctggaatgaagataaattcaccaagatgaaaaccaatgttggggaacaaactgggcagccagccctcccttttaggaatcatctctctattgctttacaactgtatttgttcttcaaaattctcattgtatagcatatcttggattaaagccatggttaaaattaaagatctcagaaattcaaacaaaatgtctaataatttttctttagccaatctcctctctttttttgtagaaattgattcttttactgaagccttgagatctctgagcattataaactttctgaactaaagtaagaatcctgaaaataaaatttcaaaggtgaaatggtggcaacttcacttcctatgggaattcctgtaaatatcagagaaaagtgcttggcagtcacagattgttgagagttatcaagtaagcctccataatctactggttcttaatgcctgatctatatggctgactttgtgtgtgtgggtgtgtgtttgtgtgtgtgtgtgtgtcttttatttaccaaattttgttttttcatcccttaggaaaagtcaggctctatttgtttgagtatcagtggctcagaggttcttttatacaaatgtatttagctaattatgtgactcaaatatccaaatttagaattattaaattcctttagagcagattgataaacaggattattgttattttattcccttgtcacattgttagagaataaaactcaatctgtatttctaaagtcagtgacaaccatatcattacattggcaaattttgtagacttaactgaaaccacatcaagcctaaaaggctgcaatgtcacttagaattttaaaagtaaactgtatactatacagctgaaaatatttaattttatagaagttaatataaaatgacttaagattttagttgtctataaaatcaaaatctgcctcagtgtcatgtgcttgtgatgtgggctttggagctgcattaacaaaagtacatgtcaagatcaaagatggacatattcgctgggtgcggtggctcacgcccgtaatccctgcactttgggaggccaaggcaggctgatcacctgaggtcaggagttcgagaccagcctgaccaacatggtgaaaccctgcctccactaaaaatacaaaaattagccaggcgtggtgtcatgcgtctataatcccagccacttgggaggctgaggcaggaaaatcgcttgaacccagtgggcggaggttgcagtgagccgagatcatgccacttcactccagcctaggtgacaaagcgaaactctatctcaaaaaaataaaaaaataaaaagatcgacatattcttcctatcgctctctgttctggtcagaccaccttttgtttgactgccatgtgttcacaaagatttttgataaatgttcatttaggagggaaccaatcagattatagattggaaatcaagtcacctgaagtacagttcaacaagctgagattacttagcctaaaaaagagaaaactttggggatatgtttaagatagacttgtttaattatataaactaaccagttaatagcatttcttattggaaggatattaaagagtttacagagtcaaagagaagaaggaagaatcaggctcagaaaggacagggaaagaacagcttaagagggctcagtaaacctggcagtcacattcttctgggcttcactgccaaagttatcacactccagcaactttcagtgtttttgttaagattcaaaactaggggatctggcttgggtcatatgttcactttttggctaaagaatggcagggaatcttgactcataatcccattaggctgcattcagtggggtagaggtaattttcctcaaagatttggggtgctattatcaaaatagtaaggaaatatatgctgtacagacaaaaagtaatgaatatccacaaaggttatgtgatcataatctttgaatattggaaagaggaagatgagccttggtaaggatgtaaggcaatagttggaatatccatggaggcatatgtgtttcaacatcaggaagaacattctaacaattagagctcttaacaggctgtattgtgagttatggacttcttattcatagtaggatattcttttcattgcatgtggtggaaacgtgacttgaactagcttggtaaaaagaggaaattagtggaaagatattaggaatgtctcatgtgaacaaagaaaggattgaacagccaaactgtggagagggcaggcatcccactgggccccagaaactgctagaaccagagactcaaatgcagctttccttatttctctttctttcatctctgcttctctcagagtattagctcattttccctctgcagacttactctctcatgcacattatgtgaaacatgattgctaagcatgcctgggttatacatctcccaacaatcaagagaaactctctctagcacatttagtgagaaaaaccttggaaaaattctctggtccaggttgggccaagtgcccaattctgaacaaatcaaccaaggccaaggggcaggacccctagtttggttccagtgccttctctggactgatctcgggatggaaaaaattggctcttaggagaactataattgagaaaagcagttcacagaaaaaagagggatgctttttccagaaaagaatgtggggggcaggcaatatagtaattgcatgtattcaaaggttagctcaatcagaaatattagagaaatgaatcttatgttggtgggaatttgaactggaagaacttgaagttctttccaactcagagatgatgtgattctagctgtttttcaggtaaggcaggcacatattggtttatactaggaattttctttttccacgtatttctactcaaggattactctgtttggaaactgaggaatatttattcagctgtttttgaatttgaggatagaggaaaatgttttattttctaaaaatgaatgtctggtagaagagaagtcatgtatgctttttaaaaaatggaacctgtggctttaaagtcacattaccttcaaagacagtactcttaaatctgaatgatttttttttctttttgagacgaagtctcactgtgttgcccaggctggagtgcagtggcgtgatcttggcttactgcaacctccacttcccgggttcaagcgattctcctgcctcggcctcctgagtagctgggactacaggcgcacaccaccacgcctggctaatttttgtatttttttagtagagacggagtttcaccatattggccaggctggtctcgaactcctgacctcgtgatcctcccgccttagcctcccaaagtgctgggattacaggcatgagccaccatgcctggccaaatctgaatgatttttttaagattattttggcttgttaagaaaacttttttttttaaataattatatattcatagcaaggtacaaagaaatgtacagcgaggtcatatatatccttcacccagccttccccagtgttgacatattccatggctcaagtacagtatcaaaacctggaaaccaatatgggtacaacccataaaacttatttcaccagtaatgcatgcattcatttttgtgtgtcatcatgcgtagctttgaataaccactagcatccatcaaaatgcctcactgtattatcagaagcctctcgtgccacatcctgctagccacacccaccccatctcatattccctaacctctggtaaccgtgaatctgttctccatctctgtaatcatgttatttcacaaatattacataaatgaaattatacagtatgtagccttttgtaattggctttttccacttttcttatggttcatccaagtggttatgtgtatatagaattcatttatttttattgctgagtagtattttgttgtatggatgtaccatagtttgtttaactattcacccttttaaggatatttggatagttttcagtttgggactattatgaataaagctgctctgaaccttcatgtacaaatttctatgagaaaagttttcatttctctgggatatgtatcaaagagtacaatcctgggttgtatagtaaatctatttttagttttaaaaggaactatcagactgttttccagaatggcgattccattttacatttccaccagcagtgtatgagtgatccaaaatcatttagcgttatcattaatttttaaatgccatttttgataggtgatagtaatattgtgattttaatttacatttttctaatgactaattgatgttaaacatattttcatgtgtttacttgccatctatatatcccgcttgagtgaaaggatgtctgtgtatattttttgctaattttctaattgggttatttgatttttttaatgttgaattttgggaatcctcttcgcattctagatacaagttctttgtctgatatatggtttacaaatattttctcccattctgtaaactaccttttcatcctgttaacagggtttttgcagagcaaaggttttacattttgatgaagatgattttatgttatttttatgattaatattttaaggaatgaagtatacattttgcatactttttattgatcttaagaattttaaattgccaaattacctgctctaccttctttttcagctcagacgtgttaccaatgcagatgcagttaaattttaagatgagtaaaaccattgagtacatagtgtttaagtgtagtggaatgtctgtgtgttctactctattctaatacctgcttttctctagtgttttaattaatgtagcaaaggaagatctcactttctgaggtagtttcattttgagtttcagcaagatttaataacaccggaaagaggacatgtgattctacttgtacaatggattattgtaaataaacacctcatattactaatatttttctttctacacaatcccaaccatattagacagtgcagcaacgtcccatgttgctttgtttatataaatttagcctttagcttttccttttggcagcccatttgttcattccagaaatactgcacacctaccagctttgtcaagattgtgctgggttcagggttataatggggaatagtatacacatagacataggttctgccctcatggagcttacaatttggttctcatttcttattatggtaagcttgtattgcctgtcagtatttcactgatttgattgaatatccttacttcccatcttctgtcacagaatcttcctcattcatccaaaacgcaacatgtccaaatcttagtgaatgctttcagtgctttgggagtggttacattccattaagattaaatccaagccaagcaagtaatacttacaagcatgcacaggagaatatgagatgaggagagaaatcctcatacttagttaatttcttgccaagtagagaaattttcagtagagccttaagttacctcagggatggctgaagattctaaatatgagattccaaagtccaccgttcaccatattctataaaaagagactcagccatttgaacaagctagctaatcagatgccctctgcatagttcatatttttaaaaatcttggtccttatattatttataaaaaaagtgactctatattagttttaaggtataaatgagacacttttcctatctgtaaactagctgatctatttgtagtctggcttaaaatgtgacttgcccaaacataggaaaatcttccaaaacaggatctagactgtgtaattaaaaatcaaaattagttaagaatcaaacgtctgaattgaaaatttaatttttagttaaattatttgctatccagtcatctttaatattttgttttgctgtgagcagggtcacatatgacaaattaaaggtggatcaggccgggcacagtggctcacacctgtaatcccagcactttgggaggccaaggcgggcgggtggatcacgaggtcaagagatcgagaccatcctgtccaacatggtgaaaccccatctctactaaaaatacaaaaattagctgagcatggtggcacatgcctggagtcccagctacttgggaggctgaggcaggagaatcgcttgaacccgggaggcagaggttgcagtgagctgagatcacaccactgcactgtagtgtggtgacaaatgagactccatctcaaaaaaaaaaaaaaaaaaaaaaaaaagaagtagaccagccatacttttaaaagcttattgtaacaaacacatactgcttattccatgctggtgtgttttgtgttctttgcaaatgttaactaattaaatcctgacaataaacctattaagatagatattattaacctcattttacagatgatgaaactgagacagagggagactagataacatgcccaaggtcatacagttaataagtggcagaaccagggttcaaaaccagtccagaggctatgctcttaaccactatacaatggtcccatattgtagttaatcaggtatttttccatataacacaataaaagcattgaactgggattttcctatatttgagaaaacagtatggaaataacagatggaggtatagaagtttttgataagctaggcatgttggctcatgcctgtaatcccagcactttgggaggccgaggagggtagatcacttaaggtcaggagttcgagagcagcctagccaacatggtaaaactctgcctctactaaaaatacaaaaattggcctggcgtgatggcacacgcttataatcccagctagtcgggaggctgaggcaggagaatcacatgaacccgggaggcggaggttgcagtgagccgagaccacgccactgcactcctgatagaaggaaaactggacctaaggatttgagttttgacattactagtacaagctgtgtgtaactttggggaaggctgctacattagtttcagtttcctattgctatggtaagaaattactacagatttaagttacataaaacaacccaaatttattattttatagttcttgagaattttaaaatcaaagtgttctttaatgactacaaaagctaatacactgttaacctctttccaattctattaataccatcattatctttaatagttgcatggaatccacatggaatgcaccataaatgaatcgaaatcttatgttgaacatttgtttactgtcttttgccattataaacaatattatgatgaacatccctaaatatatgcctttgaatacttgttcaattttattcattggggcaaaaaggtatgcacattttaaagaactacagtccacaggtgttcatgcaattgctgagggttttctgagaaggtgaacaagagcagtctatttcaaaactactgaagccctttttgcatgactgactggcattccctaactgggccttcttcgttgccctgacactgcctgttgctgctcctctgagaaggaatgtgtattcacagatgaggcgctccattagtcatggtgcatttcctgggccctggagacatgggcatgacatcaccaagggccaatgagaaaggattctctgtagcaagctctcaaaactctttagaggattgtagactgtgtgttctgttcctagccctcagggtgtgatttgagcttgccttgctcatccagccatagtctgggcacaaaagtctagcttacagacccaagaagccaggacaagcttgaaaatctgcagagctgcaggcagattcccatttagtattttttttttccagggctcaggttgttattcccagagttttccactcctaatgatgttgttacttcatgtggtaatgggtgggtggtgaaagatgaagtctgcattaaataaaagacatttggcagttaaaatttctgggtaagtataggttggtagcataacaaaatcagaagtacattttaccgttttgttacattgcttttgtgtgtagtttcacataataaaacaacatcttttaacagcaaaggctcctagcaaaatgagtgtggcttaaaatagggcaattaccaaagaactttactgaggggattagtaactcattaaatcttttctcttcaaggagaaaagaaacttaaaaaaaaattctcttttcttgggttttaagcattttggataaaaacttttctgtctttctctgtatctgtctctctctctgctccctaatttatgtatttatttatgaaaatgatttgtggaatttagtcagggataactttgttaattctgcacaccaggaagtctattgaaagacttatttcctaattggcccaatcttttgctaacaaggtataattgtaaaattatctttttaaaaaatagtcaaggaaattaaggctcaaaactcaatgtgagcttacactgaacagacttttatagcttaactcagtagttgaacctaagagctgtgcttttctatcttcattcaatctatgattgaatgagaatggttcttttagtattttttcatgtttaattcctttttgatgaagtcaaagagaaattgggaaaagtagccatctttattagtgtgttatctgtggatgccatatactatggaagaacctgcctctaccacttttaaaaaaatgtttctgcaagataaagatgatttttttttgtaattatagcagcttttatttttaaaaatcacttgaaaccgcatgaatttatccttatttcctaacatatataccagtaattaaaggactttcctctagaactataacatactataagacagggcacttttcaacacttcagagatcctccttcaaagatctctgtgcaattcaaaacatttattactaaaatttcaaaacatctctggagatattctaaatggttttttttttttggcttgtatagatgagaaagttgaggtacagaaagattgaaccttgtactttgtgtcagtcatagaagcagatactgcatacataaatcattcttttatcaaaactcttaagaggacagttctttgtgtctttgtataaaattgttcttgttttcctttgacagcttcaggctttgccttattaacagcagtgcttatttttcaaaaccctttgattgagacaaaaaaaaaagcaggttcatctagcctaggcagaactggaagaagccctgaaagggataaattacctaaggggtggcagtgtggggcatgggagcactcccactgcctcactcttagcagagtacttgattcttctcaatcccatcccacaatttctcccacctgaaccaatatttgccagttttctactcgagggttgccatgactcctgatgagttaatattggtaaaacactttaagcctttggaaaaaggtctcataaaagtgtacaattggcactggccctgatagtagtcacaggctttttgagtgggcactaggcaccctcagataaggttaaccagatccctgtttttggcgaggacaggctctagaatgaggtctgctgctgccatcttgagagaacacatctggtttgaaacgttgaaagccaggtgacccttgaagcagccacacagtaatgtctcctcactgcttctgcttcctgctaatttggggagcagcaggtgcctccctgagaaaccctgccagagggttggcatgccatgctgatcgtctcattaagccctaaactttttctacagaagaaaactctcaaaaggcgattccagaatatgacagagagaggtcatgacagataatcagatcagtttataaaaagttaaggatgagtcatgtcactcctaaaggagttggcatcaatttattacacaagaccaaacactgaaggaagaaaagcctttagtctcattaaggagcccagacaaaaatcccacttaatccatcttgcttttccttttcctgcaactcagctggtgtgcaggtgtagggcagcttggcagaagatttgaacgtttggaaaagggagtcattactgaaagtcactgacacacacttcccttggaatgctgctgatgtcatggaaaaccaggaccttagcaataacccctaacaaccacagctacagtaaacagtaaatgttacctccaccaaggcattggtttttaaagagttttaacaggccagggcttgccagccacaactcataaaaatgttcttataattttaccctactctctaaaagtgctggataactgctgaggtttctctgccacttgggatgcaaagccaaattcacgtcactttcaaggttcactaatcagaatttacagcatttcttttgcagtcctcttcataccccctgccatgctcacagagttaggtctggtagatttcatactttttcaaagaagtctcttgtcttactgagttgtctcaatttctggtgatggtgtgaattaatgtgccaggttttgactagtgttttattagtctagaggttaggcaaatctggttaattgatagcactcaatctataggttatattccaatcaatttgaaacaaccgggcaaagtggcattctatagttcaaactctgaactgggtattgtcaaggtgaccatataatttatcatcaaaactaggatatttttgaaagtaaaggggctctattaataattactctgagataacagcaataaaccgggactgtcgaagcaagttgagcatagggtcacccttgttactgtgccaagagtcaccatctagctgtcatttattaagtcagacattgaagaaacttgcaggaatgcagaacagtgccactcttctcatgaacattttttgttttagaaaatctagtcattctcataaaaatgttatttatgataagatgttatgagtttattagtgttagttttaaatgaattaaataaatgctttaaaattcatctattttaatttctaatatggtaaatataatcctcccaagtaaaagctctataggtcttcaataatttttatattcttaaagggaacccaagactaaaagttttgagaattgctgctttttctctgcatgggaaagaatatactactaaagcaaaatgataaattccctggcaagagagaccagcttaatcatgattgcatctgctacagcactagcaaaatgtcctgcatatagttagtattctgtaatacataaatatgagtagacaaatctcgtgtgacaacgctgaaaagttgctgtgttttctgacgtttgggtattacattaacattattatttggtttaagtctttgttttttgatattcagtatgtttggtactctttgttaatcttatttcgacacaacaatgatgatgtcatttttccttcgaaagttttatgggatagatcaaatttcctatgaaatgagtatgttagataagaaaacataaagcataataaaagtaggactcctttcttttaacctgcctaactcatgtttatcctttatctcaggtgtcatcttcttcatttggccttcctagaccttcccaggctggtctgcagcccctcccatgtgctttcaaagtaccttttatcacaagacttatgactcagggtcattccattcatatgttggtttccccagttaattttgagtgcttttatgtcagaagcatcctttaatttccttattcccagaattaaatgatgcttggtaaagctattaaagactatctgttacactgaaatgaatataaagaaggaaaaactagttaatttaacttttactagttaatgaagtgttttttttttaaatgtcatatgacatgatttctatagtactggaagaaaaaattttttagagtaaaggaaaccacagtttgaggaaagaagatagattgctttgttatgaccttacatgcagattgatttacatctacctacccctccactctcaaactccttttcagagttagactcttttaagccctttaagggttacgtatttctgagtatgtgatttctgtcaatatcagaaattatttccattggcaaaaaaagttatgaaatgatttctataatataggtttacttttgttgcaagtaacttttcattctttatgtttttctttctttcaaatgaaaatattatcttctatatttaaatttgttccttgagttagaaatataatattttaaatccatgcttaatttaatttagaagacatctccaaggcctaaaattgacttgctgttttgtaaatcaacatgacaggataaacagaggccatagtttatttgggaagcagcatgatcgtcatgatttaataatagtgataattatatgtaataagtaaaagtaggaatctaagttttatgaagatggtttttaatgccatgtgttttgcttggttttagtttgggtcttttctctgagtgctgttctgtgcctccacatttgtttctctttttggagaccacacattttggataattacttaccaaacttatatgcaaattattgatgagagtcagaacacatcacagtttttatcaagtctccactaaaaaaggggttgggggcttgcagtgagctgagatggcaccactgcactccagcctgggcgacagagcaagactctgtctcaaggaaaaaaaaaaggcgcggagggcgagggggtggggggggagttattatgctgtctgagatggagtcctaaaggaacactgtgatttctgtggacaggtgactggctggatggggatgagagagctgggtacttgtcccaactttgccactttctaagttttggtgtgtttttagcatgtcaccttacttctcttagctgctattagtgtccccatctgtaaaatcagtctgatcaggctgggttagatgatctccaaggtcttttacaaatcatctaattctatagcttgtgtagtcttctgtcaggatttcttgttcttgaagtccctagttgacagataatggtgtggaaggaaatgatacatggcagagtcctgaatgaccaaaatggactttgtccacacttatgtgctaatctccaaagaagaagaaaatacaaatgggccagcggccaaacatgaaaatggtgacagtgagcaaaacattgaagcagacagctgaaagcttcatttcctggcccggctgccatgagaaatgctgtgcttgccaaacccttcaggctgtcaaggccagaactttggctagctcttattttgagctccccccataccacacacacaaaccacacaggaaaattgtctctctccctttatatttgtgccttttggctacacttctatttatgccaagtccttgcctaatctccttccttccagctgtcactatactctgcctgttgctttctgggggctttgaaaagcagctgcaaccttcagaggaagcgcagggtggttggcattggtggaagggtattgtaagtgtgtgtggactctatcagaaccaaccgtcacttttacctggtttatggacagtccaaacagtgttctcactctctttccttggcaaatgttagaactgatggctttatttttttctccctcccttcatcttcagggattttttttttctcttctacattactcagcctttttgtctgtgaacatcctgtggaagatttcatttatcttaggttctttggccaggctgctcatcatcttttttttccacataaaacatatttacctaatgagagaacttaagatggataaccagagcctctgtactctctcacaagcctagaaatttgacactttctcaattctgacagttcatcccaaaccattggcctcctaaggcccagagagctcttggtcatttgctgtctgtctagccccagctgttggagaactagcttaggtgtactttcacccctggcctgtgttgtttccccacagagcttgtctgcatatgtctcatattggctcttagtgagggcggctgagcaaagaggcacttggttgtcatcattttagaaaatcaaggaagaatctcaggaagcctgattgaagaatcttggctcaatataggggaacaccatgtactatgaaggttttaagttattgcgcttgcacagactgactttgtggccttaatatggaaagcaaaacaagattaaaatctcacacagtcattgtcttttgtagtagagcattgtcttttgttgatgagtagagctttttgagatacaatgagttgttctctgctgctctttctggaaacttcgttaactatcttgccctatacctggcagtgccaacccacatttctgtttatataaaaggaactccatatcctcttcagaagctagtaaacaaaaaaacctcaaagcatatctgtattggggtttgtctatgttttctcatgtctgtattttgtgttttatttaaaataattaaaatgttaattgattttaacttcaaacagatgaatttgtttgctaaaattctttttttgatgggatcttgtttacctttttgtatactatataaagtcttttttattcatattgggaagataacactacaaagccatttttttccatttctgcctgtataatttcctcaatctttgacttgcttggctatattgtttcaaatacccagttaacctttttattactcatttccttattacatgcttttgcattgtctacaattcatagaatcagtatggtaaaacattagagctggaaaagccattaaatattaactatccaaactccctattttatattaatagatgagaaaaagcctgcagaaggaacatgattagaccaaggtcacacacatgccacagccaggctgacaagtcttctgacccattgtctagtggttttccattataacacctgtgctccatgtgtcaggaattttccaaagcactagtgagaactccatcagagactgcatcctactggaaagggcacaggctttggagctggatagatctgggtttgaatatcttgttctgccacctacgggcggggtacattaggcaaggaaccaaagcttttggggacttgttttttcctctgttatatggcaaaagtaacaagaatactttatggttattgtgggtattaaattatataacctacattaaagtacctgttacacatattatgtttaataagttattataaaaatctgctgttcacagaaaaatgtgatatgtgtaaataataacttaaaataggtatttcattattgggtattctgagcctctcttgttcagtagtattttcttgaagtcagtattaatatgtgaattgagtgaattgtctggaaatgaattactgaaagttatttatatcttgattgtgattcatacatttcccttttctttatggctttcctctgtacttagctgcagtgcatctgcatcctatccaagaacttttgtacaagttgaactcacccaaagaagacatttggagagtacttgggtttggcccctgcttttcatctggctaaacactattagataaatctagaatatatagtctatgtagaatattatgtttacatttttagaaactttggatttttagtgtttttctgaaacttactgaactatgtgatgaacagcttcagtgtgaaattatacgtacttggtctgagtataggtagaagttatgttcaatataaaggggcccaggactgttgttaaaaggaataaggactacattatttaactagtagtgtggggaggtggaatgagttaggaaacaaaagctaagatggatttagcaaaggccagagcaagaaaagaaagtttaggctgggcgtggtggcacatgcctataatcctagcgctttgggaggccttggtgggcggaatgcctgagctcaggagtttgagaccagcttgggcaacgtggtgaaaccccatctctactaaaaatacaaaaaattagtggatatgatgacgtgcacctgtagtcccagctactcaggaggctgaggcaggagaattgctcgaaccaagatggcgccactgcactccagcctgggcaacagactgagactctgtttcccccccacggccccctcccccacaaaaaagtttagaatcgtcgcaggaggtgactcaggggaatttcatttaagggcctctcaaattgcttgggtgttgttggcttactggaatgccttgagtttgaattagagggaaggaccttaaggaactagacagaattttgcttctctattagaggaccctggcttaggttttaaacggaagttaagtgcaattagaaagaggcactatgtacctaacacgtagtggatccttcatatgaaaccattaattgtcaggggactttgaggctcatataatttggcccataattatggctacataagtaaaagctgtgaacactcttagggttttttttaaattgttttttcagtaaaggtgaaagtatagcagtgttgggagggggtgttccttgtgcctatttgtacacaatgtcttagattagattaagagccttaggccaatgattgcttaaagataaaaagcaggcatgattctggagggatattggataatcaaatatgaccaggaaatagaaggtcctattttgctgtattttgggttcatccagatgggatcagaccagaggaatttggcaagcattgagactcgccacttagaaccacactgaaatagttgtggtggcaaaagaatttctccgggagtcttattccacttgaggcataacagccagagattcctggcctttgaggggagagtgccaaagttgatgtattttaaaaacatcaactgagatctataaacctacgagaaatagttgaattggatgacactgggactatgtgtttctgtacttttcttacagaagacatactatgaatacatgtgtcctggaatctacttttaaaaattagttctatgctcatatcctcacattgagatttaatgtatttcagtttaataaatgagaacatataaaataatttacctgtaaggacctgtctatgggaacttctatattctgcttgaaattctgacacattaacctggccatttccaaaaactttctggcaagagctcttcatggacctaataattgctttactgtttaatcattccctgagcctttttatactctagtaaactgcatctgtcactagatttcatcaccatctgtattatttatcccttgtaatctgatatctatctctataatgcccaattgtatccccttcaagtgcccacttcattggcttatatacattaggttttcaataaatatttttatataatggtaaatgaagaagttgttctttatattttaaacaactcttacggaaggagattacaacacagctggaaggaattattgtgagagtgaaacatggaaccaaaaaagataaagcaagggaaattaaaaaaaaaaaaagagctttattgagttataactgacatccaataaacagcacatatttagtccaatttgatgttttaacatatttacatacccattagatcatcaccacactcaagataattaacatgtcttttatccttaaatgtttctacatgacctttgcaatccatgtctcttacccttccttaccttaccctcataagcaaaacactgatctgtttttgtcacaatagattatattacattttctagagttccttattaatggatcatacagtataaactcattttggtcttgcttttttactccaatttattttgagattcatccatgttgttgcatgtatcagtacttcattactttttcctgcaaagtagttttccactgtatgtatatactacatttgcttatccattcatctgttgatggatattttgggttctttctagtttatggctattacaaataaatctactatgaacatttgactacaaatttttgaaaagaggtatgctttcttttttattgggcaaatacctaggagtggaatcactagattataggattgctgtatgttcagctttgtaagaaactgccaaactgtctgtaccattttgctttctcaccagcaatgaatgagagttcctgttgcttcacatccttgccagcatttggcgatgtcattgctttggattttagtcattctgatacagatgttccccaacttacaatggtttgacttacacttttttgatttttcaatggtgtgaaagcaatatgcatgcagtagaaactatactttaaattttgaatgttgatcttttcctgggctagtgatatgtgttacgatactctctcgtgatactgtgcagtaacagtaagccccaagtcccagtcagccatgtggtcaaagggtaaacaatcagtactgtgcagtgtactcttcaataaattgtatgagttatttggcactttattataacataggctttgcattagatgattttgtccaactgtaggctaatggaagtgttctgagcatgtttaagataggctaagccaagtaagatatgatgttctgtaggttaggtatattacatttatttttgacttatgagttttcaatttacaaagaacttattgagtcataaccccactgtaagttgaggaggatctgcaggtgtgtagtggtatctgtgttacttctttgaagaagtgtctgttcagatcttttactcatttttaaaatcagattgtttgttttcttattgctgttttaagagtcctgtggatgcaagtcctttatcagataggtgttttgtaaaaattttctcccaatatttggtttgtctattcattatcttaacagtgtctttgtcagagcagaagcttttaattttaatgaagcctaacatcaatttttttttcatggattgtgctttaagtgttatattcaaactcattgccaagcccaagatcacctagatttttttctatgttatcgtctggaatttttatagtttgcattgtatatttacttctatgatccactttgagttaatctttctgaaaggtgtaaggtcagtgtttagactgatgtgaatgactatttggtccagcatcgtttgttgaaaagactatccttctgcattgaattgactttgcttctttgtcaaggttcatttaactatatttatgtgagtctgtttctgggctctattttgttctatttatctagttatctatattttcaccaatatcacattgtcttgattactgtagctttgtgaatgtatgcatgtattcatttaagagatgaggtcccactatgtggctcaggatggagtgcagtggctattcatgggcttgatcccacttctgatcagcatgggagttttggagtgctccagttccaatctaggccagtttattcctctttaggcaacctggttggttccctgctttcagcatattgatgctgaactaaatgtggacatccaattggcatagcacacaacagcccagaactcctgtactcaagcagtctttctgctttagcctcccaatagctgggactacaagtgcatgccaccatgcctgtcagattactgtagctttatagtaagtcttgaagttgaagactttttttttttttgagacagagtttcactcttgttatccatgctggagtgcaatggtgcaatctcagctcactgcaacctccacctcccaggttcaagcaattctcctgcctcagcctcccaagtagttgggattacaggtatgcgccaccacgcccagctaattttgtatttttaacaagagacagggtttcaccatgttggtcaggctagtctcaaactcctgactcaggtgatccacccaccttggcctcacaaagtgttgggattactggcatcagccaccgtgcccagcctgaagacttttatttctccaactttgtttttctttgtcagtattatgttggctattagtttgtttcctttctagataaactttagaatttgtccatatccataaagtaacttgtttggattttgattgagattgcaccaaatttatggattaagttgggaagaactgacttcttaacaatattgagtcttcttatccatgaacatagaatatttctccacttatttagatcttctttgatttctttcatgaaagttttataattttcttacataggtcttgtacatattttgtttggtttatacctaagtatttcccttttgttgatgctagtctaaatggtattgtgtttttaatttcaaattccaattgctcattgctagtatataactaagcaattgacttatgtacattaaccttatatcttatttgtttttggatttgtgtttttatgattccatttacctctactattgttctattagctgtaactccttgtgtagttattttagtgatggccataggatttgacagtatatatctttaacttatcacagtctatcttgaagtgatattataccactttacatacagtataagaaccttacgatagtcttaaagtagttgtcatacattttacttacacataaatatactttagttataaatcccacactgagttttattttagtcaattatctgtaaaatatattttgataataagaaaataaatttaataaatatatattacccagtggttaccatttcctgtgatctttcctttgtatagactgatttactgaatgagatttacctgaagaattttctctatcaggtcttgtggtgtaggtctccttgtgatgaattattttagcttttgtttatctgagaggtctttattttacctttgtttttgaaagatatctttgttgggtatagaattctagattgatagatttttttcttttagctttttgtagttattgctttattgtattttgacttttattgtttctgactagaaactgtgcttatccttatctttgttcctctgcatatatatataatttttttaatcttgttgtttttgagattttcttttctcttcgattttgagaaattgattgtgatgtgcctttgtgtccttttctttgctttttatgcttggggttttcttgagctttttttgatatgtttgtttagcattttcatcaaatttggaaaaatcttggccactatgttttcaaatatttttcttctctctctaccttctcatctttggggtctcttactacacatatataaagctaactgaaattgtcccacagctcactaatgtcccacagctccattcatttttcttggttttttgtgtgtgtgtgtgtgtgtttcagtttgcatagtttctattgttatgccttcaagttctctaatcatctcttttgcaatgtttaatctaccattaattctatccagtgtatttgtcacctcagacattgtagtgtttaccactagaaatttgatttgggtatttttagtatttctattgacttttcaaacatggactatagttataaagactttttttttttttttttttttttttttttttttttttgagatggagtttcactcttgttgcccaggctggagtgcaatggcatgatcttggctcaccacaacctccgcctcctgggttcaagtgattctcctgccccagcctcctgagtagctgggattacaggcatgcgccaccatgcctggctaattttttgtatttttactagagacggggtttctccatttggtcaggctggtttcgaactccagacctcaggtgatctgcccaccttggcctcccaaagtgctgggattgcaggcgtgaaccaccatgcccagccataaagactattttaatgttctcgtgttatgtagctttgaaatgattccagacacataatttgctgcatgaatgataaaagttttgctgtggtaagaacacagagtgtaatcttcctccccatggaaatgttatatcacaccttatcagaccacatatatgaactcatatatgtcctcaactactggactctaaaacacatataaacccaagattttgacagatacgttgagaatgtaggctgtggcagggctactctctgttagcctttgagttattcttttgagcctggccagccaacatcagcaccacttgctagtgttgagggacttttcatgttgttgtggatccccattgtgttggtcaaatcatcactccctagaatctcttgtaaaaagatacgcctcagatgttgttttttgtttgtttttgcttttttaacttaacaaattggtaattgttttaacttttttattaggttcaggggtacatgtgcagttttgttatatagggaaattcgtatcacagggttggttgtacagattatttcattacctaggtactaagcttagtacccaatcttttttttttttttagctcctccctcctcccactctcttccttcaagtaggctccagtgtctgttgttctcctctttgtgtccatcagttttcatcatttagctcctactgataagtgagaacatgtgatttgattttctttttctgtgttagttcactaaggataatggcctccagctccatccatggtcccacaaaagacatgatttcattcctttttatggctgtgtagtattccatagtgtatatatatcacattttctttttccagtctgccatttatgggcatttaggttgattccatgtccttgctattatgaatagtgctgcaatgaacatacatgtgctatgtctttatggtagaatgatttatattcctttgggtatatacccagtagtagtattgctgggtcaatatctttaagtgttactgtgccactttacgtatagtataagaaccttaacaatagtcttacagtacttgtcatacatttaaatatacattagttataaatcccacactcgattttgttttagtcaattatctgtaaaatatattttgataataagaaataaatataataaataaatttgaattatccagtggttatcctttccagtgatctttcctttgtacacattgatttactgaatggtagtgctatttttagctctttgaggaattttcacactgctttccacaatggttgaactaatttgcattcccaccagcagtgtataagtgtttcctgttctcctcaacctctctagcatctgttagtttttgactttataataatagccattctgacttgtgtgagatattatctcattgtggttttgatttgcatttctctaatgatcagtgatattgagcttttttcatatgctcgttggccatatatatgtctttttttgaaaagtgtctattcatgtcctttttaatggggttgtttttttcttgtaaattcatttacatttcttatatatgccggatattagacatttgtcagatgcatagttttatgcctcaaactttgactagactttgtattcatggcggcctacttccaccctaattgggcaaatagactttaataattagactctaaatgaaatggaaactcacacactatgaggttagtgtatctcatttattgagtgtattccctaagagatttgttctcattattctccacctgtttaagcattgtgggggagaaaagaatctctttgtcaataagccatgtgattcatgagtcgtattttaatcgtcttcttattttaactatacaaagcaccttgtctgctaactctagtatctgtgtcagttctgagttaatttcaattggttgatttttctcctcactgtgagttgtattttcttgcttgttttgcatgcctggttatctttgattagataccagacattgtgaatttcacctttttgggtgcaagatatttgtattcctataaattttaaactttgttttgggatgcagttaagttacttggaaacacatccttttggatcttgctttcaggatttgttttggcagaactatttaatttaaagctaatcattccccaccatcaaggcaagacccgtctgagtattctatccaatgcttcatgcattatgaagttttccattcttattcgtaaaaataggcattattcttggtcctgtatgagtgccaggcactctaccctctactcctctcagagcattctttctctagcctcaggcagtttccttacatgcatgcactaatcagtactctgatgaatatttgagggagactctctaagatctcttctgtgaactttagctgtcttcttttctctgaattttcagctccttctcctcacttcagggagcctgttggattccacctgtgttccctcttcatgcaacacaacctagaaattctcttaaggtaatggcctgaggaaattgtagaactttccttttttttttttttccctcatctcttaccagatgtccagtgtcttgaaaagacattgttctgtttgttttgtttcttgaaaagtattgttggttgttttaggtggtagggtaaatctggtccctgttacttaatctttgtcaaaagcaaaagtgctcagagatcttcctttaagttttcattggtagttctagaaatgaccaatcacaaaacagggaatctctaactgaaagatccatgacatttcattatagagagttaggaaagagaattaatctgagaattaccattatctagtcttcctcccactcatattcttcataaacatttgcataacacaattttttgtaccattgttgaccatatcaatgggtagattactgaattttggggggaaagacatgtacaagctactagaatggtaagttttgttgaacatgttatataaaaggaaattacgcaaggggagctgggttggtatcatagtatagtattatatttcttttttttttttttgaggtggagtctcgctctattgcccaggctggagtgcagtggcgtgatctcagctcactgcaagctccgcctcccgggttcacgccattctcctgcctcagcctcccaagtagctgggactacaggtgcccgccaccatgcccagctaattttttgtattttttagtagagacggggtttcaccatgttggccaggatggtctcgatctcttgatctcatgatccacccgcctcggcctcccaaagtgctgagattacaggcatgagccaccgcgcccggcctatatttctttatagaggtaaaataggtgtgagatttttgtttttacttattttgctttgttatttgggcttcactggggaaccaagtgatttttggcaagagaagaagcacaaaaaatacagaaaagcctcttcttatggttcctataatggcaaccaagtcaataaatggttgcaaaattcaactagattgcgatagggtagttactgctactgctttatccttttataaatagtcagtttgaaaagtagaaaagttcatgggtaaagagcagtagctagaatgcaaatgtgaatccaggatgcaatatacaaaggtttttgcagttttcagcaagtgtgaagaatttctgattgatgaggccctcagagcagaaagagaccctcctctgtctatgtgtaagattagtaacacatagagacgtggtgttcatctgcccagtttatgtggctaattagcatttagagtttcttcaatagaagctagtgaagtaagaactagataatatcttggaagatctttttgtttcttctgtcttgcactttgaagaggggctcagactgttgaattggaatagaacaattaaacagactgtaaaatgaagtcctgacatgctggttgctttgcctgctctgtcagagcagcactggttccagggagagagaatactagttttgtttatttgtttgtttccagacaatttgctatgtcatcactttttttgtgtgtgcatgcgccaagtgtttgaggttgataatgttgacagagtccttgcagaatggaagttcatctccacagggaaaggctttgtatttcaagttttaaaattccaaaatattttgctataacattgttattcctagttttttatgcctttttgtgtggaaggttggtttctcctttatctacttaccagcttttaggggaatccctttttaagtcaagaaagcaccttagaaaatttctctctctctctctctctctctctctctctctctctctctgcctttatgaaactgacagtagcatatcttgctattcttgggtcttagtttggaattaagctgtgcatgcagtatgcccagaaggctcagtttttaaaaaatttctatgtttattcgtatttaacttcattctaatggggtcatgtacactgtgatatttattcatgaaatatttaggaaaagataaaatgtttgaactataatgaattatgattttattatccttttattaatgataatacacccaatgctattcttgaaagtttgaaaatggaaaccttggtaaattttttttcttttggcagaattttgaacttttttacataaaagtgtaaacctttgtttggtattatgggtcacctggttccatagcatctctttgatttaaagaggatatcatccatttaaaaaggactcacagccaggcatggtgcctcatgcctataatcctagcattttgggaggctgaagtaggcagatgcttgagctcaggagttcgagaccagcctgggcaacatggtgaaacgctgtctctacaaaaaatacaaaaattagccaggtgtggtggcatgcacctgtggtccaagctacctgggagactgaggtgggaagactgcttgagcctgggtggttgagtcagcagtgaaccatgattacaccactgcactccagcctagttgacagagcaagagcctatctcaaaaacaaaataagcaaaagggacttactttggggatttggagaactagaaaatattattattcatattaacttacacccataaaagagtgctattaaaagttcacttaatacaagggcttctttttctttgctttggatttaaacaggttttctataagctaatcaacagagatttgattaacatacttaagcatgttatatgaaagggatggcattgtgaaagatggggatactatatagaagtaataaaataaaaggtatggaattaggtagtgtaagaatttcagaactaaaatagtctgagaagtcatttggaacatggatttcttttgacagaaaacttctgtcctgcagtatatcagccttgtccagcagagctggttagtgcagatagaagaacctaggttgcttaactaccagttcactgtcctttctattatattgtaattctgttttctgtcttatttcagaagcagcaatccagatgagctctacatcctgaataaaaacaataataatggcaataacaaactattatttttttaagaaatatgacttaaacctatttgtttttatttatttggtttgtttgtttatttatatgtagtttgtcagaaaaccataggagtcaggcattgggtagctcgtggccattagtattattttcaaagtcagaaatcattggagaagaatccccttctaatataaatttttaaactattcatctgagtgtttaggaagctgtgatctctgctgtgataatcctagaagacattgctcaagccacagctggctattattgagactatggaaagagaaagagcttttgccctgatttatcccataaaatgaataataggccacattcagggagacctagcttgtggcagactattctcaccacacccttcacacagcctttttttttcttctcccatcccaagccaccatcccaacctgccttgactaaactcaatgaacaggaaccattgtatgaatcggaaggaaaatgtcttaaatatatgaagttataatgagttggtaagtgctgtaaaaatactctgtaacttagttggaagttgcatcatccatgcctgtggcactatggactggacccaaatggtataattcttcagtgtaacactgaagtaatttttgcatctgccaagtaaatggtttagatttcaaacctatgaaatgccgaactgtaattgttcaattctagtgaaccacagatgtgtttaatttccttcctttactttttgctgtcttctttaggtaagctgaaccaactaaagagtggccttatgtgaatctacaaagtgaactttaacgtcagtcagttaatatactttaacacctaaatgttgtataacactgctctatatagcacttttaaatgtataaaatttttgatagaggataagtccatttcatttagggaaaacagttgtttcaaccacatgtattataataggagtaaaagtggcatatcgtaatgaaagaacacgggaagtcagaaaacctggatttatttttgcctctcctgtcgattcttcatttgatccggcctgaataatttccttttcctttaatttctatatctgctgaaggtgaataataatactttcattggccacatagaggtgctgggagaatgaaagataaattctcccaaagcactttgaactgcctagaagaaagacttatttaaacaaaagttgattctgttttctatctttttatttcttacaagcagacaccaaagtaagtgttagaagagcctcaaagatttggttattttttttttgcaacttttattgtaggtgagaaggttaatataattgccttcattgtataaacagggaaactaatgctcccaaaaggtttgttttggggcttaaaatgagtagccctttatgagaataggggaaattgatgggggtgtagatgtaataacatcagccatgagttgacaattattaaagctggtaatgggtgtgtctgtttaggggggttatcatgaatactatcatgtctaccttgtctttgaaattttgtattaaaaagttaaaatttaaaaaattgattaaaaaaatagctcattttcatttgcaaggttcttttaaaaatgctattgaggctggtcacggtggctcacgcctgtaatcccagcactttgggaggctgcggtgggcggatcatgaggtcaggagttcgagacaagcctgaccaacatggtgaaaccctgtctctactaaaaatacaaaaattagccagccacgatggcgtgtgcctgtaatcccagctactcgggaggctgaggcagaagaatcacttgaacctgggaggtggaggttgcagtgagctgagatcgcaccactgtgctccagcctgggtgacagagcaaaactccatctcaaaaaaaaaaaaaaaagacaaagtatatgcttggaccctgaacacagacattttagtttttcatactcagtttttacattctatttccaatgctttctaaccatttactacttttaacatattatgccatttctttagcgttaatatattacacttttttcttactcccgttccagatgtttgtcatgtgctttgttgtcaattttagattttcattttcctatttttgggaattataagcagtcacttattaacccaattactttatgcttcaatgggcttgtcattgggtagccatgtgaattatttcaatttttagagacacagatcaacctgctaccctatacccacaacagaaaactgccgacttccccattgtaggaacttacaatcaaacggcatttgaaacatgtgagaacactcctattattaaaaaaaaaaatcaccctcaacctgggttattttcactgacagacttcatggttaaagcttgctatttcatgagctcccagatgacgcaaatgctgggaaatgtaacatactcactgtgatttgtttttagacatcaaaagaaatccattttacaaaggaatcatataactttagagctaagaaagatcttaataatcatctggtatagatctttccatttatttatgccagaacctaaaattagaaaggccaggtaatttgctcagtgttacataccttagtatggcagagctggaacttgaacctgagttccctagctttcaattcagagttcttaataggttgccactcaagtgcagtcaggtctttgatgctatttgtgaacaccaaatatgtctctgcttcttacaacttagaaatcttactctgttttgcaatgccctgccaagtcatattggagcctgaggcaaaatgaaagaccaatgacactgatcctgtctttatttaaaattctgatattttcttcactatggatttgtgggattaattttgattttttaaaatattgcattaaatattatatcttgactactgagttttttagtagctcctaaaattttgcatttgaagtgggtgccttgcttgattcaccctagtcccaatcctattatttttgctttaatctactaaatccctttttcagccttctggcaataaaataaaatcaacctatggaacctttataagcaaacccatactattggccacttacaaacaatggtggcaaacaaaccagaatctgcaagtgcttttcattggcttgattgttggtaacattgcatggtaattacatagtcatttttggctccatgaattgaaactctcttggaatgtctagcagtttattgaaaagagctcaaagccaagacgtgagttcttttgtttgatccttcacagtattgtgttttaggctcttatatcgttgtgtttgttttgatttctataaattgggactcaagggaaggaagctctttataggcctattattttcattttacttggtcctctcaacacctgtttgagataggcactttataggctaaaaccaactcacactgacttaagttaaaagagaattcactagctaacacaattgaaaaatctaaggagtagatctgacttcaggtattacacatcattttgtcagggctttctctctcgtgttttctactgggttggctttattattattcaggtttttcctgtgtagtagcaccaggtgtatactctactagcttagcaaccttagtagaaagggaatgaatctttcctgattgcttgagccagagtctcagaattgagtataattggcccagcataggtcacatgcacatccctgcactaggcattaaggcctggcgaatgcaattaaatcactggctgaacctggttcatgtgttcaaccctgggtcagggactggattgagagtagaagagatctgtttcctctaaaggaagagacgactttttaagtcttttccccccaaaagggattctggacagggaaagacaaatgtcaactaaaatgttactattctcacttcatttatgaggaagttgaggattaattaagtgaattttcacgaggctgcatagctaatgagtgataggatcttaactttgacccaaatctgcctaaatctaaagcccatctcttttctccacaccttgtatccctagaacatcatgcttcttcctccttctccttaatgtgaaaccatgatggttgccatcactttacagcagtattcttcaaaaaggagggattttgcccccagaggaaatttggtaatttctggagacatttttttattgtcacaactgtgcacagaggtgagtgtggtgctactgtatagaggctaggatgcctatacctcctgtagtgcacagaacaattcctcacaacaaagaattacccagcctaaaatgtcagtagtggtaaggttaagaaaccctgctttttaggttcaatttctcggctgttactattaacatcagttttgagagaaataagtaatagagagcaggattgaaataattcatacatgtaggtataattaagttgtctcttaattcagggaaacttcctttaatttccatagaagctaactttagaatattgaattatcttggttagtgagtaaattgcaatagaacgtaaattcctttttaaaatatttgttttatgcaagtttaagctaacttcccagacataatttttcattctaaaataagtcctataatttttttcttaaaatagaaatctagggatattttaaattgaatactgaatgcttttaaaggaaatatataagtttatctcaaaagccttttaatatttcatatagaagtttctataccaggggaaataattattttttaaaatccgagctgccgggcgtagtggctcacgccagtaatactagcactttgggaggcggaggcaggcgaatcatgaggtcaggagatcgagaccatcctagctaacacggtgaaaccccgtcttgactaaaaatacaaaaaattagccgggtgtggtggcgggcgcctgtagtcccagctactcgggaggctgaggcaggagaatggtgtgaacccaggaggcagaggttgcagtgagccaagattgtgccactgcactccagcctggatgacagagcgagaatccgtctcaaaaaacaaaacaaaacaaaacaaacaaacaaacaaaactgagccaaagcatttctaaaactttggatgataataagggatttaatgtactaaaaagcatacagaaattttcttcctgtaagcatgtgctttgtgaaagaataatgaaagcagaagaatgcgttaaatgtattatagctgcagttattgggtttgacacttcagagaaatcaaccttcttgttaaatgacatgaaaatagtttatactgtctgactccttgagacttgcaagtcgtttctgaattgtgcatatctgaatgaatccagggaaagctgtgcttctgtagtcaaaccacagataatattctagtagaagagctgaatgagtagagtgatactacagatggatttcatataagaaatcttttacaatccagcaagtcaaatttattgttggagtcggaagatttgaggcttagcattttctcgttttgccagttttatacaaataattcttcttgttttccaaattctcatgactgtatgcagcatggaattacaagtccattcctttctctggttctttttaaccttatcagacccaacccagatcaatgaacattcctctgatttcaactgaataattctgacttgctttgatatctcacatggatgactttcttcccatctctcctatcccccgatggtccttcagctcatgcctgtcgtgcccatttttttggcctcacttctttacctaatctcaggaatactcattgctttttctatttcttctatttttctttggcctctctttccgctcccatattaaatttcctccttggctataacgcctgccttcttctgtttcccaagtcctatttactggctctgtatccttagactcacttgtttcttaattcatatcctcatctactaaggtgcctaatggccacccacctagcatattttagtaaggcatgtgtgtacagacaggtcacctattcattgttaatagaattcaatttgcagtttccctggaaataaggcagtttctgatcttcaaatcacccaagttcttactcgttagaatgcaagttcctttgtcacattaggaaggacagtaatatttatttatgaaaaagttgaaaaaatactgtaataaatggtgctgggttaattaatatattattaatatggtcctatttttcttgagaagaaatgttcttgaagatttgaaatttcttatctgtttacaaacattttcctggtgccatcagcagtttattcctctttactgctttgtgatagggcttggtattcccaattttacagagcagagatgacaggtcacttgactaaacaagtgacttatttagaatttcacaggaaagtaattacagagcccttaaatttcctgtctcttacttctatgatataaaacaatttactttgcattccttatttatataaatgccttagagcatttcctttcctttaataaaatcatgaagactatcacctggtaatgaaattgttaggatggaagagaaatgaactaggcacagtgtacgtgaatttgattattgccttttcaactgtctaataatgggagctgtgggctcataggctctccttttgaattgtgaaaactatacttattttatactacattggtgaagttccctgaagtccttaaaaaacaaacaagatttaaagtgcaaaatgttattgttaagttaaaatgacccttgtgtgtttgcaaagctccgcgggctttctggggctagtgatccccttggtgagcattgtggagtgtggtgggaaccagccatgttttggtgatttcttttagatttctaaaactgtttttctgttgggttgaagtgggaaaacagctttggaactgcttttggtgttgctctgagtgtgtttgggagtgcattccaatagtttgtgaggggatgttagctgttcaggaaaaataacccttaccaaaggtaatggttcccactagcattttcagtaacatgtaccagatgtgggtagttaattattctcagatctgataaatacctgccagccaagcctaattttattttcagtaaacagtggccaaaggtcctagctgttcatttgataggatgggcctgtttgcacttatctattaataaaagcacaacactcctttagttttcctttcccagggccagataaaacattttagacactcacgtatttgtcttagtaaatcagacaaagtaaacaaatctggtagattaacttggtaaatagagtgtggttaagtgttacctttggagttgaactcagtgccatataaatagcattaatcgcatggtattttcaataatctttatggagtaaaacggagggttgtttttttctttcaaccaacagggacttaagtatatttcttaagtactttcagatgttcttctgtatggagattttaaaatcactttaaaatgaaatttattcttttgtcccattagtaacttgttgggaactttgtactagttaacattatgtttaaaaacctggaaacctctatagttcatctcagaagaaaaataggactacatagtggcatgcaagctttgccagacagagataatggccatctagaggttactgatttgggtggaacagtgaaaatggggccgcttttatggggaagacagtggctggtaggcagaaattcactttattcatatgcattttttttcctcttgggtaaagagttttattagggtcagaagtactatttatttttgtgaggtaaattcttgtcttgtgagaactggcatgaaacagactcattatttcacactagccaacaaaacagtattttatcaaagtaacttctagtcagtccaagactggactggatttgtactggtaacctggtggtgcagggctctaagtctcatgccagctcttgtctccctcattaaacttccttttttagtaatgattaaaaacaactctctttactacaatatattttctcattggctttatactcgaagttgcaagtactttataaaattatttttagttttgcatgctgtataataatccatctaatttggtaagcatagtacataaaagaaatagctgaaaggctttagagaaagttccctactcatacctccccctttacaatgatctcggcattaatatcttatgctgtaagagggtggcctggcacagtaccatgaatattgtgcccgatacccagtggtaacctaccaatgattgttatgaaaatgatggtgatgatagtataggggagagagtgtaaaccaaaagttgagatctgtattctgttttcagcttcattttaatggcctactggaagaccaggtacattatttctgctcttttttttttttttttttagtttctccagctatacatgaagaaaaaagtcctagtccactagccaacctgacaggcatgttgtgaaaactaatgaaagtataaagttctcatagtccgaagcataaaaggtgctgtaaccaataggtacaaaatactaattattatttttacagttcagcatagtaaatctttggagtaaatttttttcattatatttactagtctttcctttaagaattatttgccaaatttaactctttttctcttttaattagacccagagtatagtaaaaaaattgatggtttggctttcagaaagagttattttgttatctgtaccaaattttcaattaaatatttttagctgtgaatcaagtttcatcttcaaaagtgtcttcaattttaaataatttgagaatacttacctggttagtaggctaaactaacgtagtagggaagagagtgtaagaaaagtgctgttgaattcatcattcccattagcaccagtctgcggattcccaaacatgtatttctaggctcagatatttttcctgatccccagacttattaatccaggaactagtcaacttctttacctggatgccctgtaatgatttgtagcacaacatacataaaacttaatattctgttcctgaatttgctctctctgtgaatggaatatctatccaccccatctctcaagctgaaaaaccctcaccccatttcctcaacatctgtagatttaactgtcttaatactttatgccccttatctccatcccacaattactaccttaattcggcttttgctcttctgtcaccgggcagctgcaattgtcttcctgccaccagtctggtctcattacagtctactctcgataccatttccagattaacctttacaaaatgcaaatcatagaatattactgtctcattttaaaaatatttagtggtttcttgtgtgctataagacaaagtttacactctttatattggttattgaaatcttaataatctttaccttgtttctagtcttgaatcctcttatgacctctgttctagtcacactgaaagtttgtgggttccaaaacatgccatgttgttggacattctacattctctccacccacttctttaattgccaacactgttttatattttaaaacctaattccagtgtgaagtcttttgtaactccctccttgtatcccatcataccctgtatatacttcttacatagttcctataaaacctatagcacgtattttgtgtatatccttcccttcctgctttattgtatgagagattatgtcttgtttatttttgcctttcaacgtccagctcagtggttggtacagaggtagcacttggtagattgattagatagtgggtggagtaaaattctatgaccatattttcctcctcaagttctactcccttttcagtgttgcatggaaatggctttttaaagtactcagattaagatttgatgggtagacgaggtctttacttaattggtatgattgatgggacaacaggaatactcctgtaaccactatacctacccaaagatttcatagacagtctgacatttccccatgaaaagtcatttattagagttctgatattctacttattatactccctgccctctttagcactttataggtacaaagtcctcccataaacattatcttatttaatttttaaaacaagcttatgagatggattttattgtatatactttaactttatctctaaagcatatacaatataatttgcacccttaggcagatctgtgaattgctttgaagaataactcgctattctttttcgtgatttggactactctgatagtgacactgttttgctaagctgtgagagtttggaagtgtctcccataattttgacactagattttattgggtacagcacaaatatcactccttggggtgggccacatagtcacggacccacagatactcagataggaagaggctctaaaggacattttctctttatatatggaattgtatgaaatttaatagaaatggatctctagaattttactccttttaatcaggacagtagtacaaagcaaaacttttgtacactgcctagcatggtgctcagttctgcaaacgtcttttatgtctttgatagtgatggtggtgatgatttagaagcagtttttgcccatatacatataccatggtaaagcagttttctcgtttaccaacgatctatgaggagcattatttttatagatcttagatataaattctctccttcagactgtttgcctgaaccttaaaatgtagcatgattacacaagcactctggaatttagattaaacagcattcaatttgaaaatctaatcatatcatctaaatatcattaagtaataataggctgattgatagggaccaaagctgttttggcctggtgttgcatgcctttcactcagccagccttttcaaaccaagatgttgataaagaggtctataaatcttaatagttggagacagtttaaaagcatagttcactggataaggtcacacccacttaagtgacctattttgtatacttttcaaaaataggttaattaacttaatagaaataagactctcatattgatgtgcaattactactaaaacagctttgtttttttttctttccaagtgaacatgatgttcatgaaattgagggcataatagccatgacaagaaccaggcttagcaaggcaggtcatgttcagcgagtacatttcagacttcccctttaaaatcctcttttattccaggtcctaggacataagcatacacctccatcagagcagtttattcctggctctctcctatttcagtttttaggagggattattctagctgttgttgttttcctaatcactataacagcactttatatagtttctgatccctgaagactccagcttgcatagtaagctcaatgaattttggtctctttttcttttaatctgaggctttcttcatttttctaacagatggatgattcatttgctaccctgggagaagcatggtttcagaggaggatacagtataaaagggcaagggagtacccagaccagagtcatattctggttatattctcctcatacagcctgctttcatttgttgttgtcgtttagtgcccatttcaaattttctgctcctaaagccttttatctactcttagtcttcttattgatgattataaccttcttagtctattattggtcactaattttgcataatttgattttcccattcatctgttccttaacatataaccccttaatgttttatatcgtaagttgagtacatgggcatttattattctttgaacttttaaatatattttaaataacatatacatttagaaaagttaacctcctcccccagtctgatatcttgtatcacacataactctctgtgtagatgttgctgagtcctgctggctcgaattttcctgtggccagatggtctgagaggcagttagtgatgcacattcatggaagggtgggttcttgcaaggtagccatgatgggtatatttgaattgatggatatatgttgatctgatgggcgtattttgaattagaggttctaatatatatagcagaggttctagatgacctctttgttcaccttacagtagtgtcatttctctgcttgtttgcactgcacttacagcaaagacttttctaaattaaacaagtcttgtttatatgttttgtgtatgtgatcacaaaaaatagcaaagaatactgttctatggactcttagctgtggtggaaagaaccattgaaactctctcagcctttagttcttcattaggaagatgcctttcttactgagggttgtaatgattgtgaagtccagttttctgacttctccattagggaataagagaactctttggttttaaattgaaagatggagtgattcactctccagtgtaggagggaacctactctacttgaatttgctatatttctttatttcctaggaaaatgttggtggttttccctcccaagcattctctctagagtttagcagcatcctttccttgaaagcaaaggcctcatttcctatttctttcatatcctttaatttgcctagtacagggtccatttcatagtaagcactcattaaaaacattttagttaattaactacaaaatgtctggctcaggtttaggagagaatgaaagattgggcaggggaagtactggcacacaggagaattaaaatcagaggatatcctttttattactaattctttttccaataataaaagtactctattttccttatttaagaaagctatcatttaaaaaattagtgttctaaaaccacaccctgaaatgactactgttaacattttgtcatatttcttactagtcttattttatacacatttaaaatttttacatagtttagcttatattttatggtttttatatagtattttttacttattttatcatctcatcctattaaaaacttttttgtcaaaggaattttaatggcagcagaattgtttatttcacaactgtaatatgaattctataaccattctagatgttggacatttaggctgaatctattttttcatgattataattagcaagttgccttttggaaaggctatacaactttttattctcatttctgaacataaaatgttgatgaaaaaaatgtattgggaatgataacttcactgagttttagaccagggtttccagaagtaaaatgttcctgtcttggttttggcctttgggtagaaaaaagtaagtttttaccaggagtccctgaaagggaaggccctgctggccaggggtttcaggctcctcctccataacccatcaagtggccaaagtcttgattttctgtgtaaacgggtagacaggttctcagcctgatcgagtcatgtatttatagaagaggttctctttttcttgaagaatttctgacttacttgatctgtcatcattgtctcatatttgtaactttagagcctgacagaacaaaaaagaaataagccatttctgtagcagaatcttatttggagaaaaggattcaagactacagcgtcctatttttttttgtttgtttgtttttgttttgagatggagtttcactcctgttgcccagtctggagtgcaatggcagcaatctcagctcactgcaacctctgcctcccgggttcaagtgattctcctgcctcagcctcccaagtagctgggattacaggcgcccaccaccacacccagctaattttttgtatttttagtagagacagtgtttcaccatgttggcccggctcgtctcaaactcctgacctcaggtgatccacccacctcggcctcccaaagtgctgggattacaggcataagaaccgcacccagcctacagtgtcttttactaggaattgtaattttattagtttctaaagaaaatattaaatgcagtgttttgtaggcagtgattacctttcatcttgtttgtcatatttctcattctttttttgtgtgtgtgacggagtctcgctctgtcgcccaggctggagtgcaatggggcgatctcggttcactttaacctctgcctccggggttcaagagattctcctgcctcagcctcccaagtaactgggattgcagatgcccaccaccaagccctgctaatttttgtatttttagtagatacaaggtttcaccatgttggccagcctggtttcgaactcctgacctcaagtgatccacccacctcagcctcccaaagtgctgggattacaggtgtgagccaccacacccagccatatttctcattcttattttaggctgatgaaaatactaaatatttcaacacctctgtatcatagccatgtttaaatgtgcatatccaccagtcaattttaatacattcctttctagtaaattctgttaggtcttcagttcaactgtacctccctcagtgtcactttttaccttccctcctcccttaaatcgcctagttctcattttgaaaaggtagagaaatcctttgtcagtagttaggaggttgtagatcctgtatgattttctgtcattacattcttaatctattacatgtgtatttgtcccgtccttactgacttaacctctgaccacattgcaaaatgtaaacagagccagataccgacaggtttgtcccttcattagccagggcccaattcataatttctattttctaatttggagaataagaaggttagctagattaagaggctttcctaagtcacataaccgtttgcaagtagctaagaacaggattgtgaactcttgccaaactcctccataaaattccataagcttgtgggagctcatttatacaatatttaagaggttatataggcaaggagaataattgaatttctatatatttagattgactgatatttcccaaacttcaagtggaaaaaaaaagcccttaaagaaagagcttaagagaattaaaatgatgtgacccgaaccatggttcctttctcattcaattattttcttttaaccactgatggctttttgtgcttggctgggtaactttctagctagtcaagcctatgttatgaaagagaaataagacacttaatcctgtgaatgattaactagtattggcctcccttcccagtagtttgcccttcctgtattgtagtctgtgtactcatttctgagccaaatctccaaggtctcttattattgagtgtagggacacctggattacagggagttaggcctttgttttagtctgaagatgatgtggctaattatacagctccaggcatttgcattttttcaaggcattttaaagtttattgcttgtgaaaacctagtttgtaaagtatcatttttaaattttacaggtgaagaagtagaactcagagaagttttacttgccaaaagttctgcagcaagtcagtggcaaattcaaataagtgtacactcatgtatacttagctcagtgtttaactcatggaggtattgttttgtttcttatttataatataaagccaagtagggctggctagagccatttgtagttaatacattttggtctttgatctttttccacataaggtcagacttcaagatagaaaaatattctttatattctttgcaaagagctgattgccatctttctatactgcctgtgggaacactctggccttagaatccaagattttattatccaagacagcagccagtaagtacagtgagacctaagtggggaattaacttttgggctgtagattttgaatgagaagtcctactcaggatctgagaggtgacaagaacgagtgactattcattgatttggattcctgggtcttggcaccttctgtgggataagaatcacatgcaatatgagtaattttgtggaaaggtcttggtcctggttcatagactgtctcagttcctcagtagagagaacttagaggagaaatgactcccttgttgtcatattgaagcagcagcagactattagggagtacccatgttcctggcttctttccttgggctggaaccattcaactgcacagataaatgtttactcaaggaagaatgcatagctttgaaacagtcttaagatgagtaaaagtcttaagatcagtaaaatatacaaactactcctatgtaggtcattatattaacatctgtggccacatattggtccatgaaagggatacttctagccactgaaatcttaaccactagaaacttactctgcagggcatctttgtaattatggcactgagtagcccaagtcttagattatttcattgtgatgtttccagtgtaccatcaactgtataggtgattagcatttgcctattaattccttcttcctctcttatcttcttaatgactcttatacattttgttatcttttcttactctccatgtagtagttcttactctgcatgttcagactctagtggaggtgctaggaagttccactttctggtagattatttagagtacaggatagtcaagggaataaggatggtgctaaggcaggctgtggtggtttaagcctatagtgccagctactcaggtgggaggatccctggagcccaggagttccagggtgtagtggagctatgattgtatcactgcactctagcttgggcaaaaaaagtgagaccctgtctccaaaaaaaaaagaaaaaaaaagtggttataagaaccataggaaagagaacaacatcattttgactaagacaaaggcataaccttgacagatctcagtgtctccaggctaagagaagagcaacttagatatagtaccttgagcctttcaatgattgctgtttaaaaagtatatgactgtaggataggatacattggaaatactgaacaatgctggaggaaagccaacagcatgtggataagaccatccaatggggccaagatgagggggcactggattggatcaacgttaatgactaaaattctctgcttctaatatacacatgactaactcccttactcacttcaagcctttgctgaaatgttatcttctcaacgggtctgcaaacctattctgacctacctatttaaacttggaattaattgaatgaattaatggaagcctcatgttgattaatcctcttttcaaggactgaactgcattacataagaaaatttaattctattaatggtgagctcagtggcacaatccacatctaagtttttagctttatcctccttgcaaataatgatattaagttagtgtaaatattaataatatttgcccatgagaaaggaacagaatgttctctacctttctccagccatactttgaatcctggggaatcagcatttcccagaaagatcaaactatcaatgacataaagcaacagattgattccattgatgatctttttataatactgacgtaccacattcttccccatggcttttgcatttctatctttccatctgagacttacaacttcaaactccattttccatgcttttgctggcatgaagaaggaaaaaagaaatcatggtgcatttactggccttaaagaaagttggtatgtttataaaagaaataaagcatactgaagaggaacagtatttgagtttcatcagttaagcagagcaatttaagtactgaatgcttcatactgaccatttccattttattcattgtaggcaggtttataaagatggctaggtgcacttgtccatggttctcccacccgtgtttgggatgtgctacctcacaagcatagctggctggggatagtctttaggtggaaaatagctacgaaatacctatttttggttgtattaaatgagctatggctgacatattctgtgattcatttctttctaaatgagtgctggggcatgatactaagtgtgcccatgtctcactggtcttgggttcttttatggttccccagccaaattcaagttgaattatggtgtccgtttaacttacaggtgtctgagataagttgtcagttaacatttatacatgagatcaccatctcctagtaagtacagagtactggtagaaaatgtgtggctcagtctgacttgggttcaaatcactctaccgccttttattacatgaattccatcaagtgaacctctctcagcctccatttcctcatcagtaaagtctgacagttccaagccaatggcttaatgatttctctactatatatgcacttcctagaatagttgcattcaaatttgcaatatctttcatcaagatgttgcctctctttccttctttttctcttccatcacagtaagtgatagaaacctgcttgctgcactcataaataaatggccagacatgtgctataataggcaggatcctcctgctgagcctggactccatttggatgctgtgttcgttagttggagtctcagagtatgtgccaactcaccaatctagctaatccttaaatatccctaggagatgatgaggaggcagattttatctcttaggcatgcatcttggaaaacataccaagtaacacgtatctatttttctggggctttgtatggatgggtggcaagtgaggcacagagaggttaagaaacttatccaagattcacaatagtaaatagtagaactgggattcaaacccaggtccaactaattccaaaacctgtactcttaatcagtatgctgttctcaaagacttagctcttaaatccttagtcatttctcaaaataagataatacattctagtgctgaaatagtggatcagaaaatttagagtttactctcagctttaccagcgacttcacctcaggcaactcaatcatcattagatgatttctctatgaggaaatgaggatcatgatgtctgtcactcagggatagaatgagcattaaaaactaaaacaatagcctctgtaaaagccctttggtctccagagttgatgaacattgcattaatctacagcattaatattttatattgaagacttctgagcaggtcattttgaacacaaaaaagggtaaactttggatcatgtattccctggttctagaaattaaaggtaaccaaccttgaaataaatagttatagcagtgccaaaagaggatacgattatggaacaatatcacccaggtatcttacacagaaggcttctggattgtttcagttagcagcaagagtatgtatttcatgggcctggggcatattaatcaactgcactatgccaagatggagttctgttttttactagagatctgctctaaatcactctgttcataatattgtcatcaaatttgccatccacaattgaggcatgtcacaaaatgagcaaaggagtccttttctctagagtgtaactgccagaatgggccaagaaaggtaatgttggactaagacttgtttctgagaaaagtttttcttccagattcaagactgacactgagtgtacaatgccacattgacttccaatggcaaacagcacataattctgtacacaaacacttagtgatgttttcctctaaaacttttaaaagcaccatctttttctgggtgccagaaaggcactcagcccaacagtataagcctatgactgctcaagcacatgtgtgtgcatgcacttgggtgtgcatgcatgtgtgtatgtttacacaggtaggcacctaggtgttttgttctccatttttagaatgatctttgttgctggccagtaccagagtgatctaattatacatgctttactgatttccatctaccaaaattcatgtttcaagtttaactagatatccttagtggatgtttccttaaaaacatgcgatcacatgtgcttatcttttctctcactaggctggagcttaagtccacttatgaggagaaaatatataaaagcaactctaaattggtgagggcgatggagggggccagtggggaatgagagaaagggaaaaatgaaaataagaagcaattaagttttttttttttaaattagcctaagctcctggaaacagatataaataaatttgagaaagccttccaaaagtcagaagaatttaactctccagccgagatgttcaagctttctggcatttgactaacgttttatgctctcttgtctattgatcattgagccactgttgagatgaccagatgaccaggtgctaagcatactttaaagaaagttaccttgcctgaagacattttcctactcagatatctttaacagctcaatgcacatgaccttggcattgcttcaaaggtggcagctcatccaagtaggcagaatacctggtctctcagcactgcttttataatgccctttttctaacgttgagctggtgaccatgctgccctcttcattttgcagtaatcagggttgtcttcttttttcatatccctttcctgcctgaggctgcttcaacaaacagcaagtataaactgaaaccctatctctttgcggatcaaacacacagcttgaatacattgataagtaactttaaaaaaaaattgtttagcctgtggacctatttatcagaatgctatataaaattattgttttccagtgacccaattagttgaaatattctttctgaagctataggaaaaagacttaatattgtttgatatgattttatcatttgtttagttatgtatcacttcccactttacagtgtgttatgcatactttctttttttctgtcatccttcccccatgtctctactcttcagtctcatgcataaagaaacagggttccctacttgacagtaaccacatgaggagttgacattggcaactggtttaagacttcgatcataagtcatctaagtaattgggctatgcgtatcctgttgaatcacattccttctcaaatccttctttgttaaaagtttgaagcccaggcctttcaattttctcttatccctttaagtccacaaaggaatttttaggctgtttctggagggttataacttctccccagtgctgtccaatagctggcatattggaaattggcagaatgtgggtgcaagagagaagggagttctcagtaaagcaccattagaattctcccacagtttgacacattcatttcattgcccctgttttgtgtggctagcaactgatgttgtttggctgtgacatgcgtaaacagatgttgtaaaaaacctgaaaaacaaaaaatcatctttccctactttttcaggcatactgaagacagaatccttttttggttatcttgaagagtctgaaataggaaacactttgaagtgtagataaaatttctgctctggtcacaatggatgccaagtgttataaaatgattgtgggagtgtgtttctatattggcattttgatatagaggcaggtaagagcaatgccaccttcctgcagagtactctaaaaccctttcttccttcattaatagttttcctttgaagataaaggaactgctttcattatgtgtgaagcattccttttacagttaaattactgtttattggtgagtggtttccttgctgcgctagtatgcggcagatgtttctcatgtatccctaggttttcaggctttttcttttcaggatgaggctctgttgtcttttctttttttctttcttggcaagaatctgattgggataaaacacattttatgcagcaaattaaaaatacgtatttaaatttaccttttattttttacctaaaaagttcgcaaactacttgtagctattattactctgaggtcattcctctgatacaaatgtatttgttgttttatttcggagctacagatagaaaatctaaatacagaatattaaaagtatgtagtgtaacatgacttgtacttagtaggtactccgtaaatgtttggaacttatgaattgaaggtttctttctgatcttagtctagaacagtgcttcacagcctttcttatgtcataatacacatagaaattgataatatttatatgtcatatggaatttttttcaaagaacatctctagtaataacataatacagagagggatacaagttgaaaaatgctcttctatgttgttattgtaacttttaggagtaagactaccatagaaagcatgcattagaatgctaggctatgacatgggtaaacagatgttacatctttcagggcatcacaccataggagtggtatgccttacatcacatgggagatgtgaatggcttataaggagtcccaaacactaggacaccagccagttgaggtctgacttcaagacagttgggtcttgcacagatggtagaaacagatggtagaatgtatatttgtgtatggggggagagggtgccctgtattccaccctttattccccccttgcattctgagactagagcttggcctatggcaccgacaattcctcagtcctgaataacatgtataggctacagcattgcctagttccataagtcaccctaatggttaaagttttgccacctgtcaccttaaaataccccaactttgaatggattctgaaccatagcctacgtgtttagaatgtctagtttgatggagcacagatggtttggggagcgctaacattcatctttactttgccttcatctattattttgcccaaacgtgtttatcctacagcctgcttactaatggctcagtttgttctagctagttgtggtttgggagtaggaggccactctgcccactgttagatgaggggattgtaaatgttagagagggccggggtagaggagtactctttttaagaaaagtagttgactttgataatgaaaaagtatcatcatgattatcgtcatgctgttgagtgctttactacatttcaggcacgataaggttatatatttaatacttacaactttatgagcagctgtcgtcattatcgccactttacaaatatggaaacccaggcaaaaagaggctaagtaactttgccaaggtctcacaggtagcaaattgcagagccagaatgcaaaactactgccttatgatctgcttctctaagtagctgggaatggagaaagacggcgagcagatgtatagaatgcactgattagggtgactgggtgagctctgtgctgagttatacttcaagatgtacaggacagagttagggaaatgtgagaccaagggcttttctgggcaggaacaaccatactggctgctgtggcaaggttagagcctgccaggtaactacagtgagacttccttttcatacagattgggggaactggcaagacaagttatcatcacctccacatagcaggtgagggaagggaagcaacagcagaggcattggtgttttgtatttagaagggcacatagcctaatgctaaaactcacccattagttacatcaatgtttggatgctctttgaaagacttctcaggagaggtgtgagaatgatttgatttgaaggtgggttttagtcttgaccgtgtgccacagcaaacaaaatgaaactccccttgagataaaggtaatcaagatgaaggtgtatttacaaagatgagcagtgggatttatccagtgactctggaaggtaatccccagatttagtgctccatgaataccttgccatgttcctaagctggtaaattactctgagttttatgagagcggattgtgggaagcatctagatgaaattcagcctgtttcacctcgagtccagggctcactaatgcaccccaggtgtgcagactgcccaggctttctgccttggaagcctcaaggaactttcatcccaaagggaagctttgaagaataccaaggacctttctatctgtccttgattttttgtcatttttctgcccacatttggtaattggagatatttgtggtgttaaagccggacttgttccttctcagcctgccccctccagtagtgaaattttaagcctgtggctttgattatgcaaagcagtgatttctctgcagtgtccctcagatgtaaaaggagaatgactgaaatactagaaaggaagttacgggaaatcaccaaacaaccattttccatgtctacagatcctttcatctgagggcaaaagaagctggagagggtgcctccaaaggtgggggtttggaggagcacaatttaaaattctctgggttgtaggctaaggatcaaagggttatgtcctcagaattacacggtgagtcactggaaaaactctgagtaaaagtcaggcatcctgttttccaatcttatatgcctaataatttcaactggctttaagacagtacatttatgtatatttttcatttagatccattgccacctaaagaatataatgatgtatgcattatatagattatggtttccatgccctagagcatcatgaggtgttttgccatgagaatacagtgggttaggtgaagaggtgcttgagaagccttggtgtctaatgtgtggtctcagtactctgtggaatctcctcctcccttacaaaccactgcctctattcaagccatcttgtgcttcaatttagaagttctcctttaagagagagttttccaaagctaaattaacagctatgcagtgtactgagtaactctgtgatttactttttccaattttgactgctgtaagcatttcagtttgtttcccactagtttggatcaacatgttggttttaactttatctccaaatgtaatgattttacatattatagacaaatgtgtttgcacagttaagggcagcaggatttgcttgaacagagaatatgtgagttctgtaacttttaatattcaattcaatttaaattctttttcatatgtcctttttatatattccagtttctgattatgggtaacctgacttgaaggtcagaccatctgaagtgaagatggttaaattgtatgtgtttgcacatgcatacacgtgtgtgtgtgtgtgcatgcatccacatacacatgggtgttcatgtggtaaaggagagccagagagatgtttaatttcctcaccacattgtagaaactgaaagagacatgtactgcagaaacaaattctgagatacgtttgctaaccacttttttaggtttcaccttccggggaaaatgttaaggcatttgcaaacatgcctagtttcttagcgatttaaggcgcatagactctctgtgactacacctagagaggtaagacatggaaaagaacataagctttgagccacctagattaggggcttaatctggccacaccactttttagatgtataacttcaggttgattactggacctgtattccttttctttccttggttgacacttgttccaacttatgatgttggtttatgattttgattttagtttggttaacttcttatttgggggattttgactgacttaatttgttctcatcttgtgttagggttctctagaggggtagaactaacaggatagatgaatatatgaagggaaatttattaagtagtattgactcacacgatcacaaggtgaggtcccacaataggctctctgcaagctgaggagcaaggaagccagtccaagtcccaagacctcaaaagtagggaaaccaacagtgcagctttcagtctgtgtccaaaggcccaagagcccctggcaaatcactggtgtaagtcaagagtctaaaagctaaggaatttggagtctgatgttcaagcgcaggaagcatccagcacaggagaaagatgaagactcagcaagtcaagtccaacttctgcctgcttctttctagccacactggcagctgattagatggtgcccaccaagattgagggtgggtctgcttctccaagtccactgactcaaatgtttaactttttggcaacaccctcacagacacacccaggaataatactttgcatccttcagtccaatcaggttgacactcagtattataaccgtcacacatctgttatcctattgatcctgattcttgacctctagccgcagttccattcagagaagattagaattgtttcagagttgggctaggcacgatggttcacacctgtaatcccagcacgttgaaagcccaaggtgggaggattgcttgagctcaggagtttgagaccagcctgcgcaatatagtgagaccccatcgctacaaaaaattttttaaattacctgggtaaggccgggcgtagtggctcacgcctgtaatcccagcactttgggaggccgaggcaagctgatcacgaggtcaggagattgagaccatcctggctaacatggtgaaaccccgtctctattaaaatacaaaaaattaggcgggcgtggtggcgggcacctgtagtcccagctactcggggggggtgaggcaggagaatggcatgaacctgggagacagagcttgcagtgagcggagatcacgccactgcactccagcctgggcgacagagggagactccatctcaaaaaaaaaaaaaaaaaaaattacccgggtatggtggcatgcacctgtacttggatgtcccagtggcatgctcccagctacttgggaggctgatgtgggaggatcacttgaacccaagagtgcaaggttatagtgagattttttaaaaaaagttattttttgagacaggatctcactgtctcatccaggctggagtgcagtggtgcaatcacagctcactacaacctctgcctcctgggctcaagcaatccttccatctcagcctcctgagtagctgggactacaggtgcataccaccatgcctggctaatattttgtattcttttttcttttgtagagacagggtttcgccatgttacccaggctggtcttaaactcctaaactcaaacaatccacctgcctcatcttcccaaagtgctgggattacaggcgtgagccactgtgccttactgcttagagtgagtttgctactgcaccactccagccagccagggtgatagagcaaggccctgtctaaaaaaaaaaaaaaaccaaaaaaaaaaacaggaagaagaagaaggagaacaattgtttcagagttaaaaagaatcttaaaaatcattgtgcttgacaacaatttttatgctgcaggtgcttctctccaaagaccattggtaagtttacctgtaaatggaaacaaaatatgaacaatccccaaatctgtgtttctgaagatttattctttctaatgcttgagcattttgaaagagagacagattaataagaaggaagaggcttcctagtatgagggaaagtgttcatgagttttagtcctagctttgactctcattacacatgtgaaaattttctcatctttaaacaggcttaaatacaaagaataactgaaaaatattggaaacctaagtggttataatgttgtatctagcagtgggactaggagtgattctttgtttggtttggttctgtttttatttccaaattttatgcactgggagtgtactccttttgtatttactacttcacccccaccagccaaaatgtcttaaaatgtaaaatcatgaaaaataaaaggatagggatgattttcagccccactacctcatagggtttctatgaaaatcagatgaaacaatgtaagactgcgcattgaaaaataaataataactacataataaagtattgccaacatgttagatttagccttaaagaaattcagtttctgtatagggcaagtggagtggcatgcaaattcttgaatctcttgaattcatcatttcagtttgctattcctgcaagaggaaggaattccatagatccaaaatgcatatctatttgtcgcaaagacaataactaaagattatttgctgctactacagactgatagcaaatttatcagcattaaaataattattttaaaggctacaggaaaaacatgatcatggcaaggaattatatcatgttcttgagtagattagggagaaagaatagaattcaggcagacgaggcttgcctatggtccccaacctttttttgacaccagggaccagttttgtggaagacaatttttccgtggatgggggcgggggtggtggtttcaggatgaaactgttccacttcagatcatcaggcattaaattctcataaagagcacacaacctagatccctcaaatgtgcagttcacaataggattcgtgttcctaagagaatctaactctgccactgatctgacaggaggtgaagttcacctcctgttgtgtggcccagttcctaacaggccacagaccagtgttggtccatggcctgggggtacccctgcacaaatctaaaaactctccctttgaggcatcacattacccaactggaaactatagtataaggctgcagtaagcaaaacagcatggtactggtacagaagcaaacacattaaccagtggaacagaatagagaaccctgaaataaagccacacacctacagatgtctaatcttcaacaaagctgacaaaaataagcaatggggaaaggactcactggtcaataaatactgctggggttgttggctagccatatgcagaagaatgaaaccagacccctacctttcaccatatgcaaaaattgactcaagatggattaaagatttaaatgtaagaccttgaaatataagaatcctagaagaaaacctaggaaataccattttgtacatgggctttggtaaagaatttatgactaagtcctcaaagcaattggaacaaaaacaaaaattgacagatgggacctaattaaactaaaaagcttctgcacagcaaaagaaactatcaacagagtaaacagacaacctacagatagggagaaaatattcacaaactatgcatctgacaaaggtgtaatatccaaattctgttaggaacttattgaacagttgaacagcaaaacccaaataacactattaaaagatgggcaaaagacatgagaagacacttctcaaaagaagacatacaagcaaccaacaaacatatgaaaaaatacttattatcactaatcatcagagaaatgcaaatcaaaaccacaatgagataccatcttacaccagtcagaatggctgctattaaaaagccaaaaaacaacatgttggcaagactgcagagaaaaggaatgcatgtacactgttggtgggaatgtaaattatttcagccactgtggaaagcagtttggagatttctcaaagaacctaaaacagaattatcatttgacccagcaattccattactgggtatatatccaatagaaaacaaatttttctacgaaaaagacacatacatatactcacatgttcatcgcagcactattcacgatagcaaagacatggaatcagcctaggtgcccatctgataaagaaaatatggtacatatagaccatggaatactatgcagccataaaaagaatgaagtcatgtcctttgcagcaacatggatgcagctggaggccattatcctaagtgaattaaggcaggaacacgaaaccaaataccgcacattctcacttataagtggaagctaaacattaagtactcaagaacataaagatggcaacagtcaacactgggaactactagagaagggagggaggaattggggagaagggttgaaaaactaactgttgagtgctgttctcagtacctaaataaggggatcattcataccgcaaacctcagcatcacactatatatccaggtaacaaacttgcacatgtatcccctgaatctaaaataaaagttgaaaaagaaaaaaaaaagaactatccctttgggatgttatgctgaccacatagaaatgtgggaaacctgcttgttagtggtgacacccacatggaagtgcttattttacttatccaacttcccacaacctttgtgattatgggccaccatcaagagatctcatttaaattacatttatccttcatatgcttttatgtttgtaaaagtaatacatacccttaaaattcagacctttcagagatacactatggaggaagggaaaaagttccccataatcttagacttaactgatattagcatgtttgtatacagtccttcaaattttttcaatgcgtatattaacatatttagtattcatttgcttcacaaagaatgtgtttatatattatatactgttttgcatctttttctcttaatacattttggacatatttttattttatttgtttatttttctttgttttttgaggtgaagtcttgctctgtcacccaggctggagtgcagtggcgcaatctcggctcactgcaacctccacctcctgggtcaaagctattctcctgcctcagcctcctgagtagttggtattacaggtgcacgccacgatggccagctaatttttgtatttttagtagagatggggtttcaccatgttaaccaagctggtcttgaactcctgacctcaagtcatccacccgcctcagcctcccaaagtgctgggattacaggcctgagccaccactcccggcctggacatattttataaaaccctttgtaataccagttgtcttaatttttcatattctttcagagtcatttagtccgtgatttcagtggtacatgtcttacaaagttaaaaaggagagctggatagtgatttctttttttttttctttgttgttcttcttttttctttttccttcttcccttcttcctttttttcttcctcctcctccctccattacctcctcccttctgtccctcctcccccctcctcctttctccccttctctccttgtttttccctcctcccccttccctttctcccatctttcttctttctcctcttctttcttcttcttttaggtaagaaagagttttttggaatgatctttcagaagcagttgctataggcaacaatattaggtttgtctatggctctacttttgtattagccaatccattacttgtgattgttgtgttgataatgggaatcgtgaattgattacttcatcaaagcaattttttccacactgacattctttctagcaatgaacttgtgaaatcaaatggaatttagaggtgatgctcctctgttttggaaaggtggaatgagttatccacctagaaacaaatctgatctagtcactctcctatttagagacttcttttgacttcttctctaaagaatagaatccaaatttattctcttagtttgtaagattttcttgggtcacctctctagccatgtatgtgcttcagacacactgatttcttgctgttcctcatccttgtgttttgcatcgacttttcttccactaggatgctttttgccagcttctctgcttggtgaaactcgtatgtttatagctctttgataaggctttgctcctccccctaggcacaactcctcctccttgttctctacttctattgtagtggttctgctgctatagtttaacttaccttaccagtcctaatctttcttttaattttttattgtgtaatttattgctgcatatgtattatattttacaataattaatattatatatttgttactatataatttacatatcgtaaagtacacaaatcataagtatacagttgatgtatttgccaggtctgaatttgtacctgggctgtgagccttcagagggtaggaacaatattttagtcattcttatatcaccagaggtactcaataagtacttgaatatgagcgaccactacataatttcctcagttcatctagtgtctatttctttatggaaaggggacattaacaagtatttttttgtagatgtttcaaaccaagtaatatttgtttactgtcttgctactaatctcaaaagttgagagattcaacctaaaatattgatttcctagtggcaattatagatcagtgactaaaaacaaatttcatccatttttctactcacttgataatgttttattagaaactataaatcttaagacttgaggtattaaacagcagagagatatggttaggatcaaacttccttttcctcactatttattccttatagaaaaaaagcaactaccccttcccttaaatttattattattattattatttgtgatggagtttcactctgtcacccaggctggaatgttgtggcatgatctcggctcactacaacctctgcctcagggttcaagcaattctcctgtctcagcctcctgagtaactgggattacaggcacccaccaccatgcccgactaatttttgtatttttagtagagattagatttcacgatgttgatcaggctggccttgaactcctggcctcagatgatccacctgccttagcctcccaaagtgctgggattacaggcatgagccactgcacctggcctcccttaaatttaaattcccttaaatattccttttgaaagatgctttttaccattgctaaagaagtggaatgatttcaaattaatttcaaaataatttcaaattaatttcaaaattctcccactaaaagttgctgacatattaaaggaaatgatatttatgcatgttttctaaaagctagatgtagaaaacttgctcggagtaatttgattcaacaaaagagtttagtagtttccttgaaagataatcctgaaatcaatacctttaatttacattaggcactcaaagaaaataaacacatttccctacttaaaaggctggtccaggtactttttttgtgctagaaaatcaaggctgaaatatctttactttgtattgattcagattttaaattgttctttgaaaagtatatatggaaacagatttttaaaaatgtataaatagataaacatgtataagcagagttttaaatgtatagaaaaacagatttaaaaaacatgtccaccaaatggacatcttttcctactatattcagtaacctaaatgaccctatcccttctcagcttatcttaattttagtatacagttgcccttcttccattaattaatcaataagctcattcattcacataatcagtcattgttgatgcctgttatatccaaggcactctatattctatatgctttatattctatgtactctatattctggagacatcaagatgaaaagttcagattaaaattttcctgactccatttttaaaaagttagtttttacttttatggttaattgtcttaatttaacaagtgtccatttaggatgtaatctgtgctcagtactgttgtacatcatgatctatattctctctagaagctagcattttatcccattgatttaaataatgtctaatgaattttaagttcttcatgtggttagtgttttacattttatgagtaataatgaaatggaagattcaagcaaactccattttcctgagaaatatgcatctctttatttcccaatgttaattatctaaatgctgttagttaatgctatattactacaagcttttttttaaaaaaagagacaatatcctttcttaaaagaatgttataaatataaaaaagtacttgtgttaaataaatgttattgttcatttttagagaaatcgagtgttttcttggcagagatgggagaagaaatgtaattgcttaaataattaagtattcatgcttggaaacccaacttctgttgcagggttaacatatgaactggtgattaactgacaaaaattaagcatatgtgtttggatcatggtttctgtggaggccatagatttgctttatggaaacttgagcttctgtataacagagtttgaaaccattacatgatcaggtcatttagtaggacaacccaataaaaggtaacttgaggccccatgataagaaagtgtctaagaactaagtgatatggttacttaccaattaaaatgagaaaagtcatactcttttagttttcatctgttatggtcatggggaaaatatttctttgaattcggtcctgaacccatctgagacttggggaacattagcagcttctcagtgcatactttctagggaaggagataatggaagaccctttcttcctgtcttctgtggtctctcttgggagcccaggtcttactcagaataggttctcatacttagaggaaactcagattgctttggtcttagcctgtaaatcaaagggtgaagactttttctgttttccttaagagagttctgccctcagtagagggcagagaaagaatatgtgtcattaatcacttgagaattgtttacaactataatctagagagcacttacttgcccatggcaggcagtaaagttaccttggttgtgtaagaataacctgagtggtttactcagactgttcacaaatgtttggacatcattcaagggctgtccaagtctgactagttagctttatgatatactcagatacactcagattcacctttataccatccaatcacatttaaaggagggtgtttcctgaaattgcaacattactgacttcccagccatgtgacatagcttttcagactctaagttaaattttaacccagacatctctcttcaattcaggtcacctacaggccagacaaagccaaggtcatgtattgagtgaatataaggagttttgttggttctaataactgtaatgttattcactggttgaaatactataccatggttaatcataagttgcagctgttgtgtccttttatttatgagcccttaatcaagaggacacagcaagagccactgtttgaaaggagcctttcatgaggtcttctctttgggtgctccttcttgtttcattgtgaaaagaagagaagtttatattgccttgcaaaagttattaaatagtatatgttggcttctctgaaaacagatttttctattccaaatttgaaagatcaaattataatctttatatttcagctgatgataatagaaacactaagcctgtgctctccaaacaatgtcttttaattggtgccaagtttgattgaatctcaatatcagccatcagaagttatatgttggctctctgaaaacagactttcctatccagaattcaggttttctatttgtgacaatatgtctctgctgatgttaaggtaaacagaccagagctctttgtgcagccctttttactggtcctgaacctgatgaatgagattttaaatgtaagtcaatctctctctccttttttaactttttggttttaaatcctcccttattttatgagaattcatcttatgagttacccttgttaaaatattggcatatccaggagtttgaatagggtcattttctgaatggattttggaataattacgtaaattgatttttctgatcaaggaatttagtgataggttatattttcaaatgtgttgattgtcagcttcatcctaaattgcaatgtaacacaaaagctggtacacagctcttttctttgagacactcaaaatgtttccaaactttaaattcatactttttactgataacatttttgtggatctcattcaggtaaacttttcttcttcacttgttgatcccgcgtgacccctccagccacacaggtttcatgtgcttccctgaatacagcatgcacttagcaccctttatagcctggatagtgttgttaccccagactagaattctttcctcatctccattacaatacttgacatccttcaagacaacactcaaatgctacttatatcattaaatttcctccctgatttctacttggacttaaatgttgctctttgtaccactttatttgacctgttgctgaagcacttagttcactgtaccttgtattttaattgattttgtacatgttttttccctcaacaagaagcaaacttattgaggtctgggaccatatcttcaagcagcctccagataattggcttggcacaaaattgcatgcatctcttgttttctcataactggatggaaacaatgatatttagatttatcagaactgctacagagggctaaagggatgcaaaaacacttggtaaaattcaaaattctctttaaagtagtcagtattgttctcaaaacaattacatcaaacttttagtgactgaagtgttgtaataatttgtgattttcaaagatactcaaaatttaaggtgaacagtgagccagaacacaagatgatatacctaatctcattcaccagtctgttttgaccaagtcaagttgaggcaagaatgctgggaacaagcttttctgattgaatgtgttaatttagcccgccttcaaacttcttaaccaatggcttccactctaccacctttcaacgcttttttttctgtaagatggcatgttatctgttagaaataatggggatcacattcattataccagcagtagtctctctgtgatcacactcattagactgtttactaccacgaattctgggagaaatggcctgggacattaaaagaaacaaacaagctaagagggctgtctaggaccaatgacagttattggatttgttttaagaattaagcttatgagttacacttttttcctttgcagcatagatgaaaatcatcacttgaggaacatttcaacatcatagttgcaagtataacttacacaatggaaaatgtttttcattttgagaagaggcaattgctattttgtaatggaacgcaaggactactggagataaaacttgcatgcaagaccagtacagcttgatgaagggagcagagtctagtttaacctctaaattaggagatgtttgttttaattttactgctattccaggcaagaaatattaagtgtctgctgtgttcaggactgctaaacattatggacaatacagtaatagtagaagacatggtgtctgcccttgagggagtgaaaattgaatagacaactcttaactatcaggatcaacaaaaaaatggtgttagttagggagtaataaaagtgccacacggctaactacaaaccagaaggccagggacggattactgtgaactcagctgctgtgtagctttgagtttcttgaatattgtccatgacccatttattttgttttaaatagagaattatatctgccctctaccaaatacacaggaataatctgagtaatgtttataactgtgatctgagaactttttgagtcttttgcaaatctgtaaacacagagtgagaatgagatatgacagtgtggtaaaagaggacttttgagatttattaatatttagaagtacaagggggaagaatacttttatagtatgattataatgttaaagatattcttcctttagttttataaaatgtggcttttgatcagtaagtggcaacttagaagaaaagtctatcctaagttgatttgctattccttgaccttaagaactatagaacactttattttctcctaagaccacttttttgtttttattttactccattcattaattcattcagcacataataacgaagtatgtacttggtggcaagcactgtggtaggacctggggatatgaagttgaagaagacctgggccatatctctaaaaaccttgtgaggggaaaccaagggggaaaaagtttctactattttaaataattagaatagattttattttatagttaaatttgaagaaaactacaattttagttagatttactatgccatctttactcatttgttcactcccattcgttcatttttcaagttaatgggtgctggaaacctgagtcatccttgacatgtccctttcatttgccctccaaatgcaaacaaccacctgttgtttcagtcctttcaaatgcctgcctccagaatgagcattaaatctgtcaacatatttaccatctcagcttctccagtcacctcctaactgctctcccagtttccactcttacttacctctaattaacagctttcagacttttttgaggatgacctacaattaaaaaatacatccatgatactcccagtacacatacttgtgttgctatgtatctataagtaaatccaaaatcaaagattaacagaataatacgtatcttttctcagtatcatgcattttgatatttttaaaaattatattcctggccgggcatggtagcttacacctgtaatcccagcactttgggaggctgaggcaggtggatcacctgaggtcaggagttcgagaccagcctgaccagcagggagaaaacctgtccctactaaaaatacaaaattagccaggcatggtggcacatgcctgtaaacccagctacttgggaggctgaggcaggagaatcccttgaacccaggaggcagaggttgtggtgagccgagatcacaccattgcactccagcctgggccacaagagcagagctctgtttcaaaaaaaaaaaaaaaaacaacaattaggggccaggtgcaatggctcatgcctgtaatcccagcactttgggtggatcacgaggtcaggagttcaagaccatcctggctgacaaggtgaaacactctctactaaaaatacaaaaagattagctgggcgtggtggcaggcgcctgtagtcccagctacttgggaggctgaggcaggagaatcgcttggagcttgcagtaagcagagattgcgccactgcactccagcctgggcgacagagtgagactccatctcaaaaaaaaaaaaaaaaattatattcctttgtcgctttcttgctgggcatgattaattaaattcactttatgatccattaatgatgtgaaatttactgttctaatacttttaaacacaggttgtttaaagccagggtgataggtttatattatttccctgcttaaaatgtttcattggcttctggttgtacttttagaattcaacgtagaaatcattgtatggcctacaaagtcctgcatggtcccactctgcctcctcctcactctttcctacttctccacatcttcacacaggttctttcctctccatggaataatagtcttccttccccaatcttcaccttgccaattgctattattctatgggtctctgtgtaaaaatcactcctttaagaaaattagatctccccttataattcctcttcctcctctttttattcactgtatttattataattgtataattatatatttatttgtatgacttttttatttaatattagtggcccacactagattacaggttccccaatatctaagaccagatctgttttgtttattgctatatctacaatacctggtatagtcctagcataatcagcaaatattcttggtatgaactttggatcaaatgctatgcttgccccacaaaggtgaataaaacatagactttattctcaaggagttctactcttttgacatggagtatactttgtttgaagacaggtatctaaaagacaaaacaggttaataaacatcttagaaagggtattagaatgctggaaatcctataaacaatggcttctttagtttaagactctaactggagggaagttttccttatttactcatgatactaactcaaggaaatgcaatgattttttttaaaggaagcagagatattattcttttattgaggtaaaatttctagagattgaaatgcacagatcttaagtggacaattcaatgagctttgaaaaaaatattttcttgtgttcccttccagtcaatctcaagcctccttaggcaatcactcttctgatttctatcactacagattagtttttcctgtgcttgaaactcacatacgtagaaatcaagcactgatatctggcttctttcagacggcctttctttttagatttatccatgttttgtgtgtattttttgttaattccttttttagtaatgagtagtatgccattgtaaaaatataagacaattactttttagccattcttttagggatagatatgtgggtaattttcactttagggttattatgaataatgccattatgaatatgcttatacaagttctgtttttgaaattggtgggtcagaggatagacgaatgtttaactctaaaataaagtgccaaactgtttccaaagtaggttatacaaattttccattaccaacagaaatataaaataattatgtttgttctacagtttcactaagagcttttttctttaattttagacattccagtaagcttgaaacagtcttgcactgtaattttaattttgatttcactgatgactaatgatattgaataccttttcatgtgcttattaagcactcacatattcttttgtgaagtgtttcttcaatcttttgatcagttttattggctgtttgtctttttattgttggttttggaagtttttaaaaatatattctgaatataagtcctttttcagatatatgtactataactatgtcctcgcagtccgtggcttgtcattttaccttcttactggtgtctttattgagcaagttttaattaaaatggttagttctttttatagccttttaaagaaatctttgtcaacctcatggttgcagcaatcttcttctacacctttttctagaagctttattgtttcatctcttatgtttatgatcaatcctgaattaatctctatgtgtgtcatgaggtagctatcaaggttcatttttttcccatatatttttccagcgttctctagctatcttttgaagggttttctctttttattaaattatcttggagcctttgtaaaaattatcaatttactgcatatgctttactctaactggactctccatttcgttccacagcaggatttgctatctttacaccactcctatgttgcttaggctctgaggctttatactaagtcttaatatcaggtagtgcgagttctctgactttgtgagttttttaaaaaatcaatttttttggtataaatattttgcacttcatataaattttagattcagcctgaaaattttgagaaaaaactattaagttttcactgggattgtaatgaatctgtgttgaactcagggtgaattgacatctttaataatatggaattttccatgaccatgatcatgttttctctcccaattgattaggtctcctttaatttcactcagaaatatcttatggttctcagtgcagaggattgtgatggtattttgaatgactatgaataaatttttggctgatatattaagtcaataatagatacctttgatttttattattatttctatattattatgcagttctcagccttgaagtttgaaagactttaataagacattgacaccagtctcccacttaatgctggaatgctcaattacaaatccctggcaaatgttcattagactttgaactcttccaatgctggagaaataactgttacacaaaacaccctattccatttggggacagtttgaattgttggaaacgttctttttatattgagctagttttctgcctgttgtctgccctttggagtcatggagatgagtttgccctctctcctacagagtaccctccagctattcgtagatagctaatctgcccaatgaattcttttttcttgttgaaacaattctagtttctctacttattcctcgcatgacatgatttttgtatcttttctctttctctgactcttttgacatgctccagttttctgtattttctttaacttttggcatccagaatagaagcaacactccaactgtgtccagaccagtgcagagcacagaaagactattttttttccttactctgaacactatacttctgctaatctggccttaaatatcatcagggttttcagcagccaagtcacactgttggctcatgtaatgttcactgtcagctaaaacccctagatctttttcacatgaactcttattcagactgctcattctttcatcctgaacttaggcctgtaatagttttctttcttgtgttcatgtaatagagtttacatttattcccattcagtctcagaacttcagaccaatcttctagtcagtcttttgtggagtctataggcttgacaaaagaaaaaactcagactccagtgaataccacaaacagttatttgctttaggttcaggaaatgaaaatgtgctggttttaagtttctgaagttgcctccctccttcatctcattccgtcctcccccttcagttctttggtccgagacccaatagaggatgtctacagccactctccctctagggagggcctgggtctcatcttccacccactgccattcaataatagcttgggtctgtcttggctaagccaagggaacatccagcttcactgagaaaacctttgctgcatggtgatacgccacctacttgcactgtagcgttgtctggcaggtttggcccattgtctcccagaggaaacagaaaacaactccccagcaacccgccaatctcttttgtccccacagtcgagctctggaaaatatctgaatgccacagaagtgggagtaccctttgatgtttatattggctggctccttttcctttttgctttttctttttttcatttaataatcagggtagtagaaaatgcggagaattaaccgcatgacagcagcagaggaattcattagagaaacagagatgaattctgctcagatttcaggctctcaggcagaagacacaaaggagtaatcgtcttctagttttttttaatcatttcttttgtggcaccttccttgtccatgaaggcaatctcagcgtctggcatgggggagcccaagaacataggcagtgcaaatggtggctttgatttggggattattacagcaatattaaccacttccttcttacctctctttgaaaagatggagcttgtcattcttggagaaggcagtgaacagtgctatgttattgcttttatttaaagtattacccactaaaacttcattttaaaattgggaaaaatgtgcataacattttactatggaaaattcttgaacagagcaaaaaatgctgaggaatataattttgcaaatgtgttctcttctaacttaatatcctcagagacccttccttttatgagcctcaaagacagctttagtgatggcttacacaaaactaagtaaatttacgcatacaattttacttgaaggaagttggtaaaataaatcaataatttttttttcttcttgagacagagtgtcactctgtcacccaggctggagtgcagtggtgtgatcacggctcactgtagcctcaaccttgcaggttcaagtgatcctcccacctcagcctcccaagtaactgggatcacaggcatgtgccactatgcctagctaatttttttttttatttttagtagagatgaggtctcgctatgttgcccaggccggtctcaaactcctggactcgagcaatcctcccgccttggtctcccaaagtgggattacaggtgtaagctaccatgcccatccacatggttttttctataattgtacaaaggcagcagctggatccccagaagctactggtaatactaagatttccctcccaaagtcgaaagtagtcctgattgctttgcttaagtagtagagtttcattactattttaattcctcatgaattttttaaaaaatacaaatcatattcggagtttcatattgaaattatttaagagaaaatttttttctcaagtactgttacacactttaaaagcgtgtatgtaatttattgattttataaatataaatgatttgcatcttatgagagcaagttctataaagctctttcttggttacaatttttagcatggttttatttttaagtaaacatatctacctgaaagcaatgaaaagaacagttttgaatcttagtgatatttctggaaagagaactcattaacctgaagtactcatgcatataattaatttaaaaaccatttggttttaaccttaagctaatccaatcaacttgtgctttcatcaaacatttaaggcctaacagggacaggtctggtatcacaaaaactttcccagggaatactcttcttatggctcatcttaggacataggctgtagaactatgtcctagaaccagaccattagcaagtaagtcaccttttcataccatgtttctcctacctgtcaagcgaagatgcaggcacttgccacctgtcaatgggagaaaatactgtatatcaatcttttttatatcagtgataaggaggaaggatagtgatgactgtggcctgtagagggtatagggaaggctctgtggaagaggagagatttaaataaggcttacaagaatatgtaggatgttagtcaatgaccgttttttgagaatattgataaaaaggcatttaagatatgttgcctgcttctgatttggattggcatagaaaaggcatgaagacaacatcagaaagggagtaaaagcacaggtgtgtcaaagcacatgcaggcatatcttggagatattgagggattggttccagaccaccacaataaagtgaatatggagaaaaactgaatattgtaataaaggtactcacacaatttttttggtttcctagtgcatatcaaagttatgttaatgctatactgtagactcttaagtgtacagtaccattatgtctaaaaaaccaatgtatatactttaattaaaaataatttattgctaaaaaatgctaataatcatctgagccttcagtgagttgtaatctttttgctggtggagtgttttgcctggatgttagtggctgctctctgatcacggtggtggttactgaaggttggggtggatgtgccactttctcaaaacaagtcaacagtgaagtttactgcattaatagactcttcctttcatgaaatattgctctatagcatgtcataatgtttgataacacttaacccatagtagaactttaaaaatttgagtcagtcctctcaaaccctgctgttgccttatcaactacgtttatataatattctgaatcctttgttgtcatttcaatgatgttcacagcaccttcaccaggagtagatcccatctcaagaaactactttctttgttcattcatatgaagcaacgtcttttttttttttttttttttttttttgagacggagttttgctcttgttgcccaggctggagtgcaatggtgtgatcttggttcaccgcagcctctgcttcccgggttaaagcgattctcctgcctcagcctcctcagtagctgggattacaggtgtgtgcctccacacctggctaattttgtatttttagtagagacggggtttctccatgttggtcaggctggtctcgaactcccaacctcaggtgatctgcccacctcagcctcacaaagtgctgggattacaagcatgagccactgcgcccaggcatgaatcaacttctcatcagattttatcatgagattgcagcaattcagtcacagcttcaggctctacttctaattctagttcttttactatttccttcacatctgcagtgacttcatccagtcttaaacccctcagagtcatccctgagggttggaatcagtttctttaaaactcctgtttatgctgatattttgacctcctcccatgaatcatgaatgttcttaatggcacctagaattgtgaatcttttccagaacgttcccaatttatatattttgtgaagatccatcaggggaatcactatctgtggcagctataaccttacaaaaatttatttcttaaatattaagacttgaatgttgaaattattcctcgacacatgggatacagaatcaggcatgaaaacaaccttaatcttatgtatctccatcagagctcttgggtgactaggaacattgtcaatgagcagtactattttgaaagaaatctttttctctgagcagtaggtctcaacagtgtgtttaaaatattcattaagacatactgtaaacagatgtgctgccatccagactttgtcgttccacttctagagcacaggcaaagtagcttttgcataaatcttagggactctgggttttcagaatggtaaatgatcattggcttcaagttagagtcatcagctgcattagcccctaccgagagagtcagcctgtcttttgaagctctgaagctaggcattgacttctgctcttgagctttgacagtctgagatggcaccttcttccaatatgaggctattttgtctacatgaaaaatctgttgtttagttgagtcgccttcatcaatgatcttagctagatcttctggataaatttctgcaacttctacatcagcacttgctgcttcactttgtatttgtatgttacagaggtggcctctttccttaaacaactcatgaagcaacccctgctaacttccaacttttcttctgcagctttctgatctctttcagcctttgtagaattgaagagttaagcccttgctctggattagactttggcttaagggaatgttgtggctggtttggtcttctagctaaactactaaaattctccctatgagcaataaggttgttttgccttcttatcattcatgtgttcattggagtagcacttctaatttccttcatgaacttttgctttgcattcataacttggccaactgtttggcacaagaggcctagcttcctgcctgattcagcttttgactttccctcactaagctaaattatctctaacttttgatttaaaatgagagaagtgtgattctttctttcacttgaacacttagaggctattgtaaggttattaattgaactaatttcaatattggtattgtctcagggaatagagaggcccaaggagtgggaaaaagatggggaaatagctggccaatggagcagtcagaatacacatatttatcaattaaatttgctgtcatatatgagtgtagttcatggcacccacaaacaatgacaagaataacatcaaagatcactgatcacaggtcaccataataacataatcataattgaaaaagttagaaatattgtgagaattaccaaatatcacacagagacatgcatgagcacatgctattggaaaaatggcactaatagacttgtttgatgcagagttgccacaaccttcaatttgtaaaagttgaagtatctgtgaagcacgataaagtggagtacaataaagtaaggtatgtctctagtgtgtttgtgtacattaagtggtggaagatgtgatttaattttttaaaaaatagccgtttaccctagataaatcagtaagagatgagtacaagtatgtatctacaaattatttttatttgtgctctttataagaattaaaaattgaaaaactcccaaataattaatgaagtaaattatctttcaagtatacactgtattgttctatagctattaaaaatcatattgtataaaaatatttattcaaatggggaaatactcatgatataggaagaagtgaaaagtaggttataaaacagaatgtatagtatggtccccattttgggaaatatatttacacttatgacaataaaaaaatcagacaggatacataatgagttgttagcagtggttatatatactctgagaccatgagttattttgatttttgagaggcgagtgtgcttgttggtgttttcaactctttcctaccataaaatgtattaattcactattcaatttttttaagttctaagaagttagacacttatttattttaggtgttatacagtccatagtggaaatttgagatgagtgacagaatgaaaataatatggttgcagacaaatgtgataaatatgtgtaagatgtttttgaatagacaaagcctattttaggagtgatgaattgtagcaataatttattgtaaaatgatagatgtttgaaatagggtgggagtggtaggaattcaaaggaagggatagatatgaaacatgaaggatgaatgggcagtatgtggtgaaatggctctgagaggtgagagagagaagactcttgaggacaagtgcaatgtttcaacctgcttaggataataaagccaataaaagatagagacagcttgtttgggggctgagataaaaggtttcaatccaggcttttttggttgttttttgtgttgttttcttttcttttcttttcttttttttttactttttatttggaagtaagaaagttgcaagaatgaaaacagtccacataacagtcaaatacctttacccatattcacctgttgctaatattttaccacatttgctttataatttactcgatctacatatgcatatatatgtataatatttttctgagccatttgaggctaaattacattcatcatgattctatacccccaaatacttcggtgtggtatttccaagaaaggggatattctgttatataaccttagtagagttatcaactttggtaaatttgattaaatacttctatctaatctaccatttatatgccagttttgtcagttggctcaaagatacaatagtgttgtttatagcactttttccctccagcataggatccagcataggattaggtattgcctttagttgtcatgttcctttagtctcctttaatctggaacatgtctacagcctttatcttttatgactttgtcagttttaaagaatttaagccccccctcttgctttttaaaaatttgtctgatgtttccttatgattagaatcaggttatgccttgtcatccaggtgatgttttgtccttgagttatcacatctgcaggcacataatgtccatctcccactcatggtgatgtaaattttgatctccaggtcaaggcattgtctaatttttcctttgtgtaggtactgtttttcctttaaaagcactgagtaatcagtgggaaacaaatagcttgctcttcatcactacccccaaatttattatctgttgatgattcttgtatagtccaaactttataagatgactgaaaaatcatgattttccatctttgacattccttccacattcgcctgtcaacagtagacattttctaataagcaggagctttttcttctctccatccaaacatgcatctcttaccagtttgtactggtcatggaatccactgttcttttcagtggttgatactgtaccagatcattttggtatataaactgtctcagatttagccagtatgttctggtatcatatctccaccgtctatttttttttttttaacacttccttgatttttggcataagttattctaggcacaccttgtacctactctgcctaagctctgaaatcacccattttcccaagaaaccccagttctttttttttttttttttttgagacggagtctcactctgtcacccaggcggttatgcagtggcgcgatctcggctcactgcaagccccgcctcccgggttcatgccattctcctgcctcagcctcccaagtagctgggactacaggcgcccgccaacgcgcccggctaatttttttatatttttagtagagacagggtttcaccctgttagccaggatagtctcgatctcctgacctcatgatccgcccgccttggcctcccaaagtgctgggattacaggcttgagccaccgcacccggccaccccagttcttttctggtggaaatagtgttaaagactaagttctgggcataggtgtgctcattactattgaggtatcttggctcttggctctttcagtgaagtgaacttggggaaaaatacacacacacacacacatacatatatatataaatacacacacatatacacctacatatgcatatatgcatattttagaaatcatgaattgattcattgatatctccaattttaattcattcccacaggtttcttacttgcccaattcagttttacatggcttctgaatttgaaataataaggcaaaatggtagagatgttcagcttgcagtgggggaagatagaaaatcgaaattcacatgacagggtgaagcatagtgattaagattaggaagtcatccacacagagttaggagaaaatacatctagagtttgccaaatccaaaggcaagactgtaagaaaaagatactaaaagagaaaagagcagaggatgtctctgcattttgtgatacattaaaaagttatggtaggagaaggagataaattaagaatagcctggggaaagagatgtagagagtgaagtcaaagaagcaggggagccagtactaggtagagtcatggtggtcaggattagaaagaattccagcagtccaatactgcagaatagtcaaggaaaattgaagaccgagactgggcctttggatttgatatttggttaccaaaggtttttaaatctggatttaggaactcatttgagattttttttttgagaatataacttttaaataacaagtcagctcacgttaattaatgtttaatgttttggggacatttacatttagcttttcttaaccttttaaatgtgttcactaaatattattttatttctaactgcaggctaagcaagttatactgtgtgtataaagtgcccaagtctaagaggcattgtagacaggctatttttagggaaactcatgtttttctttaaaagttcagctagcatttggaatcgatatacagtataatatttaaaaaaaaaaacaacatatttcctcatcccccaagaggtttcttaaaatagcatgtaatcttacctacagtgggaaaagcctcaaattttataaattgggttggatctaacccagattacctgaccaagagagtccccaagaaaaacaaggtgtggtaaaggttatagtaatggtaattaagaaagttgtgttgtgcctgctgggcctcactaaaagcaatgacccagcctgtggctactggcatcattttgactgctgagacatgctttcttttggagagaagtccaaaccaaatctttgcccactttgaaagccaagatattctcattcctttcagccacagaaagggctggtttttctaacaggatcatgtccgtgtgaccttctgatgtatcaacttgttttctatgcagtatataaacaataaagggtttaattttagttgcttttcttcacagagtcatggaatattacaaatgttagaagctagagaggatctttgaggttatctgctttaagccccttgctttccacaggaaaacaccaaggctcagagagataaaatgtgtccatgctggacacagctggaaaatgatagagcttgaactcaggttaactgaccctccatgcaggtctgtggctgcaccatacattacagcatctctattcaacagtaaaactcattggggttatatattataccctagtggatattacatctgtgggatgacaagctgcattatgatagagttgcactgtgctcagcagcagttgagtagccagcacccacaggcaacctctatgggcaatctgaaagtgaaatctttactgaattgaatggaatctgtggagatcttcgatagtcttcccttgaggtgaaatcttgttttgttgagtggtttaagatgttttctagggtgtagcactttgcagaagtgctttcctctttcatgataggtgacccagtttggagatcaggaagattttgtcatccttcacattgcaagacttgaagacttgcaactcaaaatggtatatttttttcttttcttccaatagagaacaattccactctagcactcaagtatctaatacttttgggacatgttgaaactgtttccatttcatctgatttcactcagcaattatttatagaactctctgtgaggtaggcaccatgctaagtatcctgaggctgacaaagacatcctttctaagttgaggcagtgacagagggcacagcagccattgctaattgtccttgctgcagccttgttgggtgacacctctggcttccagggcctcatattttcacagcttcactgataactctctgagaggaattgtccctcccactaagattcccttctagaagatgagtttttccatgagcattttaaaattttctttgttgccttgttcatttttttttccaacatttaaaagagcagaagtgagggcgaagagaaaggagaatatttagatctgaaaaatgcaccagtccacttttaatctacttttgggaagatgattgtaagatattctgtacccacttagggatctcctgcccttcggatacacatgccttaactaccatcttgctagaatagaaggtcctgtgtttaggcatcaaagaaaggaattgcactgagaaattttagtgataattcttttattgtaatcgtgattttcttcctcctgctaatctttttaagtggtattaaaggaagcttcttgccaggcagtaatattcctccatgagcacacgatctttttccttatttggcactggaatttcatcaggctgtattagtctgagcgaaacatactctaggaataccttttttttttttttttgagacagagtcttactctgtcacccaggctggagtgcagtggcgccatctcagctcactgcaacctccgccacccgggttcaagtgattttcctgcctcagcctcctgaggagctaggacaacaggcgtacgccaccatgcccagctaatttttgtatttttagtagagacaggatttcaccatgttggccaggctggtctctaactcctgacctgaggtaatcacctgcctcagcctcccaaagtgctaggattacaggtgtgagccaccgcacccagccaggaatatctttagaatagttctatagttaggaacgttgagaccaggtaacaagggatttattcaatgggatgacaatttttatacaccatgcctgaagcaaataaaggtgatcagtatttatattgcagtattcaaatactctggagccaaatagataggactaccttaaaaatgttcttgtacatgtgggtttgatcttaaagatattagggatggtaacataccattctatgtatatacatgaccaggccttaggttacttaagggtgatggaatgaccattgtgtgtgtcttgtgtcttggtggccttcagtgaattctgcatgagctctagtagtaactgccactgctgtagtatcatggaaaaaacactgaacttaaaatagttttcttacctgtaacaaaatggacaacaatctcacagagtttgtgtgagaattaaaggagaaaatacttgggaagaagtgctttgaaatctccattgcactctgcaaaagcaaggaaatgcgcttgtgatcagtatcatgttgacgtggagtgagttactccccagctgttcacgatatggtcgcccacaaagagcaagtaggtcacttcaccaaacagaattctgtatgtattacagaaactcccaggctgagtcaccaagtaaaatgaagggcagtgtgctctatttaaaatgttcatttcattttcgcattccattctttactaacagaatggtttcacttcatttccagtcactttcattttcaggttgtcaagcttcacttagtgtcagttgtgttcccacactcaaacatgtgccttgtcttccttgatcttctctctgaggatgtttctctgactaatgtgctgtggtcagaacaagagcattgccacatggtgcatttcctaggtaggcatgtctaaaatcattaagtggcctagctcagaacattctttgtgaccctttcccctccccacccagtgcctagtgactgatttatctgaatataaggctacttccacttttagttcaagggccttgctccctgcctgcaagaatctctctaatcacattgccctccctccacccgctttccccattgaaaccaatgtttggagaagatagaagaatgaaaagaacatctcaggtcctgtttttgtaccaccttcactattgtagcacctcttttgtgttgccaactgaatatggtatacatggctttaagggggaaaaaagaaaaataaaacataagaaagtaggagagctcctagctttcttaaatgaattaaaggccttaggccagagtgaattatattatagattgtagactagatatggtggggaaggttactcaacaacttggttgggaaataaattaatatataaaaccatcagatatcagagcatagttgtggaaagtcacctaaggaaagtcattgtctctaggccaaagactggcctagacgtaagtaatgcaccagtgtgtcagaaagggggttggtcgacatcagaagcacccagaggcaaacactggttgtgccctgtacccacagtaactgtccatagaaatgtgaatgttggtagtcttcaaagtttcagtgtcactggcaagtccttctttgttggaaattcaatttaacattcaagttctatagcaaatgcctcctattatgatgtcttgtgtttacagtttgcctctgtaagtagaaccctctaaagggaaaaatgctctggtcagattgttatggtctgtatgacagatacataactgttgtaaatcaacacattggcattctcgtttgctccaccagtttgttgtgaacttcgtcaggggaaggcatcatgcctaagtctattcaactctgggatactgacaaggtcaaatttctgtgcctgcaaggctgggactggacccaagctgtacagttcatacaatgaaatagtgccatttagtaaaaaagggagataatatggcacttggttggaagtttggctctagaatctgattgaactgggtttgaatactaggtcagccacttacatgctgtatgacctaagaccccgctctaaaaaggatattatctttacactgacctcagagggctgttttgagaattaaattagacaatccatgtaaaatacttgactcagagccttacatagagctgttagcagcagcaacaacagcagcaccagcagcaaggtaaataccaccatgtgtgtcctttgggtggtcagcagtttgctgaacaatttggactggtttagaaccctcctaactcactactggggactttccattggaaccacagcactgggtagtgacagaatttgccagtgtaatcacatcatttatgagaaatgatagcaatagggtttggtgtcatagtaatggaaaatggcactggacactatcctaattttgaagaaatggagtgaagaagaagacatgttccagaatgcacaggacattgatcttcagcaaatttttagagtggattactgaatgattacgtgtgagaaaaatgtgattattaggagtcaatatgagctcattgaaaacaaaacattcctatttctaacatccttaaagtctttcacagttcatcttattggttatggaaatgtcaagggatagatttttatttctgggaggagtttggctaagatttttatgatactcttgttgtcttgttgaggttaagtagattcatagctggttgaacaaatgtccactggcagttttgacctgatggatggactaatgtccatctggagaggggtcctcagggtaagcctcaggaacctgtctagtgatgctgttctatccaattttctcattaaaaatttctgacgaaagcacaaataatgtgcttttgcaacaagtgagataggattttttaaagatctgtgtaggttgatgggcggatttgctaataacaaccatatgtagcatttattgagtacttactgtgtgccaggcaaaatgctaaatgtgttgtatgacttctctcatttaatcctcacagtgaccctctgaggtgtatactagtaatattccattctatagatagatgtagaggcacagatatgctaagtcatttacccaagtcccacagccaataagaggcacagatggcagaggaccatttgtctatcaccaaagcccatgctcataactgtattatgctactagaaccagtgagtcagaattttacacagattaatgtaaagtcctaagctaaggttaacaaaatagtatgttaagtcttgaaggaggaagcttaggttgatagcaagtaataaggaaaagatttagggacattagttggtgggaaactcaatgtgattcaatactaacgtatacctacttttaaaaaagaacaactaataggagggtgcattattagaatatagcatcatggatcatggtggcagtagttcttctctaagagtccatgtccagagtactaggtcaggtctgtcattaagggggtccttgaccattataatcaggagaataagaggtctggatttacatcctaagaggaaaaacggtgaactaatgtcaggctggaaaagagaaaaaccaaagaggaatatgaagacaaccttcaaatattaacatagttacatgatgagaaagagtagatgccattggtgtctaagagagtaaaaaaatcacttctcattccctgttgagaaatggactctggcatcaggttgatggagaacaaaatgtcagctttattccagtaaaaccatattagagaatgtggcctgatctgtggctacaatcaggccttttatacccttccctagttaaacacactctcagagtcaggtaaggccctggacaactgttgtttgcaggaggagggcagttcctgtgtgaaggagaaggagaaagtgtgcatcctgaagccaggggtgcacctgacttctcgactgtgaatgagagaggaggaaacctagttcatatctgcacaaaaattctttttggtatccttgaagtgggctgaaacaaaaaagatcaaaatgttactctagcaggaggccactcatggaaaccttaggcaggggaattgtgttacccctggtacttaccaactttaacttcagtggggcaaccaagccaatggagcactcttatctctgaaatgtttggcctctgtacagaatgatgtgaaaaagaatcttctagcatggggaggtggaggggagggatgtctagattacttctacggcccccactccctaagattcttttgaaatcagttaagacacgcataaataaaaaaactccaagtaaagcatgtcagtattttaaaggcttatttgtttgagcaatgagagatgatcagtgttctaagtgctatggttcatcatgttctggaggtggctttgttccaactgtttgttcacgagtgttttgagttaaagggaattacagtctacaaatttatgcacatggcacttcacagaatagaagaggccaacttctggcctcttatacccacatgcaacaaatacagctcgtgtccttcccccaggactcaatttgtaagcctctttattgcattgtgctgtagtaaaaaattctcagttttgtgggcaacctgtgaaaccagccttcttttatttcaactttgttgttttgcctttatactgtgaattaaatgaatccttgggggttctaattatattatggaaaaaagaacttgatattctgagaagctgaagaacaatttgttttcctcagctaggtatttaggacttttaggatttagttaccattttcaaaaaacttgaagaagattaattatctccattgcctcaaatgacaaagatagtatgttcaattctctcctgagttatcatcataataaccctatattcttaatatggccttttatattttacaaagtttctcaatagggaatgagaagaaagtgattttttaatctcttagacaccaatggcgtctactctcccttatcatataactatcttaatatttgaaggttgttttcatcttcctcttcagtttttctcttttctcttttaccacaataatcatcacaaataatcctgtttggaaggtggagaagaggaagcaagacagatattattgtacccatttcagaaataaggagaatggaactcagagagtggtggtgggaacaattaacaaatgttttctgagcaccaatctgttccaactacctgcagtagtgcatttaatccttataatagttccgggagttaggtgctattatccccattttgagatgaggaaactgtggctcaaagtgttagttgcccaaggtcatgcagtattaagtagaagaaccaaaattagacccaggctttctggttctgaaatccatactcttaagcactaggttgttaccactggagaggttatgaacgtgcccaaaggcactggctgcctagtagctgaggcagggccagaacctgtctttagactgcttagcacatcttctagatcctgtagctgcttcactggttttcattaactttggggtttttcaatacaaaaagaggaaacaaatgaaagctgagccgaattttgcttttgtaacatagaggaacttactcagtaccaaggataatctgaggctcttatgggatttttttaagtgcccagtgttgtttcatattctgtttattcttcaccaccaccaccagtaaatgcaggtggttcttgtctcatagtgattcacatgtgggtttatgccaggtacacctattttactacttttggcatttataagggcaatatgtttctgaactaatttggggaaaataagttcttatattaattgtagcagaaaaacaaatgggaaagtcagtgaggttcaatgcaaagagctcagaccaacctttggcatcagcccaagcagagttggaaatcccagcttagtctcttcctaaaagagggactttaagtgagttactgaagctctctaaaaacctatttctttattttaaactggagataacacttgactcatgcgttgcgtttgttagagagaacaaatgaaaaaggtcgttaagggtttattggcagtgaactgtatggtaggtgctgtgcttgtgtttgcttcacttaatcctcatgacagccctaggagataggtattattatcacctcctgacagttaaggaaattgaatcttaaggacatgtgataactttcctaaagtgaactctaccttaatgtgttggaaaagagtgtagcaaatcaaatatatcattcagtttctccaaagccatgaaatgtctttaagtctccctgaaagatttcccaaataaggctgtcaaagtcttcttaaagaatcccatctaagttctattatcccagtggttcctttatctttttatttcttgccataaaattaaatctagaattacaaagaagtatttcaaagtatatataatattcctctgttttatggatttacatatcacctcctccatcagcagggattaggaggggtgtaaatacttggatagggctcttttccttggacttcctcacctccatcaacaggggtcaagaggagcctggacagtaatccctgtccgacccccctctcagcctaatcactactatttgcctcaaacaatcttatttcatgaggcctttgatcaatgttgagattagtcactgtaagaagcctgacttgtaggaaaccttttacctcccagactctaattcttctattccgtttctccccaagtcctgtgtcctctggaattcagaatctgtcattggcaagatctcctgtgttctcaaccccttctcagaacagtcctttcaccttcccactctaaactgaactgtggctgtcgcctaaggatgctgcctcccctgctgctctcctaagtggtggtagtgttatcttccccagtctcctatgacaaggcctggaggtgggctaggtgtcctctttcttgttccccactgctgctttcagaccattcttcatctcctcttttctaaatccagccctcctcccccttaaaatcttatgttatcagttatctatagacctctgtgagcttaatcctacgcaatgtaaaggcatatctttctggccaatcaatatggagtttatggcacttttataaagaaagtggataatggcctcctgatcaagaacataactgctattttcattagtcggtactctatgatgcgggtgcatggtccaggggaagtgggttcaggcccatcagactgactgagagttgagttctttacccactcagagtcaagaattgtggtatggggggaagcactgtgtgaagcatcctacaggggtctgttctgaacactgaaaatgtacagtccctgtcccagagtggcattctcaagatttttttcttgatgggacttgtgtggctatgggccaaattaaatttaatataagcctgactctcatagcctttgtagaggaatgaaaccagaagaatttggagcagagagtcgggcactcatagaatatttttctaaaacagaggaagtcatggaagactcagggtctagagtataaagtgtttgttacttaactttgaaaggacaactttgtataatttagcaaagccttcttgtttaagattagtctctaataagtaagagggccttgctggatttcttcataattctcagtagttaccagaagtcagaactattccttatctgtaagtaacaggtctttagattatagacctagtggggatataactttaatgttgtacagttaaatcaacttcacactatttacaagacatgtcatacaacactgaaaacaagaaattagagtatgtggaaactatgctactaaaattaagcagcataaggaaaattaatgtaagcctataagtcacagcttgacttctgtttcagcagctgacccagaggcaatgaagccaaaaacaattttaagacctgttctgttctgacttgtaaagattatttgatgttaaccccatacccttatcccctttccaagtgagtaccaggggttaggaaaaagatataatattgcctggctcatttctaatcaaactttaatgctggcttcagcaaggccagatgcctactttttgtaaatatcattggcagttggcagtacatttcattaacagtttttatggctatcagtagtatttttgatactctgaggatgagcactagagaaatatgtgcttgctgaaaagcctgctaatctctgtgtgataacttaattttgctattacctgaatgtaagtgctattgatgtggcattagcattgatttcatagctatttaataaagagacagaaacttcaaatgcataattatgacatcaatatatgaatctttctttagagatgaaaaacacatagttaaaaactgtgaaaaactgccctgcttatatcagaaaacttatacttctctgttgaaaaaataggcaactaaaatagtttacaatataatctaaaaggatgaattggtggaattttcagtataactggaaggtatgatgtgttagatagtggggagagtgtatatatattatcaagccacaatattacaacctgacactattagatataatagattatgcagccaaaaatgtggtcatggacagtgataggggagcagaatggttcggtaaagtaccaagtctggtgacaggacaatgggaaaatttctgcagcctgatggtctgggtagttggatataagtctgacagcagagatactttcatatttagggaaaacctgcaaaatactgaaaagattaataaagagaaagggaacttctaaatagctaaaactcccggcagagcagcatagctgacagagcaccataatcttgcgtatcagagcttctcaattcctttggaacaggagaatttgataatttttttctcccatgaggatgcactatgaaggaaaccgctaggaaattggaattattttaaagtgattattttaacattaacttggtagacttcatctattccatagcatttcttttcttttatcccattcaattgcatcctctctataggattaatgcactcttgaaagtgtcaccttctagccagtggccaactaacacaaaaccaattcactaaacaaaaacacaacaaaggaccctcagagagtccacttcactccctgctacctccactggagcaggtactggtatcctcggctgcaagacctgaagacagatcacatcacaggacgctttgcagacactcgccagtaccaacccagagcccaagagctccactagatggctaggcccagaagagccaaaacaatcactagagtttggctctcaggaagccgcattcctgagagcggagcaccacctaagggagcaccccgtgtcccaaagaatctgaacagcagcccttgaatcccagatcttacctctgacatcgtctacccaaatgagaaggaactagaaaaacaattctggtaatatgacaaaatgaggttctttaacacccccaaaagatcatactggctcaccagcaattgattcaaaccaaggtgaaatctctgaattgccagaataataactataataattcagaaagtgaattattaagctaatcaaggaggcaccagagaaaggtgaagtccaacttaaagaaatcaaaaacatgatacaggatatgaaaggaaaattcttcagtgaaataaatagcataaataaaaaactctcacaacatctggaaatcaaggacacacttagagaaatgaagtcccagcaatagaatcaaacaagcagaaaaaagaccttcagagctcaaagacaaggttttcaaattaacccaatccatcaaagtcaaagaaaaaagaatttttaaaactgaacaaagcctccaagaaatttggtactatgctaagcatccaaacctaagaataattggtgttcccaagaaagaagagaaatctgaaagtttagaaagcgtatttgaggggataattgaggattaagtgggtttcagatgcagagatggtttaacatatgtcagtcaataaatgtgatataccacataaacagaaataaaattaaaaatcacatgatcacctcaagagacacagaaaaagcatttgacaaaatccagcatccctttatgattaataccctcagcaaaatcggcatagaagggacacaccttaaggtaatataagccgtctatgacacacacacagccaacattatactgaacagggataagttgaaagcatccctcatgagaactggaataagacaaagatgcccactttcaccgcttctattcaacatagtactggaagtcctagccagagcagttagacaaataaatggcatccaagtcagtaaagaggaagttaaaccattgctatttgccaatgatatgatggtatacctagaaaacccaaaaagactcatccaaaaagctcttagaactgataaatgaattcagcaaagtttcaagacacaaaattaacatacacaaatcagtagctctgctatacaccaacagcagccaagctgagaatcaaatcaagaactcaaccccggccaggcatggtggctcacacctgtaatcccagcactttgggaggccgaggcaggcagatcacgaggtcaggagatcgagaccatcctggccaacgtggtgaaaccctgtctttactaaaaatacaaaaattagctgggcatggtggcgcacacctgtagtcccagttactcaggaggctgaggcaggagaatcacttgaacctgggaggcagaggtagtgagcagagatcacgccactgcactcaatatgtgaaaatgaccatactgccaaaagccctctgcaaattaaatgcaattcccattaaaataccaccaacattcttcacagaactagaaaaaacaatcctgaaattcacatggaaccaaaaaagagcctgtgagtcaaagcaatactaagcataaagaacaaatctggaggcatcacattacccaacttcaaactataagggcatagtcaccaagacagcatggtactggtataaaaatagacacatagaccaatgaaacagaatagagaacccagaaataaagacaaatacttacagccaaccgatctttgacaaagcaaacaaaaacataaagtgggaaaaggacaccctattcaacaaatggtgctgggataattggcaagccacatgtaggagaatgaaactggatcctcatctctaaccttatacaaaaatcaactgaagatggatcaaagacttaaagacctgaaaccataaagattctagaagataacatcagaaaaacccttctagacactggcttaggcaaagacttcatgaccaagaacccaaaagcaaatgcaacaaaaacaaagacaaatagatgggactcaattaaactaaaaagcttcttcacagcaaaagaaataatcaacagagttaacaaacaacccacagagtgggagaaaatctttacaaaatctatacatgtgacaaaggactaatatccagaatctaaaaagaactcaaacaaatcatcaagaaaaaacaaacaattccatcaaaaagtgggctaaggacatgaatagacaattctgaaaagaagatatacaaatggccaataagcatatggaaaaaatgctcaacaccactaattatcagggaaatgcaaatcaaaaccacgacgtgataccacctcactcctgcaagaatggccataatcaaaacataaaaaaataatagatgttggcatggatgcggtgaaaagggaacacttttacactgttggttggaatgtaaaatagtgcaaccactagggaaaacaatgtggagattccttaaagaactaaaagtagatctaccatttgatccagccatcccactactaggaaaagaagtcattatataaaaaagatacttgcacatgtgtgtttatggcagcacagtttgcaattgcaaaaatatggaaccagctaaaatgcccatcagtcaatgagtatacaaggaaatgtggtatatgtatataccatggagtactactcagccataaaaaggaatgaaataacggcattcacagcaacctcgatgaaattggagactattattctaagtgaagtaactcaggaatgtaaaaccaaatattgaatgttctcactcatatgtgggagctaagctaggaggacacaaaggcataagaatgatgcatgggactttggggacttgcgggaaaaggttggggtggcgagagataaaagagttcacattaggtacagtgtacactgcttgggtgatgggtgcaccaaaatttcagaaatcaccaccaaggaacttactcatgtaaccaaacacctctgttccccaaaaacctattgaaataaaaaaaataaattaataaattaatgtttgtgttattcaaatacccataggagaagtaatctccttgagactggagctccattttcttcacttttctatgcctggaaatacctcacaaaatgactacagagtagttacccaagaggtatttgttgactcgttatctcttacagaattttagataccatctatacttcttttcttactgtacattttccctgggtgagctctcatttattcctgcggatgcacacataccctgaccagtcacagatctctacctccagctcaggctcttctcctgagctccagccccacgtgtccaagtgtctgctgggaatctcctagatgttgtgggctaactccaactcagaatgcccatgtctgaactgttagtatttctttccagaatggccatttcttacacttcccctaccttggctaacaggaaaatcgttatctactcagttgcctaaatcacaattttgaggcgtagaaactttccctcgtcctttcctcccatttttaatcaaacatgtttacattcttctttttccttctggtttaggatctcctccaagacggtttctgtctcattacttattagccttgcctaggccaaggcttgatttaggatatgtatgtttttaatacatgtctaatgaatgggaattttttgtagcttttagattttctgttgagaaacacacataaacacatactcacaaacacgtgtgtgcctggaagcacatacatgtagtattcacccaagtcgtccaagttcactgagtcctgtccagacctttaattctctcagtttatttgtgagattgttgtgtggcacaagcttacaggcatgtgtaattgttaagggaatatggattgagaactctgccatgataactcatagctccttctgggtagttaagccttacatcccattctgccaaacccttctcagacattcaaccattttctttctcccttgttaacaaattttttaaaatattttttaaaaggaaagaaaagaaaatcctaccttatgaaatcatcttggccttgatgagaatcttggccttgatgagcttagattctcaattgactattttccattctgtcactaagatgtatttggaaaacaacaaataacccctgagccctgctattgtttctttatggtttatgtttcatgctgtgctgcttagccagcagggagggaggcttaactgacaaacccagtttttgtagctgtgctgatatcatccacaattcaaagccacagtgaaaaattacaaatcagcctcagccatgtttttttgttgttcttcttactgagaaacacacatgcacagacaaagaagttccatgtttgctgagtgggaccaagcaatcttggtgtagaatgaagaaaaaatggtgaaactatggagggtgaaattatttaaactgtaaaaagcaaatgactttgttttccggatcttttataccacctcctttgatgcagcctgcttcctgcatgaagcctgttttgtttgttacttgttttcttatcctgagattgcgctaaaattgcatgactctgttacaattcttggataacttttcaagaaccactttggaaaaattattgtacaatagtatctctctggaatccagttttattctctcccagtcacttactttgccaatggcccattagctgtgtaagtgatgtagctcttccttttttcactcatggattacttctgcttggcatatcttctttcaccttgagcagcagtcaaaattttacttatttcttaatattcaacttaaatatcacctttgtgaaaagcctttcgggttcatattattatgatctattcatatttattcagttctctagtaagtactgtatgcataagtaggcatctgataaatatttattaagttgatattaacatatggcttaagaaattgctaattttataatacagtagttttattttttatgcaaacaacaaaagacatcttaaaaagctattcttttttttttgagaaggagagtctcactgtgttgcccaggctggagtacagtggcgcagtcttggctcactgcaacctctacctcccaggctcaagcaattctctgcctcagcctcccgagtagctgggattacaggtgtccgctgccacgcccagctaatttcatatttttagtagagacggggtttcaccatcttgaccaggctggtcttgaactcctgatctcgtgatccacccacctcggcctcccaaagtgctgggattacagatgtgagccactgcgcccggcccaaaaagctattttctttttaagcctcaacaatacatattaaaaaatacaagagaaagaatgtttgttaagaaaaaaatttagacatacaagtgtgcaatttagagaaactttttttctaaaatattataaatttagaaaaattttgcaaacagaaaacactgtagggacaatatatgataagtaaattgtacttcagcaactcattgctttttagataccactgaattatttgcactaatggaggaacattgttataccaacctatttatatttgatccacattttaagattcctgttcagcttatttactttcttacttatgtcttatctggattcttattaacgttagttctcccttacttgcttggaggagaaatcattagaaacatgctgagaactgggagatggccacttcaagtttaaatttgctatgaagaagctaccaataaccttctttcagtctaaattaaggtggcctgtagttttacaacccaaagcatgattgtgggatgctaatttagggaactattctgcagaaaccatgacacaatcagcttgctggtccgtatttagaaccatacttggaaattgtgctcaggtctgcaatttgtaattcatgggtaggggttgaatctagaggtggctgagagttcagccacaaaggtgataaaaggattgggaaagaactatgaaggaatttaaagaaactgggattagcttggaaagagaggaagataaagagcaatttaatcgcaatctttatgtacatagagaagcttagcggaacacagtgaccagtgttttctgcctcacctgaggacaacacaagaggcttaaactgcaatatgagggatttgggataggcataaggaagtatctactaacaagcaaaattggagtagactactgagaaatatggtagaatttccatctctgaggactgaaaatgtatatattctattcctttcgagtgttttaaggtaaatcttgctcaaagatgttgacctgaacttgatggcttcctggaaatccattcattgtgtgacattactgtttttagaagcttcttcatagatggcagggaggagcaagtacaccaatcaagtcacgggcagtgtgatatggagaaaagggctccaggctgagaggcaagggaacttgattgctgtctctgatgtactgcaattagttgagtgttcttatacttgtcacttaactcctctgtgcttcggttttctaatctataaaatgagggagccaacctaaatggctcaaaaaggagtttaaaagtaagaaagcataatattcagtaaacataagctaaaaccctctcccgggccagccacggagcaagacttcttcacgtattatcttctagagcatctcatctgatatagtttgattgtgtccccacccaaatctcaccttgaattgtagctcccataattcccacgtgttgtgagagggacccggtgggaggtaattgaatcatggtggtgggtctttcctgtgctgttttcatgatagtaaataagtctcacaagatctgatggttttataaaggggagttcccctacataagctctcttgcctggtgccgtgtaagacgtaactttgctcctccttgccttctgccatgattgtgcagcttccccagccatgtggaactgcaggtccattaaaccctcgggtatgtctttattagcgcatgagaacatactaatacatcctccaacccattttacaggtgagcaaactgagggccagagagactaagtgacttgccagttttacatagctagtttcagttctgggtagaacccaaatctcctgactcctaggccaggactcatttattttactgagctaggtctttgataatcatgctttgatacagtctttgagaatccattctagtttttctttacttcgtttctttttttcttccagaaatgtttattatgccctactaaatgataggcactatgttaggtacagaatggaactctgatggactcttccaggattttaaattcaaaactcaagtgtttcagttagtgaaggaggcttctggatctttccaggcatgtagatgtctttaaagatgcaatcaggcctcctcgtcacaagtgtgtggccagagatggagaaacaaaagattgacataagtatcctccaaggtttggagtcacttctggctttgcctaagaaggcagtagggcactcttgcctttcttcaaatagtctcttccctttctctccctccaggccccagatatggatgcttagcatgacttaggcgaaacttttccaactcccacaactgcacccctgttctctccttggggtccaaggccagttattcagtttgaagactgcctgggtttaaatcctactttcccacataccaactgttgaccttagattagttacttaatgcattctgtgaaatggcagtaatactgatatccacctcagagggttgttataagaattaaataaaacaattccagtagagctgtgattcttactaaaaaagtaataagtgttagcactcaataagttttagcaatttatattaatatttccaatgtagcgataatactgtcctcctcagcaatggtcccttcagcccagttttgagaccaaacccctcccaggtctttttaaattgtgcttttttcttcagggtccgtcaactggggtatatttctgtttggagacagtgtacagacacttacatattcagattctatagtctgaccatcctaagttcaaatccctgctctaatgtataattggaggaaaccttcctgtaagtatgatgggcatgcctacataacggctttgaaatacatgtgctggccattcatgaatttaattttgttcctttagaaccatttaacagagcatattattatgccattaattattattagtagtaataataatgatagtcattatgtattaagggcctactctgtgttagcactgtgctaaatgttttgcatacattatatctaacttttacaataaccctctaaagtaagttgtttcatcccccttttatacctgaaaaaattgagactaaggaaggtaaataaattgtccaagattacaagctagtaagagacagagccagaatttagtctgaaaatcaggtttctgtagctccaaagcccaaagcccatgatcactataactccttccttaccatctgagatggtaaggacaaggcatcttacctctaggttgggagctaaagatcataatggtttcggccttactagtatgattagcttagtgaaaatatgattcacttagtgaaaatatttatcagcttaatgaaattttattagcttaatgaaactttcattagcttaatgaaaagattttctcttgctggcaaaataattcatgtactgcttaatcaatgttgaatcattattcttactagatttatacaacctatttcattgtctcgcctttaacacagtgtgaaaatttgctgaaaaactgagagatgtcatttttagaaaccaacatctttgatttttttttaaaagaacttagttctattcatcattttgggtccatacctaaaacagctcttgatgtgtaagacatgctttataaatttgtgttgaatgacatgaatgaatgagaattcagtctggttaaaaacagctttattttaaagcacttgatacagtgaaatgagctgtggacacacgtcaaataatctattctctagatttagcctggcattgacccgctgtgtgacttacgtcaagccactatttcttgactggccctcacatgcaatttatcctttgcaaaatgatgggatttaatctaaatgattgctaaggttccttccaggtctcagcttttgcagcttcctatagactgtgaacatgggaatacagtctgattttctcagtgactcatctgggaccctagaaactggcagattgggaaagaaaactaatattctctaaaactgaatttcttaacttacagattataaaactctactttttaccatgtctaaaaattcagtattcgtggaacagctgatattatcttttgctgatgggcaaaattaacaggcacctttgagacctagcttcatatctatgaaaattcattaagttgaaagttcatttgtaaacaagcttctctagacagctgagaagtgattgttctatcttgcattgtatatattttaatcttttgtattgacctgtagtcatctcactggtcaagctaacatgtttttgatagccaagagttggaaaacctggtcactattggcctaattgtactcttggaccacccatggaactcttggcaattagattttcttataaaactctttcctagagggccctttgtggataagatgagcctcacattgcattttagaatagtacgtgctaagaagcagtgcaagtaaaagtgtgacattatagaagatgcctctggcttactcatcttcattatgacaggaatttgccattgtcaatgtcttatatgttgtagaatgagaaagaaatgactctttggagtagatatctgcaataaaatctggattgatctacttacagtcagtttcagagtaggcagtctccagggcactgggagtaactagactctggtctccaggcctaggttcagctacattccctacaaggcctttggcgtgtacctgttcagttggtcagtcaccctgtttccaaacaaaggacatggccctgaaaactatacacaacagggcaagatcctggctctagtttgggattcgtcatgtctttttagttaggcaagccttcaatttaggggacaggatcagagctgtgtcatagatctcttatatctttgtgccctatcttgccctcaagactgcctcatctctttgattagttcctgatgctgtcatgggctaggccaccttcctcatttcctactaaaattttcactttaactaggttgaagcaactcatatcatttctagcatgtcactgaattctatccctgctcttcagaatcagttacactttttcaactaggtatccagcactgagaaggcacagaggagaccaggcctgtagccagttgagaggttacaaaaagcatcaaattgtaggacagtcttatacaggtgactttctcattcagtgtaatgtggattatataagttgaggctttttgattgcaagcaatataaattactttggctaactgaaaggaaaaaagagtaatttttgaaggtatagagagtgtgtcatagaattgaaggaaaagtagaacagattttcagagtaggacatctgtgggagtagaggaaacagaaactaatggtcacgtcaaggcaccaccactggaatgagttcactccagacattttctgttaaacatctttattgtttgactagtcattcagattcccagcagagaatctgactggctttgattataagcctacctcttagccagggaaggccctgtaccttagatgacagtcctaccagcactgcccataataaaggtcaggggtggttacccaaagccaagcacttttggtgttcctaccaaaaaaaggacattcaaaggcaacagatgtctactacaaaatctgttctatgggatctacagtgagggaatagattcagccttacagctaaagaaacggattgctatgcagagatttctgcttcttaggagttgccaaaaagacccttatccggcttaggagttcttggctgtgattttagtgttcttttgtttcccaagtatttttaaaatgtaaatcagtaactagcaagaggcatctttggtcattgtagttgcttggagtagaataaatttaaaaaattctttgatgtgagaaaaattactatcatcattatcacacatggaaggtcaacattagggccagtcattggagttaaactgtcagaagaacatcccagttactttctcacttttgagttgtgtagactgacaggatttgagtctttgagggctttgactagggtaactgacctcaaaacaaatagctagagggatatttctacttctatccgctgagggatttgtagcaagaagccatattgtggatggtatattttaataacaaaggggattttaaaaggaggatgacacattgatttggaatgttttctcaactgtatttacttattcttaaatattttccttcatgctttctttctcaagtggatgaccagctggttgccacctttttcttctctctttgcctctgttcctaatttctttcttatccttaaccactccactttccttcctccaatcttgttttctctctaaatctttcctccaaccttattgaatctctccccttctttttgttatctggtcatttgatctataatttcgattccttttcctgaaattccctcctttttccttttcccctaaaccatcattctagtcctccccacacccaagcttcttatctctttgctgttaatctccaatgtgtttattgacttgtgtgccaaaaggcaaaatccccagccccctcccaaccatgccagtgcattgaaaagcagcagctgtcattgctcaacaagttccttgtgatctacaaatcaatggataagaattctcacagtgaaggtttacatgtatatatttgtatgtatatatgagacatgtgaccatgtttaatgaatggagaaggacttggatcttttctagtagagaagagaagcagaaagctttgcctaaccctatttctttactaaggtaatgaaaaaattatacagggaaaataaatgatgttaatgagagaaacagggacaggagaccaataaacaatcatcaggcatgagaatatcttgctgaacttattattgatagtagacacaggaatgtaatataaatgcagtgatggaacagaaagcagactcaggaaagaaagagatgataataaatagtaataaaatccaagtgattcatatgctcaagtgaaagaaagaagaaagagggcagtgtacacaaagtaaaagggcaagaaaatggaagtagagtcatcactcgtagagataaatagttgggaaatatgagaagccttcctgacatcagtaaaatattacatgttaaacagcaaacaaaagacaacaacagtgtctgtagtacttttggaatataaaagttagataatactagagtagtatcttcaaaataagcaacttcagaaatcaagtccccagtaaagggaattggaagaatttgaatagatgaaataaggagcagtggcaagtgatacaaaccttaagcaggaaaagtgattttaaatggtactggcaggttaacaactggcaaaaagaaaaaaaaagaaaagaaaagcaagatggtgctatatcccccaggtgctgggaaaccaacctggcctaaaaaaggagcagacccacctaactttttgccaagcactgtgctaggtgcattgcatacacttttaatttaagcctcgctgtacataaaagtgaagccaaggtctgagaatgatatccattgggaggaaaaaacaggaaaattttctgagccagttccaaagtcataaggctcagggggaataactttgactttgtcaagtcagagtgaacagccagagtcagcagacataggatattgtcagaggtaaatcaccagcttggtctggtctgtcttattgcaaggtcagaggaccatagcaagccagccaaatgttttcaaccatggaaatcccctaactttccaactgctgcagtcccacagctctgagcttttactcacaggatggctcccttccagctttcaaatctctccaagttgattaatcattttcttgttctgactcattcaggcctctagaaaaatagctgtaggtactggaagggctatgtagatcaaggaggtcagataaattggcttgatgttggtctatagaaaaatctagaagatattgccaaaagcttttaagcataccgtcttcagatgctgggatgtgggctatatccacaggccattggctcattcatgtgtttgaagcagaatatttttgtgtgcattaggagacttgggtatgttcatttcttaatgtaatgttagatattgtaagctggttgtttagacagtagaatttcattgtgaccacttatttttatatctatttagatggagtacaggccagattataaccccctaacaagaacagcaacagtaaacacacagatagtgcttattattagttaagcatggtactaatattttccctaagaggccacattcacaggactgaaatgtcagttctggttgtctgagccaagggcatatatgctgattacattattttgtctggctaatacactttatcatgaagcttattttagaagaaatgttcatttttagatttctgtttgtatatttaggtcatactataaggtccattctcttgcttttataataatttagtcttctgctttattcattcaattcatgaacattcattaagtacctgagtatgctagtcattggagatgcagttgtaactaaggcatcaccccagacctgaagttttatgttgtgttttgtgcttagtgattggcataagtaaaatacttgaggaaacacagaagcagcagcaaatatttctgcaaaggagaagagaaaatatttgagttgaagcttcaagaatatatcaacattttccagtttgacaagggtgggaggagccccatcaatacagggaacagcatgtggaaatgcaaagaggtgtgaaagagcatagtatattcagggtgaaaaaatacattttttatgaattgtagtagaaaatgagccgaaataggttaagttgaggtaagattgtgatgggtcttacagcatactaaggcattatcctgtaagtaatagaagggcttatggaggttttaaagaaagagagtaacttcatttgatttcttttttcaggaagagaattctgatgatagtgtagggtggaaaaaaggggtaacaaaggaaccagtgggaaagctgctgtatagtctggaagtggtagcagtaagaggagaggtgaagggacagatttgagatgcatatcagaagtcaaatgagcagactactgtgactggttggatacaggggtgggtgtttgagtgggacctccagttaggaactcagatgtctggatgggtcatgctgccttcaacaagaaattcagaggaaaagcagccttggggaatgatgaggtcattttgtaacatgttgagtttaaattaaggcactaatgagaagagacattcaggtggagaagtccaatggacgacaatagtatgggtcaagaaagaaagctgagaagtatctgaattacaattatgcatcacttaatgataggaatgtgttctgagaaatgagttattaggtgatttcaacattatgcaaacatcatcgagtgcacttacaaaaacctagatggtatagcctgctatacaccttggctggatggtacagcctgttattcctgggcagcaaacctgtagagcatgttattgtactgaatactataggcaattggaacacaatggcaagtgtttgtgtatctaaacatagaaattaaacagtaaatatatggtataagagatcaaaaatggtatatctatgagggtacttaccatgaatggagcttgcaggactgaaagctgttctgggtgagtcagtgagtgcacggtaagtaaatgtaaaggcttaggatattactgtacactactgtagattttataaacactacacttaggctacactaaatttattttacaaattttcaacaataaattaagtgtaattactgtaactgtttgactttataaacttttaattatttttaactttttgactcttttgtagtaaaacttaaatcaagcacaagagaaaatgatatacaatcaagaggtaaacaggagatatatgaggctgctgctgctgttacatataatattgttttacagtaaaatatttttaatatgtagaaagagtacactgtaaaataatgataaaagtatagcagagtaaaaacaaaccactaacatagtcatttattatcattatcaagtattatgtgccgtacattattgtatgtgctgtgcttttatatgactaacaatacagtaggtttgtttacaccagcatcaccacaaccacgtgagtaatatcttgcactatatcattaggacagctacagtgtcactacatgataggaatttttcagctccattatattgttgaccacgtagcacataactgtacttgaagccaagacagccaattagatcaagcagaagaggagggggccaaggacagtagtgtattctgttttgctttttttcctcttaagagctgagatcttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagagctgagatcttacctgcgtgcatgtgttcattgtagcactattcacaatagcaaagataaggaatcaacctaaatgctcatcagtggtagactgggtaaagaaaatgtggtatatatacactgtagaatactacacaaccataaaaaaagaatgagatcatgtcctttgcagcaacatggatggagctggaagccattatcctaagtgaactaacacatgaacagaaaaccaagccatgtgttcttacttataagtgagagctaaacattgagctaaacatatagacacaaagaagggaataacagacaccagggcctacttgagggtggagggaggcaggagggtgatgatagaaaaacttcctatcagatactatgcttattacctgggtggcaaaataatctgtgcactaaactcccatgacaggccatttacctatataacaaactggtatatgtgcccctgaacctaaaataaaagtttaaaaattaattaattaaacaaataagagaagaggtcttgccatgttgcccaggctggagtgtagtggccatttgcaggtgcatttccgctactgatcagcataggagtttgatgtgctctgtttccaaactgggcaagttcaaccctccttaggcaacctggttgtcccctgctactgtaacgtcaccatattgatgtcaaatttagtgaggatacctgatcagcattgtgtcctatagcccagaactcctgggctcaagcaatcctcctgcctcagcctctctgggagctgggactataggtgccaccaccatgcctggtgagattgtgtatcaaggaatttattcatgctatatagagagttttaggagttcaccaacagggttttacaaccatgtttgttgtttttatggcagaacacactttggattctgttcttcttctacatatgactaacagactttttaatgaggtctgatgcctcaatcaaaggctagtaaaacactgaccccttctaggccattatctttgtgtctatttggggaggagttggggagttgttctctgaaacgcaaacatgtactcctgctcagctttccctggctgacctggattccaaatgactgttggctcctctatatagatttgcagacatccacacaaaggagtgtcatttgtatgcagccccttaactaattgtaacagtctgttccttaagtctctgagaaagcacacaaattgattccccagcacttgcctatttttgaggacacctgtatgacccttcatcaaaccagctgacacattctgcctgcctttattcacctgctatttcaattatgtgagcagtgatgtatctgtctcaaaaatctctgtcctgggaaatttcttcagaagagaattattggaaaaaaatttttttgctgtggagccaactcagggctttaaatcttttccagcctacagagcacctggattcaagtgtctattccctcctgactctggaagaatgagttacatcttgaattgaggatcataagcacattgagaaactatgagtttatttcttcctgctgttaactgaagcaatgaaaaataaacaaatctagatagcccagagccagttttaagtatcacaagatggggcctagcaatgtactagaacttaggagccttagtttcaaaatatttttaaaaactttattgaaacatagttcacataccatcaaatttacctatttaaaatgtccaattgagtaatttttgtgtattccctgagttgtgtaactattgtcattatcaagtttgagaacatttttactcccaaaagaaatcttgtacccattagcagtcactctgcatttcttctccttactccccatcccagccctaggcaaacactgctttctgtctctatggatttgagatttttttctgctttttagctattataaataatgctgctgtgaacatttacatgcagtgttttacatggacatgtgttttcatttctcttttttttttttttttttttttgagacggagtcttgctctgtcaccaggctggagtgcagtggtgcaatctcagctcactgcaacctctgcctcccggttcaagtgattcccctgcctcagcctcccaagtagctgggattacaggcatgcaccaccacgcccagctgatcttttgtattttagtagagatggtgtttcaccgtgttggccaagatggtctcgatctcctgactttgtgagccacccacctcggcctcccaaagtgcctcagcctccgaagcatttatcatatgaatatatctccgagtagaattgctgggttatatgttaactctgttttcttttaacattttgaggagctgccaaatcattttccaaagtgaccacaccattttacattcccaccatcaatatattgagggttctagtttctccacatccttgccaacactttttattgtcagtcttatagccatcctagtagttgtgaagtggtatttcatggtgattttgatcagaaacatttttcacaaaatagaattccttagtttagtttagttttgttttgttgtttttttgttttttaagatgaggtcttgctctgtcgccccagctggagtacagtggcacaatcatagctcactgcagccttgaacttctgggctcaagcagttctctcacctcagcctcccaagtagctagtactacaggtatgtaccactgtgcccagctaaattttaaaaaattttttgtagagacaaagatctcactgtgttgcccaggctgatctcaaattcctgccctcaagcaatcccccttccttggcctcccaaaatgctaggattacaggcatgagccactgtgcccaaccatatttattgctttttacaagaaaaagttattgataggttatgctaacccttactcatcactgtaacactcagcttggtctcaactcttaaaaccagaccatataatgtaatacaatgtatccctgcgttgtggtctgtggaacacctgcaattaattctatcagtttggggttgatgtgatactggttaacaattcagattcctgcattccaccagggatcagaatatctgaggttggagtgtgaccttgggcaagatgtgttgctcttcttagcctgtttctggatctatatcagagaactggtcatgatgatatctctgtccttttcagctgtgatgttctgtagcattctgtgaaccactatcaggagacactagttctacagaaatcttgggaccttaacaacaacaacaaaatgacaaatatttatcaaatagtcacagcatataatgcgctatactggttaccaagttcacatagataactaagctgtggcccttgtccttgtagaaatacagcctcctggggcccagataagacaactgttatctgaggaaaacgcctccactccctcctcacttccctcctgggcacctggggggatgtggttagacacctgtccttcctatggcatttctcctgcttattcgccccttctctgactccctttctcaaggtgtcaccaataccagcacagccactcttgatggtattgagtttaccaaacactgagaaatcctaagtgtgtcaagtcagcccaagaacacttacaaccctgctttctgcctgacatggaggtcacaactgctttctcatcacacgctgatcctccagagacggaagcagtcatcctgctccagcctcagcctctacttcccaaaaagctgtccttctccacagtcttttttttttttcttttttaaactgggcaccaggactccattctagtgcctgactttgatatgttttcttcaactcactgctctcttcttttgttcactgttctctgtcttcttccactcacctatctcatcagcccagccctgtggtactgccccagttctgagaccctggagttccctttataatctccaccagccaaaagaaccatatgaggcctctttacctagcagactcttgatataactatcagatattccaacaatctcatttcagatactttccattgtccctttaagtatacattgctgacaagagccctggtttttagttgagaaaatcaggccagtataactgtaatttaatatctaaattaaaaagtgaaaggtcttaggttggatgtgaaaaagctacattagtcacattgttttgggccacaactgttccttatttttacacagtctgtccatccagaaggccactgtctgtccatgagaacatccacgaaggcatcagagctgagagaccttctcactaaatgtgacactgacactgtccaggagccgcagcctcactctatcagcagctgaggtttttatagggtgcccctattaccctgggtgttgtatctaccattataaagactgccttggatctctagttttttttcatctcagaacagacctcattgtgtctatttggagccccagcccatgcctgttgtgtgtgtaataagtgcgatgacttagaacagcgcctttcactccaggagctggaaacctttaacaacctcaactccacttccttatacagccacttagggaaggacagacaataaacaggaacttctggggattgtctgttcaggaaaagcggagagaaaaagaagacatattttttacttacctaagatttcattagaggtgccttactaatcaattgccaggcagttaaaagtgataaaggatgattctttatctaacgaaagaaaagccaactgaagtttcagctggctcaggaacttgcttttcatggtgaattgctagtagagtaagataaagcgtccagagtacaaaatgcctcttgttttcatgtggcctgacatttgttcatatccctgcccttgtttacttctcaaagaaacaggttctattcccgtagtcgtcccaactcactcataggtaatgccagactcaaggacattagcccaaggaaatttgccttgatgtttttcttcctgaagaaatattggactgttttctatttcttcaagttatgctatcaaagaaagaaaaattatcttacgcttttgttgggtaagtagggaagaagctgagaaggaaaaggaaaggaactagcatatgctttgcctcatgtactaggctaggcactttacctacattatcttattaagctaaaataaaaccaaattcatgtgacaagtctgcaaagcaaagcaattctagtgagcttaccatctgtgcttgtttatcgtttgttagccagtagctgtttggatgttatcatagctttcaccccagatatctacctgggcctagtctatgactttttcttgtctttccctttaaaatgtggctctgggaggcggagaaacccaacgtgtgtattctttcctattggaagctgctatacgtggttggaacctagaatctaaaaacttcttctctttccttttttctcttctttcttcctttgttatgagaaaaacctgttctctttttaaattgtcaatcaggcgggcgtggtggctcacgcctgtaatcccagcacttcgggaggcctaagcaggtggatcacgaggtcaggagattgagaccatcctggctaacatggtggaacaccatctctactaaaaatacaaaaaattagctgggtatggtggcgggcgcctgtggtcccagctactcgggaggctgaggcaggagagtggcatgaacccaggaggccgagcttgcagtgagctgagatcgcgccactgcactccagctgggcgacagagtgagactccgtctcaaaatataaaaaaataaaaaaaaattgtcaatcatggtgtcatgataaaatatttcgcttcatcattttggctaagtctaattaacataggttccatttaaatttaaaattttttagttctcaggttttattttttttttaaatagttaaaaagtagtttctgcccatctccctgccctctccctgcaagcagtccagctcatgtatgttttgtctaccattcccaagaccatcaaatgattcccctgcccagtcatgtctcccttcatgaattctggtgccacactgagtttctgtcctactcctatctcttttgagctgtgcaaccttgggcctacactcagtttccccatctgaggatacttattgggttgttatgaggattaaatgattctggcagtgtctgccgggtctccagacttcccctgcttatgttgaccctgtatacagctgccagatcagtttgtctcagcctggctatacctcagctctgaagcttctctggtttctgccacctgtgccttgctatctgagccccttccaggctactccacactaccctttccagatctgtctctcactaatcttcggcataaacccttgtcctccagccagcctggactagtaggatttctgtaaagatgcatttgttttcttcactttagacttggctcagtccatcctgtttgcccagaatgaattcttttctcatcacacttcaaggtacgctccgtagctgtcctacccagggagtggttggaggtgactgccaacctctgaacccctagatagtctatacgtggaccgcacttatcacagattgcctggaaatagaagctactaacacatcttgtttccctgtgcaggttgtagaccccctgaaggtagaaagtctagtttttcttacatatcagtgcataataaaaatttgttgaaaaaataaagctccttttttcaccttttcatctcctcattttgaattcagtagtttcctctaacgttcaaacagaggaaggtagggtacatagcaatcaggactttgccttacttcatcatcatatacttttcaagtacctgctaagtgtttaaaactgtgctaattgctggggttaagaataatattatagccacaatttactgagcccttcctaggtgctaaacgccatgctaaataagtacttttcacacattatctcttttaatatttgtgacaaccacatgaggaagatattattattatcagtatattattatgtaagctctaggtcagagaagttagtagcttactcaagatcacccacctagttagtggtagagcctcttaattatgggatatgatctactcctggacatgatcttgggcatggaggccctagaaagcttaagctcaccctaaaggagctgatgctagaggctgtctgctgatcatactccccataggaggacagcaagtgcttccttgaaggaggctcttggcaccacattttaatgtatactatactactaataataccataagtagtgtgtgcatcatatattatttattactgttattaagatgtgctctccggaattaatttacatctaaaacctgggactatttaaaacagaaattttaaaggaaatcgatacccgttgccttcagattgctcattgctttgattcacatatgataattaatgatatttctctttttttctagctagggaaatattttcaagattattaaattttttaaacttgcgaaggttaaaaaataaagcattattcatatttttccctattgtaaacttttttatattatgcacacttttaggcagaaacaactttctgcatgttaatatttctaatagtttatctttttggttaagtcatccagcttctaagaattattgagtaacatcgctattaaattgtcatggttgatgttattttatattttccgagacctagaccttgctgatttttttgatccaggcttttccttccttagggaatttagtttccctttgttcacttatttatagctctgctgtgggtatggtttggagccttggtttttattgctttaattgcttggtagtaattgacacactgtacacattccaggccccatgttccctttacatatgaattcacactacttgatgactcaaataggctataatgaatcccctttatcctgggatatctttgagattctgggttaccgtgttgatctgtttcctttaaacatggttctggcagtgttgccctactggaaacaactgacctttcatttctgctggtatttcatcattatgggtgcatcccaatctaattatatgttgatttgtaatgaacagaggcttcctctcatttaattttctgttgactttatattccctctgtttggaaacctccaagattatggtatcagtttcaattttgttaaactgatgtcttttcgtgatgacctgcttccagtgtattacttttttattcagtgattctatcaaccagtgttatctgttaaaaaaacaaacaaaaacaaccactgatatgctggtgggctctatgctgtcatctaaaatgttatagaaagatctgtttgtattgttattgttgctgtgaattagtccaatggcctacctactatataagatatatttgaccttaggagtgaaaaaaaaaatcttaacgggaatcctcactgaagtctgatttgggtacaataagaattcatcaaaaacatagaagctgcatttcctaggaaatcgaggctttttcctgtatttgggagtggtaaagaatacgcccaagaacttggaacagataaagcattggcagacaaacaaaagatctgtagggcaggacttcctttttattctcctgagctctctttcccattgtttcagagaagatggagcaaacacccagacagaagctgcttcagtattgtcttctattgataggctgcttgtgttcagtgattcctctggcccatagtgtctgctggacagttggaggctttttgaagccattgtattgttagagaataattagagtgaatgaaacagtgggtaggggttaacaacaattctttgttgcaagcaattggtagtcttggcatcagtattggtaacaaggccaatctactggaaggaatcgaaacaaaagatggaaaagttgtggttggtttgtctgatccatccagcaaatccacccatgcatggccattgtgtcctgtgagctctctggaaatgcctttggtcacactgcattccaagccacggggtgggtaatctctgggtagtcttgtacatggatttcctagactttcccataacaaaaatggcaaggcacaggtgttgtcttggcaattaatcatacactttataaagaaaacaatgtcctaacatttgggtagatgaatggcatggtagaaaagccccatgatgtttcttttggaaggagggttaaagaatgccgtaacactaactagctcagatgtgtctattgataccaaggtgaaaacatctaggcaaaaccataatctatgtcctcattgtctcctccatctcctccagacctaccctgtcctcgtcctaggagtttatattgtgatctagaggaggcccagccagggtggggtctaacaaattggggtgggtataaatttagtacttcaaagatagtggctcttattggaaaactttataagctgaatgcctatttccccctcactaatttggggaactgcagctgctgctaaattctgagtcaaatagacttgcaactatggttgatcagatttgtgatgtattagtaacacatggaagtggtgccttatgtcggggccctgggttcctactggaaacccatcacttagatttgtatgatattggtatgatctgctagtgtgtgatgctttgttacatcctcttttcaagtcagctttccaccagagcttcccaagaacagagaggcctgcctcaaatatttggttcaaattatgcaacataagttaccttatatctcttttcctgttgcttatctaaaaggacagagactcagaggcagtttaaaagtggaggtgggcatatctccaaggcgatttatgactttagacgcatatccctaaaaggcgaattcctgctctcacaagttgaatagggctctaatcccacaatctgatttaggccaagaatgacttacatttgaaatcccaaaccaagactgttcaagattggtattaaagtcggagcaatgaggtggaggtagggttcacctccacattattctgagaatgggcctgaccctcatggatctgtgggtgtgaggagtggtggttgtcaggagccggggaaggtagtgcggggagtgaaggaggggagacagcagtgtgcttattttcagtttgtcagctgctctggaaaatggccaaaatgaatgagatacaacaagccttcagggctgctgtaagccaaggagagacaaggcccctccttttaaaaagctctgtggaatttagacttaaagttttatatgttattttgtttagggtaaatgtgaaatccctaaacactccccaggaaatgttagctcccaggaacacacagtgggccctaactccctggacagaagtacgtcttgagggagaaaaaagaattcagcaccattccatgaagcctcctggctctgtttggccatgggagaaagattgatgagaaccatgattagatctgtctctgtggcctccagcagattattggaaagccttgaaaaaaaaaaatctttttgacaaaaaaggatagaagttccagtagacaggggaaagaaaagggctaaatcttccaggccaaaatatgccagggtttgtacaaaccagggagatggagcaaagctgagcacttttatgagaagaggcactggcatcaatctaaaggagagagaatctgggacatttaagaaaagggggcttccatgtgggaagaagggcttgtgaacccagtgtggttgtgaattctgtaacggaagtcaccagctgggctttttctaggcaggagttatcttctttactggcaatcatgttccaagtttaatctctcctcagtgtgactttggtctcacgttcacatcatgaaaactccaggctgttttttgctatactcctgagtaatgttgacatttctaaggagagaggaaatctggataaatagagttcttttcttggcattgttaaaaatattactaaaaagagcaaagggtgttttcagagctaagtggaagtaaagtctttctttgcaattttgaaaggccaggtaggtggctgggtacgcactttcttgtagcctgtttgttttagcccgcagtggtttctgagcagctctaagttctgataaaggacacaaacacacccatgctacagtggccatctcacttaatgctgtcttttctatcctgtgactgaagagcaggggctcttgttcatgcccagtaagaagtaaaccctgaactaaacatcacacactgagaatctcttcataatctaggcacagataatctttaacactaaactactgtgaaattctaccagcattaagtactgtatattgccctgtgcttggataggctggctaactcgtaggaagagagcactgtatggtatccttttgctttattcaccagcattttgggggaacatttcttttacattttaaataaaacttcagcttgaaaaaaaaaatgtatgtaacttgtaggacatttctgaaaattacattatagctagtctatcacggattttgaattgtctttaaattttgctatcaaaagcagaacaacaacttgtcatcatagaactggaaggcatggttattttgtttacctcttactttttgcccatttggaaactgaaattgcttaaagttacatagctagttagtgcaggaacggaaatgaaaaactatttcctgatgcctggtttatcacaatggaaggctctgcccacaagaaggaaagttcagttcagattccctgtaattttaagaactttcatgaatatactaattttagtagaaacaactaaccaagatggcttatcattctcaacggaacataattttaaggagaaacacttggaataatctaattttaaactgtaatgctaattctttattagtctatttgggggattttttatatgttgcatgacatacttgcacattttcctatttaatacttcttttaatcctgaaagcacttatttaagaatgatcactagcactccaggacaagttaaatacagaaagccatatacatataaatggcagacataactgcaaaaagagaacaatatagtgagggaaatggtcttcagggtgctgcaaagcgctttatagttacaaaatgccttcatgtacatttctaattgatcctcaggacagtgttgtaaaaggaggaagaatgtgtgtgtaagtgtacagctgttttccagaacaccaaatcgaagctcagagatattgcacaactcaccagcacagcgaggaagctactgaattgggactcacactcagaccttcaccccaagcccatagctcattttattacttcataatgcgttagttgcagaagtaataatactttaaaaagcaatccacattttttctgtttactctttcctctcttcttcaggacagaaactgtactttccttgtccagttccagtttgtattattgtattcatggtatttaccttacctggagggaataggccttttaaatatcattaaaattgggtttttgaggttatgttcttttctccttcacatcctaaacttcagacctcatgctctttggccttccattcaattcaaatgagaagggctgttgtaattgttggcaatgcctccccaggctgccactgtatgtgaaggatcttcatgtttggaaagaaaaaaaaaatgcagtttagtgaagttcatgattctacttttactcttctaacatagccttttttttttaatttatttgtttgtttttacatgtaacactaggtggcagaataactacaccacaaagcaccacatcctttgtttctcactactctggggagtgggtatctgaatagtgaggcataaaaccatctgtggctacatgagattggaccaaccaacaaggccaatattttcttgacagggaactggctgcagtgattctaaaacgtatgcttccaagatactgtctttaagatttccatctttcttttttccccagctcccctggattttaatttctctgccccattgcactctgctagcagagggcggacacagcctgcaggcagctgctttgaaatggcagattgggatggatgtgcccattggtgctggcaccctcgcctttgtgtggcagtgggtcatgaagggtctgggggtaaggcacctgagtccttgcccgaatggcaccaggccctctggcagaggggcagcagtggctgggctgagtcagttggaagatgctgccctcactaactcaggtttacagaacaggtgtttttaaagagcagtctgatcctggttcagctctgtcaccggtttggaaatactgccgtgcagtcggtgggtcattgcctctcagtttcttcctagcaatttgctggtgtctgctaccctggatgcctcacatgccacaggacacactaagctaaataaagcagagcaagttctgtctttcatgttgtgaagagtatgaacttgggctgcggaaatacttctttggatttttgctgaaaaagaaaagaatagcattaaaacaaaacaatacttaccaactagtaataatactctaagtataccctacattaagaaactcctgtaaaaccaagtctgaatgtataaaatcgatcaaacaaaaaggttgtattttaattacaaaagcgttctttgtaactggaaccacaatcggatttcattaaatagtgagcttctgatgtgaattgtaaatgttttaatctacaaaaaaaagtacttaaatcttgacttttcaggaacccacttgttatataaaacaaaaaccaactggactatagttttacacacatacttacatcacaccctcaccactttccgactgggaatcctagagtattttttagtgtttagctggaggtccaggtagtgtcctaattttgcacacacagccctggtgacatgaaagggcattgttgaaatgaccaagtgagtcatggtaatcagggcaatcctgtaggttagagatatgggggtcttgtttatttgtttgcctgctagagctgcaattctttcataaactacatgacttttgaaaatacctcaaacaacatatataaatcagaccaaggatattaatctcaggccaccgccatagtgaggctttgaagccaggggaaggtggtgagaccttcttgtttgttaaggaagaaatgtcataaaaattccaaagcaggactcaaatttccaggggagagggcctctttattgtttcctctaatagctgctttggcgctttagtgaataaatgtgttgcacaaagtaaccctagatgcatctgaactttagtctggcttggctcccacttttgtatttagcatccattctgaattatttatttaagatatttttgctgttgtttgtcactccttcttcctgtctccctaccagtccccctcattcgtcctgtctttatttttacacttctctaattaattgatatcttctgctcttagcactgcagcaaatgtgcctgcatttttatgtggatcttcactatgcaggctatgcttttaagtttctggaatagaatgatggtaaaaatgagtcatggcttgtttctatatttgtttctgagtcaagaagcttaattttcttactataatgcctgagatatcaagctatacagtttacttttaagggaaacaatcacaatttcatcaattcctttaagtagatgttttcaaatattatagaattctttggatttgtgtttccaaaatgaacaacacaatggtagtgctattattgttttaaggagaaaaagaagcatatccaaaataggtaaaatcttcccctaaatcccctgggaacaggcctatgggtgttgccctggcctgctcacagccccaggacaaccggcattaattcactgagggcctcatacctacatctcaatgactgcttaaaccagatacctgagggtctggggtctaacagaagaaaaaaggagagtagagctgagggttatggaacattcccaggaagggagagaatatcagaaaatgcaagactgccccagtgcagcagcagtgatgcagccagaggttaccagaagttctggcacctccaccttcatggacacaagctgtatatatcagtttaccatggttttcagtgtaaaaaagcaacttatgtccttcagtgtcagtttattgagctcttcagtgcagcctcataacttatattaattgggaggaaaatgcttccagagaaaggagagatgctggacaaaacaactttgtctttgactagttgtcaaggccctgctgtttggagtcattgacaagtccttgattcttgtatgacagatccaggggaaaaaaagaagtgattcatcttcttctgttgcacctttcaaggaggaattaaaaaaaaaaaagattttgcttatggacttaacatcactggcagcagtaagtgggctctgactctttgcaaggtataatttaccattgtgctcctccctcctgagtttatgcacctcgatgagccccggcccattaaaattccttcttaaaagcaggaggtgaaaagagccaagcgtgtgttttttttagaggagagtgtagctatacaaggaaagaggtcccagtcctttttctattttaaatgctggtaaacaacttgaaacctgttaaagcttttgaaggaatgtggaggagttgtccttttgactctaatgttggggaaaacaaaataaaggaaataattttaagaaaagagactttcccatgatgagctttagtctgaagcatcctgcaggtgtcacatctgttcctctaggtgtgcagattaatttcagttgcctccatgtctgctgggtccattatctttgctcggctgggtccaacatctttgctcatttctctactgaactttttccaactttcagtgctgtgcttttccatctcagcccttgtcaaagtatgaaataccatttgtttgatggtgagacagaatagtgttgtttaaagatgacatgctaatacagttatgtaaaaattctccattttgtaatgttacaggaaaaaaacaccagtgtccgttatgactgaacaaagttatcactcagccatgttatctcagtcatgcacatcaagattgacctgtctgccatttggggaagccttcataatttgtaaggtgcaggaaggaactagttttaattgagatttaagaggaatgtctttcacagccaatagcctttctttttgagtcccttatttctaaagggtcttttgcaacttgtacaaaagagcaagatccttcattcctcttttaatcctacagcctgcaggagttgagtatacctataaccaggcagctaaattttgaaacaaggtggtgaagtttaaaattacattttagctgtggaaatttgagctttagagaatgattacgttctgattgtcttggaaatattctctgtatagagactcaaatgtgggtcttccctattatttatcccaacctcttcagaaattatatgaatggaagagggagaaataagagccatctaaaattatgtaaatctagctgggatgtgtatttttgaattgacatttaaatatggtcctagcttatattctggagattcaatacactcctccaagccttactttattccctacttcttcaccacccttccgtccatcactcatacacacatgtatgtgcacacacatgtcttttgccaaacaatggagaaacatacatggtattttaatagggtcacacttatataaactgttttgcaacttgtttctttttgtataacaacattgcaggaaaaaatacactttattcttttttaacagctgcctattaagtcatactgaatatatacatacaaacccatttgttattgatggatatttaggtggcgtctaatttttcactatttcaagcaatgtttcactatttcaagcaatgttatatgttctttttttcttaaaaaaggaatgtagccaggtgtggtgactcactcctgtaatcctagcgctttgggaggccaaggcaggcagatcacctgaggtcaggagttcgagaccagcctagccaacatggcgaaaccccgactctactaaaagtacaaaaaaattagccaggcatggtggtgtgtgcctgtaatctcagctgctcaggaggctaaggcaggagaatcacttgaacctgggcggcggaggttgcagtgagccaagatcatgccattgcactctagcctgggcaacagagcaggactccgtcaaaaaaaaaaaaaaagaatgttcctcattgtaaatttggtcaaattctccattccaaaaggcagaaaaatataaagaagaaataaaaatcacttagtcataattgtctatccagagatacctttaatactgtagtatatttatttccagattttttcagtgtatttgtttattaacaaaattggtatcatgccatctgtagctttttttttcatgtaacattatacttaagatatttcctcacatccttcaacctttcttttggaaaaatttttctgtatgttgtgttttgtcttttgtgaatgtttgtttagttttctgttcttcgcgtttctattggaatgttaatgtgtgtttttgtattggcttatacagtaaggctattaaccttttgtctcatatttgtttcagttatttttcccagtttctcatttgccttttaattttgtttgtggaatcatttatatgcaaaagtcttacattttttgtataatcaaatatgtcagcatttttctttataatttcttttaagcaaaacacatttctttaaaacacataaaatggtagctaataagtgattttgaaaagtttccattattattactacagcttttaaatctgtatttatttatgctttacagtaacccccctgtggggtaggtaatgttatctccgtttcactgataggaagttgaggcacagagagtaatacagatagaagtgacataaatgagattcaaactcagggttgtggacagtactcttactcactaaatatattgctatatattttactgttataattggcctcaaatattatcctgctctgtcttaacaattactaaaaacgagaaaaatatgcatcatttattctagtttttcaaatagttttataattaactctattttgtctggatcttatcttgatgtgcagtgttaggtgaagctcatatttaatttttctatttgtcagtgtccccagtatattagtgcctctttaggaacttggaaaggacttgccttctctaagaagcctttgtgattagtgccacttcatgttacttgtttctgcaattgtttatttcttcagaattgttggtttctcagcagctttgatctgaatgattttgtggaatctcatgttgctcctagattaaaagatttattttaaaaaaagaggtgctgtctcttcaagtcgtttcattctttacataagaacagggtgggaggttcttgtcctagttagcatcagcccctctcccccaaccctccacagtcagcagatccatgaatttagatgagaggaaagccacatctccattttcactaacctttaactgaaattgattatttccttcaattttgattgtgggcaaaaaaccacagtagtattagctgttcctgggactttaaaccacagatcagatagttaatcttgcatttcagttgttccaggtacctttaaatattctttatacgcatcactactttgacaatattgtagttgatccaccactagattttgccattaatgcattaagaagcacattcattaatatttcaaatattcaaagctattttggaaactatatttctataaaattagttttctttgtaatcctatatgttttatttacttaaaagtgtatatattttatgcacttagaaacatttttctgagaagggcttataggtttcaccaaatcaccaaagggatccatgataaacactgtgaagagttcttgtctgtttgaatacaaggcataccattgggccttgtaaattacccactgggtactgagtaatcaagaggcaatttaggaggagctggaaaatagtccaatatattcctctctagtgctttgattctttcacttctggaataattctctttatagtcctaaagagaactgtgtattctctttttctccatctcctttgcctttcatcctccccttttcctctttttcacttagtattttctttctttcacatgctcccttttttttctttctttctcattctcttcttccttgactttgctctttttcccttttcttcctcttccttttcctctctccccactaaaaacattaatatcttacggagtttgtgtttcaactattttcagaaaactttttctctttgtggtctaagaaagagttcaaagacagagataaacaaaaagagttgacagaaagagttaataatatcaacaagaagttgaaagcaagatttgtcaaagataaacataaggtaattatctggaaatagttgaccttagaggtcacctgcctggtttgctggtctggcccctgggaaagcccttgtaccctggttctggttccatcattccaagtcctactttcataccttagttacctaattccttttataagacaatcattcacactaattttcaaagtcccacaaggagggacttgttttgagacaatgaggcaattagactgtattgttgagttacagtcatttctttgagattagttcgaaagtatatatattcatggacaaaagttatcacataattttctcacctaaagtggaacttttgatacctgtaataagttagtagtttctcaactgcccataccatgatctcacctatctgctgcaatgtaatagtcattgttcatggatgcctatttatacaatgtgtattgctacagagcttttccttcttaaagtaatttctatgtctgggatgatgccatttttctacactaaaaacattagctcgtcttacagctaatataagctgaaaattagaggtgcctgggggagggaaatgaggcagatggattgtttacatgagtgctatagtttcactttttatgcaccagtcaccttggaaaaattaatgccctgtaagtttgccaatcagattgctccagtcatctctaaacattccatttggtttattagaataataaatactgtgcaaaaaaagttcatctggatccaggatattatactgtggtcagtggaagaaatatgtgctgcaccttacctctgactagatttggtcaggtgacacagtgagcttgacaaagggatacagatttaccctatttgggtgttgaatctgaggactagtcactggagttacagcctttagaaatctttgtcacctgtccagggctggtgctggtggcctcttcactggccatttctgtcatgcacctgaccatttgatgtctgctgagtggtctattaagaaaggattaaaggatctctcttcatccttccaggtggattcgggtgtctgtagtcacccagaaaagacttactggaaagtccattaaaggtgtcatctaatttgatgacgatgactctgaattaatttcagttggggaagcttccatttttatgtctggcttttaggtccttccatgatatgtcccttcttgtctcatcagactcattccagtggatccccaggaacagctctactgctctcagcgaaagaggcctgaagtcacactgcttggttgatctgtcgtgacatcctaatattttctctcaaactgttttctttcgtcctgtgtaaactttgctttttctctgaggcctatcctagtgtatttccaaggccccaggttaaatcccacctccttcccgagcctttcctattgtcttactcacttcaccaatctctcttgcccctaaccttctacagttctgaaacccgatacaaaaagaaaaacttttggcacaggaagcgattgaatagaatcagataaatactaaagtcataaacataaaatctggatttattcatataagggatattaaagttaaagttaatatacataagtatatttcaagagcaaagctcatattttaacactttatttctggagtataggttccaggaaaaaggaataaaatctgtaatttttaaaaaggcaattacagaatgtcccctgcactaatcaaattaattgcagcattaaaacatggatggactttgaaaacatgctgagtgaaataaatcagacattgaaggataaatgttgtatgattccacttatatgggtatctggaataggcaaattcatagatacagaaagtagaatagaggtttccaggagcttggggaaggatgaatggggagctgttttttagtgagtacagaatttattgggaataagaaaacattttgagtagataatggtaatagttatgtaatgttatgaattaatttaatgtcactgaattatatactcataaatggttaaaattataagcattacgctacatattttaccacaattaaaaaagcaatggaacaaaaaattaaaaattaaaataaaattaattgcaccattatttgtaaagggaaaaaactccttcagtgtctaaaaatggaagaattaaactgtgacatgtgtagtatactatttatgctcaattgataatttaaaattaaatgattttgtatattaataagaatttttacataatgttaagcaattaaaaacaaaatataaaattattaaaatgtgtatatatggagcaagatgagaagggaacatgaaggagtgaaaagagtttttgctaagattgcgggattgagaaattctttaattgaaagatttctctcttaacagtattataaaactccaaagtttattatataaatatgttaggtttcatagtgttgttctctgtgattgtttttgacatcttaactcaattgtaaacttcatagaagtggagtccatgtcatttatttcttccataacccatgcttttaaaatggtagagaaccacaatagattattaatgtttttaattaatggatagatttattagttatggagaaagtaagtcaaactagagcataggaactgacattttttgaacgcttactaagtgccacacattatgctggatgtttagtatagtttttttaatttgaatattcataaaaccctgagagaaatgtattactaatcaccttctaatgatgaggtatctgagattcagaaacataagtgagctgtgtgagtgatatgattagtcaaatttgagaccaggtgagtaatcccagcactttgggaggccaaggtgggaggatgacttgaggccaggagtttgagaccagcctgggcaatatagtgagaccctgtcaccacgaacagtaaaacattagccaggcgtggtggtgttcacttatagtcccagctactcaagaggctgaggcgggaggatcgcttgagcctgcaaggttgaggttgtagtgagccatgattgcacatgccagtgcactccagcctgggagaccctgtctctatacacacacaccacacacacacacacacacacacactctctctctctcacacacacacacacaatttgaaaccaagtttttattgtttttggttgatttttcttattccagaaacatatctctttaactagtaatatgttagtgtaaccgtggaacattgcgatggtttttgtgtcttaaaaaaacttaaagatgctgggttcatgactaataaaatggggtgtgtgtgtgtgcgtatgtaaggtatcaaacaatgaacactaatgaacactgcaccttttccaacattgccactcaaggacttcccacagactgcctgttatttgggggcaggtcatgaccatccccatgagatagtttactagagagcattattcttcctctctcacacattggtattaacttagacttttgtggtcttaaggaataaacacccactcaagccagctcagatgacaagaaagttactgcaaagaaagaagaatcttctagaatatcaagagcaggagccttcctgtgtaaaaattctggagcctctactgccggtggcctaagtagtcatttttcagaccagagtgacctgtccctagtcaaggttaactagactagaattaagcaactgagtcaagggcagaaactaaggggagaatttgccagtggcaggtgggcttgaaagaagctgctcagacatatttgtgagacatgtcagtgattgaggctctgcaaattcctgctgctgaagtccagcctccagtgccagcttccacaaagctctgccctgtcatggcccctgttcttgaacgaaatgcaaagcaagggaggatgatttaaaagctctcattgttcaattcccacctgtgagtgaggacacaggaaggggaacatcacacaccggggactgttgtggggtagggggaggggggagggatagcattaggagatatacctaatgctaaatgaggagttaatgggtgcagcataccaacatggcacatgtatacatatgtaacaaacctgcacgttgtgcacatgtaccctaaaacttaaagtataataataataaaataaaaataaataaacataaaaaaataaaagctcagagcacaaatagagtactcagaagtttttgctaggttatcatgtgtaatttaacaagatggcatttatcttttttttaagagactgaagaagaattagacaaggttagctgtgtaaagccagtggtaatctgccacatgtggttataaatggccataattttgtatgatcccaaagcaagatagatagcagattaagggtcagcacagatctgcaagttgagctcatggcactttatttccctccctagccccttttctagtgcttaggtagcaggcaccagttaagcatggtgtcttgaccatgatactgtggaccaagcagcgatatggctatggctatatcactgttttgcctgagagtcatttattccttcattatatatttattgggcatctactccgggccaggcatgtgttgggcattgagaaagtggtgaaaaagacagaggtcctgtcctcaaggagctttcattccagtggaagaattcagataatacacaaaataacaaatatataagatattttcgagtggtgatatatttgaccagggaaataaaactaaggaaagtgataatgggggggtgtggagactggctgctataaaatgggtgagcagaggaggcctctatgaggaggacttgcattagctgagacctaagtcatgagaagcatccccatgggtcttgggaaaagtgaggaaaacatattcaaatagaaagaaatatctggtgcaaaggctctgggataggagtaagcttagagtatcccagaacaaaaagagggccagtgtggctgagagaccgtgtgtgtgtgtgtgtgtgtggagaggggaagacagcgggggtagagatagtaggggagtaattacctcacaagtttcatggctgacacctctataacaaaggagattaacaagagaaaagcatagcacatttatttaaccaaagttttacatgatgcaggagccttcagaaattaagatccagacccaaggaaagctgtattattatggttaggtttgatgaagcatggacagtcatgtagaagtatagttggacaaaaagcagatatgacctaatgatgataaactagggggatcttagcaaagcctgtttgtttagtttcttcttggcctctgtgtttaacattccatccctccgggtatagtcaagacacctgtctcatgagggtcttcaagagagaaggtcagagagacctttttgcttctgcagttttcttaacttccttcagcttaatactcagtgcgccaagcttccatatttgggggtagcattttctgcactctatcatgctataagctgattttctcacatttagaggaacattcaacagctaacataaacaattacctgatgtcatatttgaagatatacttagataataaggtcttaaaaaacagtaagtacattaagtacattcacaacaattgttaatcttccattagttctgaaatgcctaatctaacctttgttttatctcagacttgggctagaatgctccttttaattcattctgcatgatttcatagaatcaattttttcttaaggtctcatatccttcaaagactttagggcaattggtcacgaagacccttgcacctcctcaaggctgtgtgctgtggatgttgcagcttaaggaagcattttgaaattgggcatctttcacagcctagtgtagaagttattggcccgcagtttttaccggctttctctttcagaaatcttcttttgttcctgccacaaggcaaaaacaggaaaagagatctgtgtgaaagaatgctctcccttttccttttgtggtgattgtgtatcttaagagaaggcctcaaaggttcccggagctgtctgtcttttcatgtaaatggagcccttaagcctatttagaagtgtgcgaaaagactgtgggagttgaggtgaaagatacagaagagtagcatcagcaccccgtttaatgtattcaagttcaactgtgcactctctctttcttgtatataattaaaaatactgcagaattgtattttgcacttgtacttttaattatatgctattcatattactatatacccatatagtgtgcagcgttgcaactacaaaaccatatattttgtattgggaggtttaagggattttccagggtaattttgaccgcgtaaaatttgccttacatgccaactctagaatacaatccccacgtaagatgtaaccctctatattaggtatttttaaatccctgcttatcccaaagtgagcagaactgggactcacattcaccccttgcccccaaaccagtaacaggtatagggttgtcactgaattttgtgagaagaaaagaggtgagacagaaggaacttgtgaggtttgacagaggagcaaggaaatctgtggcaggacacagtaggccggggacgctgggtcaggcagggaagggggctgagagagagttcctgggtgagactgtttgtactagtaaatgcagggctcaaagccatactagccatggggttggtagagtttgtaaataggagtaactcctactggatggataatagccatttttccctagagtaccttcaccttacaggaaagtttactgtgcattgttccatgtgaatgttgcagcatgtgtgtgtgtgcacacacgtgtatttgtgatgttgtagacagagtaggaggaaagagtagcagtgtggaaagaggagaaggcatgaggatttagcatccaaggtttaagaacaaggtctgccttttgttgttttgtggctggggcagtatcattaaatggctgaggggacctgagatattggcatgagagagggaaggtcacccttgtagcccctgtcacctgctaccttgggaggcattcccttcccctcttctcacccaccctaccactccaaggcagagtttgtttaatcagatgcagaaaatgttctgatttggtagtaaagaaaggtaaacaacacatccccatgccccacttaaggtttttaacaggtgcagttgaaatttatattcatggatgtgggattttcacctgccccctgacccagtttgtttaggaggttaatagaattccaagtcgcatctccctgggttggaattttctctacaactcttggtagtgatggggttcaggacacactaccccacaatatgaagcctggcatttgtgaaaattgcagaagcaggaaggtcattctcttactttccccctgcccttctctcctgaagctaaggagtgtccttatctctgaagacacacggactcagagaggagtttgaacaaacaggccttgctaaattccctcttgtttattgccattaaattatatcccctttttccaatcatacttctctacgactatccatctcttcatcaaacctaagtaaaaatacttaagtttacttgtttctttggatcttgatttctgaagcctcctgtgtcatataaaatttataaataaatttgtcatgcttttctcttggtaatgtggcttttattatagaggctcagccatgaaaaaataaatcgtttcctctcccacagtagctgttcgtcttttgagcaagtcttttagcctcagtttcctcctttgcatcagagatgatactgaccaccctgatgctctgtgagggctgaaaggaacaggatacctgcaagcattttcccacaacttatgcagatgacctgtgaacaaactgctaaccagcaagagtgtttgaatacaaaaaattctaatgcttaatacaacattttactcaagactctgttacatatgacaaaaactcagttctaagaagcttatgtaaaaagcagaatttcttgttttatagaagccagggaagacctgaggagtgaaaagggaaatcaccacatataagggatgaggcaggtgagtgctcccaggacagacagtcccaatgatgttagcaacatattggaacaaaaaattaaacaaggtcttagaacttaaatctgattttataataatattcattatcaatacttaattctaattttacatttttagatttatgtaattaacattagttacctatacagtaaagataaatatgtttcataatgctttttttctgacattagttcttgtttgaacacacaaagctacacttttctataagtaaaaatgaatatgtcagactttcaattcggaaacttgagtcaaatcagcagtctctgggaagaggaaagttgtaaggcctatgttctttcataatggcctagcccttccccctcatctgacattttcttgtggaaaacatctggtttaaataagcactaatggcaaacttgatcatcagaaactagaatgcagaaatcacaaacaatgtatagtaggttaaagggatgccaaaaagcagtatgcaaagagaagtcaacagcaaatttattttatatataaatttcaccattttggtgcttgtcttctaactgccttacacttttctcttctgggaacggccaaggcccccaaaacacaaaagtgaactatgatcccactttgctagactcttgagatggctctgtaaacataccctctaatctatggtccttccttcctacttcctcagaattcactgaaaacaatagagctctaggaactcctattgcttaaaacaggggtgaggatcgtgtttattcaggactatggctgttaaattagcaggactgttttgactagctggtactcaggggtagggttgtcatgttggtcaacatgcctatcccatttgggactactctaaaggaaataggaatgcctaaaaagtttctagacttctaagaattctatgactggggttagggatgacttataggcaggaacggagccagactcctgacggtatccaaggtttataggcttggtgatagaatttaccagagtagaagagaaagttttctgagtagctagtgttttgaatggcatggggtttgtgacaagatttggggtaagccagtgagagatgctttggagttatctgggacctcatttattctggtggaatgccagaagtacaggaggcatctcctagggtatttagttttttagaggctaggaaaggtagtaaaggtaaagtagatacaaatttgttactatgacttttatggagccttgagatagttatacgaagtaggaggttgagcagggattattttaatcggagaagagattagtagaaactcatttaggaggattagagcatgctgaatgagatgtcagaagcttttaggatccaagaaaagtggatggcagagagagagaggggtcagcactgtgtttaatttccttctttaccgtttctcgtctgcctttcctggatattacctatttcaaactaaagggaaatgtgtggaggctgcatcgggtagcagaaaaacatggaatagggaactctgcctctgaaatagcatataatacttcccacagggtttaatgtgaaataagtggtataatctaggtcaagtggcttaggtagaatactgatcaagtgaccagatgtcttggaatgagtaggataatcttagattttggcttcctatcctgtatccaattcactttaccattagggcttactattaccttgatgtctggagtgaatagacccttatcaacttacgataaacatttatcagtagtttagacagaattcttaaactggattcagaactagaattataatagcagagttactgtatgtttcaaacagtgatttggccttagtaaagtttggtctcttaagatttattactcatttatggctaagtatatcacaaataaatgttaggtcccctagtgagtattcagcaatcatttccttgggatctaaggcataccaggtgctatgttcaaaatgaatgggacatggttcttgtttttaagatgctcccagaccagtggggcagactggtataaaaataactaactgtcggccaggcgcggtggctcacacctgtaatcctagcactttgggaggctgaggcaggtggaacacctgaggtcaggagttcaagaccagcctggccaatatggtaaaaccccatttctactaataaaatacaaaaattagctgggcgtggtggcatgtgcctgtaatcccagctgctcgggaggctgaggcaggagaatcacttgaacccaggaggcggaggttgcaatgagctgagatcacataccactgcactcctgcctgggcaacagagtgagactctgtcttaaaaaataaaaaataaaaataacataactaactgtataatataataatatgataaatgctattctgttggtatgaatcaagtagcacagaggaagaaaacaattcactctagtagatggttggcattttgagagagatataaatataattgtgctcatttataacatgaattataaatgtagcagcattggaaatggacatttaataaggtgtagcactactaaattggattaagtgcatgcactgggtttatagatggatgttcccatcaaatttgttctttatttgtatccctacccctgagcagtccttgcctggcaagtgattggtgtttgcactgttgggggtaggctttaggttcctgtttgggcaccaggagctgtagggttagaagaagtaatgtctttttctcacctattgcaaggttcattactgaaccctatagcaaaggcagagtaacaagcaaaaagcataacaaatttatttaacagagttttatgtgacactgaagcccttagaaatgacccaaagacccagggaaaactgtgtatttatatggatagtcatacagaagtatgattggagcaccacagagtatcatctaatggtaatcaactagggagaactttgcaagccctgtttgttcgaatggcttccaagtatagggtaggacccctctggaatgaagatcttaaggcctacttttagggaagataggtcagaaaattattttatggcctgcttcagagggaaaggcaagagaaggtcagagagtgaccttcctgtttctgtggttttccaatgtcctttagcttaaaatgcttggtatgccagggtgccatatttgggggtatcctgttctaagccccaacatttccctggaagggcgatggctttttgatctaagcaaagttatcagagggaatgaggtacaaatcaatagaggacagactatgagatcaaattctgactctactacttaagagctgagtgtcttttgacaaattacatgtattcctggtgactctgatatctctataaaatagggatgatagtagtaccaaccttacaaggctgtgcctcaaatgtgtaataaatatgaaaacactttgtaaagtgctgtaaaaatatataaacattattgttttatcacaaatatcagcacaccaattatttatgtagttctatacattacgcaaaaagttacagagatgtggggctcatcttctaggaaaacagaatcagaattctgaatcagctctaaagtcggagaccaaacctcgagctctctctaggtgctgtttctcctgaaaagttgacttgtaagtctaacccagtgcattgcctctgatggcctggtgttcttcagataggtaaaaagcaactcgaaaaggggaagagtattgtgctttccgcaaagacgatacttttttgctctttggaaattcttgctcttttggttttgagctctgaaggtgaacaatccagctgattcaaatccccagagtagccctaataataggaaaaccgtgacaaccgcagatattaaaaacatacctcaatttgcacaactggggtaagacaaatacatatggtattatatgaaaaaaattcctttatgcaaatctagaaacttactttaatgtcatttcatttaacatcaaagagatgatgtcaaagagaacatgtttaccactgggagagtcaaatgaaagaattagtcttctagaattctttcaaatgaaagaatttgtgtgtaaggtttgattggttatttggcaaacactaatattaataaaaagaccagtacttctagatatgggccactttgtagagggattatgccagaactcccatagtatgtatagagacccttgaaggagggtcctcaaacccataagggaatttattttaaaaatattttgcttatgggcccataacttcattttatgtctctctagctcacaatagaggattataatctattgggctgatatatctgagttaacatcagattaatcgtatcactttgtgtatgaatatcatataaaaatgttagtggctgctgttttcaccatgctctgtcataattaaacaatttatttcatgctgaagcttccctgtcctgattctgggattgtcagttttatggttctcattttacacagataaaaccaaacttttcagatgtcaaataatgtgctgcagacttccatgcagttctcagctgcagttataaatcactgttgttttaagtaagtgacctaaatgccatttttattaggaatagagtggctaggagagactaacataaagcctctgatggagttctaacatttctccttgagcagcaggaagagaattgcatttcctgctggctagagaagccaggtcaattttgtcctaccattctgggaactatcacttcagacacctaacatatccaggtcctgcttatttttcttgaatgagctattaaaatgcatgtatgtgtgcacatacacacatacatacacatcatgcagccatttgcctctgtgtatacatacatatcattgtgtagattgcactttttcagaaaagacaactgatcaccagcacgtcactctcacttcctcccatgtacattttgtatcttccccacagggaagtgaaactggtggtgggttggaagagattgagtttgctgaagtggattctgccaagtggctgtttgtggatgacctttgtcttatagggggtaatagtgggagttacggattcctggcaaaatgtctgttcacatctcatcacaattagaatcataaactatgggctttgtggatttgttcacctgagatagtgatgaactaggaatcaaaagatctgggttttagctctatctctaaatatctacatatatgtgaagatagctgtgtataccactgtggatattttccctcttttgtcttatcttctccatgagactttcaaatcctcaaaggcacagagcatctttaatttacacagcattcactttttcatctttgtttgttcctagactgcatttagtagagatgtaataagtacttactgactgatagaatgagaccacatcctgccttagatgaactggaattccatttgaaagtgtttccaaccagaaatattctgctttggtgccactgctactgttcagattcaactatagcagccacagtgtgatcagacaccttctcccctcaggcgccacccttggccaccctgagaagatgggcccccctgccagcatgtctttggggcccagtgtttctgtctctctgcttctcccaacactcagtggcctgaagaagaagagctttggtatataatttcttttttccccccagccaagaggaattgagcactcatgaatattttaagcgtgttacaaagaacacaaaagctgtgccttcatgggaggattaaatgttggtgtttgactcctcacaatcagcacattttaaaacataaaccagatcatgtcagtctcctgcttcagagccaccagtggtctcccacactcttgcaaccaaacccaaggctgggtgccagcctccaaggcactgcctgactcagccctgcccactgctctgaccacctcttgcagtaattccagccatgctgatctactctgggttcccagggcatcgtaagcatctttctctttaggacctttctacacatctcccctgcctgggaccctgccctgaaccctgtgctaccgcaggatcgtcactcagatctcagcctgaatgtcctgtctcagacaggactcccctgactgtcctatcagtatctacacccgatattttatttcctcacatcactcatcatatctgaaattgcctgctcatttcctggttttcttgtttactgttggaccctgactagggggtctcactctacaagggcagaaagaggttgtcttagtctggttctctgttgttacccagaagctggaacaacgcctgttccccagcggttgctcagtaaacacatgtggactcaatgagggattgaattggaagttatttacctctctcctggcttttgcttccctctcttcctttgtctctcttttgcggaatctgtaccatgaaaagggctgttgtccagtagtggaacacaggccttggattgaggtcctggttgactcacttgatctgaagcttctggtcatgcacaactgccaattggaaacagctactatagaaccaccctctttttccaaagggtcaacaaggaaatcaaaaatagaaatacatttcaggtagtcatgtaatactttactaatactaaccctaagaataactttgcgataactttgcaaccttaacttccattagtctcactaggcagttctgcttcttcaattcctttagtttgttacatgccctgcgatccagcccaaaacaggagaagccctgtagaatatatgttgctatatcctcagatatggccaataaaatttgtttgtgacctgtaaggagcagatggttcactgaaggccattcatagaggaggcaaagcaccaaaattcagtgtctagccttaatttttccttattagagagtctggaatagagggatacattttcaggatctttcctaatagaggagttctttttttatttggatgaagagattatttctgtaatttcccacagtcttaggctgaactctccaagtaatgaacttttactcagaatagtctaggctttgtgtactcatggaaagtgtaatatagcttgccttgttggtttttctggagatagcacatttgggtcacaggggttcagccagtcttcggctgttatgcagtgtaattttatgggaatagttttataatgttaacatctgtagactgagagcttgatgaagacatcacccagattgcctgggaaacgccactgactttgggagctaattcttgataggtaaaatatttagctctctctctgtctcttttttttctttgcctagatacagctaccaaccttaccatttccatcttttatggcagatgagctatgtgtgtatttttttttatctccttgcagtatgcatttttgcaagttaggggataaagcccaggcccttggctttttaacttttctgcttccttgatatttgtacatgagataagatgttaaaggatttctctttacagatttctgttgaagagttatagaattgactgaatattcatatgtgtactgtcctctgcttcattaactctatgttcatatttctttttcccatgaagcctctgtcgcccattttgtttaaaattgcaacctattcccacaccttaagctaaatctcccttaccctagtttgtttcccatagtaatgatcactttctaacatactgtatcatttgtcatttattacgtttattgtctgcctcccaccactagaatgtaaactacagggaaggatttctatctgttttattcacattgtatcccaagtgcctacagcagtgcttggtgcatagtaaggctttgataaatatttattaaatgaatgcactgacatcctagtgaaaagacagatactgtagtgtagtgatgaaaagcttgggctttggagtaaaacaagcctgggtttgaatcccagctttgctgcttaccagctgtgtgtctttagaaagtgatttaacctctctgagactcatttttctcatctataaaatgaatattatagcaccttgaaagtgtgttgtgaagataaaaaaaaaagataaataggcaatacagcatggtaggtaagaaacaaggctttatcgtccaatggatatgggttctgggctttagcttccagttatggctctcccattaccttatacaatttttagaagccctctaagctcattttctttacctgtcaaatgggtataaaatactatggcctgcctcacaggagagtggccaggattaaaggaggtaatctctgcgtagtgcttagcagactgatcaactcgtaacaagggactaattaattgaagatgacgatgatgataatgtttgaaaggtgcttagctttattgctcacacatcatagtaattgctcaataaatggtggccttgacaataaatgaaggacaactttattagaactctgggagcctcccaaatttgccattttctttttgttctcctttctccagggggaagtaaggcaaatgcatgaagttatctttgtgagatacttgtttcaactcgaaaatgaaacagcaagcaatttttgtgtgccacactttttgccctgtcaccaacagttctgttatgatttcagaacttaatttctaatttttggatgcagttgcacagaggcatttcttcaccacgtgatcactgtgggggcttaatataactcaggcatttgctcagctggtttggagctaatggaattggctgtagtggctgtacttaggggagattataatgtctcaagggtttcattggcttccacttccttctgcagacttatagtaaaagacaagagatgcctcttcctggctctatttctcatttgctgtgtgactctcagcaagacacttcgctgccgctgagaaccacacccactaagtggacgacccagttatgaatccttgctccattctgctgtatgaccctgaccaaattattcaatgttgccatatcttattttccatctttgtaaataaataaatgtatatgacaaatagaatgatcctataccttagggctttgtgaagattaaatgagatactacatgtaaagagcactttggaagtactcaataatacttattattatgttttctgtataaaaaattgaaatgttctattaccatggtattttgtttataaacactttatatatatatatatatatatatatatatattttttttttttttttttttttttttttttttttttttgagatggagtctctctctgtcacccaggctatagtgcagtggcgtgatctcggctcactgcaggctctgcccccgggttcacaccattctcctgcctcagcctccccagtagctgggactacaggtgcccaccaccttgcctggctaattttttgtatttttagtagagatggggtttcaccgtgttagccaggatggtctcgatctcttgacctggtgatccgcctgcctcggcctcccaaagtgctgggattacaggcgtgagccactgcgcctggcccaacactttctatattttaaaagttctagaacttcggcttctgcccatgatgtcctgtggggtcctgaaagcaactgttgaagaatatctttgcttgaaaagagccacgagtgaccactgtgtcttcctacaagtggtcagacacaattgtctcttgattatttagtgtaatgtaggggaataactgagattaactggtggttatgattttgcttaaggcagtgtgatgaggacactaaggttagggcagctcctgagcaggaggaggctgctatccagagtcaggaagtctcccaaggtgttttttgcctggtgatcagcttttggccaaaagcctattactctcaggtgaacctggccctgttcttggtcccaaagctcccggaccaggctgagctataaaaatagaatgccaaattattgatcctacagtgtaaaattaagctgttctatccactggataggcttgcctaagttcccctttaaggcaaattaagtgacaaatcaaattattggacagttgcttggtaagtacagaattgatgtgaggggagttaagtgattcaaatgcttatattatcaggccccgttagcctgctgttccacctctacagtgcagatctatctgtcaggtgaccacttgagtgggcacacagggcttcctggcaaccctgattaggttcggaacaagcacttccatcatttttcttttttttcttagagatgtgctctcactctgtcatacagagctggagtatagtggtgcaattatagctcactgcagcctcgaactcctgggctcaagcgatcctctcccatcagcatcctgagtagttgggattacaggtgtgagcctccatgccaggctatactttatataaaattttttagctgacagacttcctccccatatcctgttctacatattattttttatttaaattctatttttcatcagagtaaaacatgtataatgttttacaaatctagtaatagtatagatttgtactgaaaaccagtttcttgccccaatttccccactctcctttgcttcttatgcttcgggagcagccactttcaaatctcttgttgattctactagtgacccccacatttctaactgatatgcttgaattgctgtttcttaatttttctattttagacattatctcatgttttctatggacgatgaccatagggtacttacaccattctctccttccatttcactcttccccttcttttttccggtatgattatatcataatattcagttaatatttacattactgtgacaatgtaagcattcatggcagagctacaaaatgtaccatgattacatttactttcttccttcctttcttgtttgcattttaaaatttatctctggaacacacatttctctacccacatctcctatctttaaatcgataagggcatatgaaaccataatgccttgcctttactacacctaacaaaattaacaattcattaatatcatccaatacccagcccaaaatcagatttccctgattgtctcaaagatatccttttacagttgattagtttaaataaggacctaaataaggtccataaattgcatttggttgttatatccttttactttcttttattctggagtacttcccagaataaaataataaatgtcacaaataatgtcacaaataattaataattatgtcagaaataattacttccttactctccttttatttgtgacattaattatttggagaaattggatatcaaatgccctatattctagatttggctgatggcttcttcaccacgtccttttaacttgttctgctagatcttatatttcccataaactggtggttgctgctaaggtttgattagattagggtttagagggttttgttttgttttttctttttaggcaaaaacactctataggtggtgctagtacttcctattttatcatgtcacaaggcaataatgtctgactatatcacctttaatggtgattaagttgatcagtggttcgggatagtggcagcctgatcttcttcccatgaccaagatttctgtcaacttttcacctactggttttagcacccattgatgatcattgcctagatccattgtttaatgagacatatattctgtcctttcattctgcagttctgtcctgtgccagtgagtgctgattattatgcagtttaactccagaaggccatcttattttcctcatttccaagtctgtgttagagtcagggagtttctctgtgaccctcatgtgctacctgagaactgactaaatttatatgaaagtaacattcttatagttgtattgattaaaatttttatttgaacctctagttgagctttgctgttggctttgaaaacataatggaaaagtggaaagcattcttgtcagtcatgttgaaaagtaactggcagaaaaagtggacttaaaaaaaaaaagtagtggaacaaataaggggactctgctttggtttataatgcctcctttctctagggtaggaaaattttgaagtccagtggggtctctcctgcctgcgagggaattggcgagaagctatcaggatacgcatggatgacacacagtcacacagtcatttgaggactttttggttgctgttttgttttagtttttacccccttagagaagtctttcataaaaatttttcctaaaccctgttgcatgcaaattagggcttttcctttcctctgtaatggggcctgatattctttgatgtgttgtagcagaatttagcttctaaatacagtttgaaactagctctccacacacacacacacacacacacacacacacacacacacacacacacccttgaattctcagctgacatgttatttctatttttttgtccttactgcaagaacctgtcctgtaggaaccaagttcagtggtaggaggagattatgtagacatcttgcttctacttcctgtaaagttggatcatgcagacatgagatgcaggtgaacaggagaaggaagtcctctccagtgtctcccagctgggagcctgttttcatgcttttcaaagagctccttttttgagacagatgaatccctggtataaatacctgtgctgttattatagaaagagacagattggtcaccttgttaatgacttccagtattccagagttcctcctctgaaatactctgcagatccaaattatcataatataggggcctcttctgccatttagaatgaccttccacataactctcaatgtccaaattgggcccttccttcaaggcccagatcaaatgactcctcccctgagtctcccattgagaagtcataccttcccatctcctagcttcccatccatcctcttttcatggattacttgctacatttcattttagctcatttgcgtactcattttactttttttttaaacagaaaaatatcagtcttatctttgttttaaccacgatttgtatttaataagtattttcataacatttttaattttaataattaattacttgagtaattttgttttctgagatattcagcttttatttcaactatgcttccagtatctacaggggagtctgtcagtcacatgttgagccaggttttctatttcagaagaggaaggaaaagaatgtgtaggggaattagtatggaactggagtgagaagaactagattcaaaacccgtccccaccacttcagagcaactgctttagtgcaattggtatgtcagcaggggccttccctcaaaaatacacagctctgtagcaaaagtcatctgtaagacatatttaagacttagttcatcagaaagagggtagggaagaaaggactgtgtagatttatgagcagtggtggatggcacagggatggggtcttgggccctcaaagccctccgaggtagtactggctactgggaaaaggatgtcggggagcaggtcccacttttagctgcacttgaaaagatgagtgtacaaagcttatggagtactcaggacggagagaacatggtgagtgttagggaaggaagccttaaatataaactttactctttaacctccttgcaatctcactctgaacctccttagtcccaggtatgggtttctctcacttcttacttccatagtcctctcttggaagctctttggctgaattaatgaaggggaccactactcataaaccataaccagcacttacgaggagcctcacattagtaatggacgacaaccctcagagacagccataggtcctaatgctattattaatagtcaaacctgtgtagagaaaaaggagaagccaagatccagttccacgggacataacaattcacaagcagctcatccttatttcagaaagccagtaagacctagctttctcatggaggttattctttcaccgtcagtctgcctctttttctgggaggtgccctccccttcaggatcaaggaatgtaaagaccatgagatatggagtcagacttgggtttaggcccatttatatgctgtaaactttaggcaagtcactttttctctctgatacggaaagagatataatatataccttattgatgttgataaagatgttcagatgaaattttatattcatataaatgtgtatattatatatatggcccgttcattattttaaagcaatgtaaataattcttatctattaccatagtatttcaaaggctacatcttgccacaggtgagaatcagaggtatgttctgggggttttttttgtttgtttttgagacagagtctcgctttgtcatccaggctggagtgtagtggcataatcttggctcactgcaacctccgtctcccaggttcaagcaattctctcatgtgcctcagcctaccaaatagctgggactataggcgcgtgccaccatgcctggctaatttttgtatttttggtagagacagggttttgccatgttggccaggctggtcttgaactcctggactaaaatgatctgcccgtcttggcctcccaaaatgttgggattacaggcgtgagccactgcgaccagccagaggcgtgctgtgttctattggctcttttgcctaccagtgccagaaatttcctacacttcttggcatcttgcttttctctcctatgaaataggcaatactagttgccctagagaagaaatttatctagagaaaaaaatgtacaaggtagacacagctggtgagttacccttatactatttccagtactaccaatttcatttcttccagaaggatttagaatgccacatagtagttttcctggtgccatgcttgaaatggtgaatctatttgaaagaagggattttgtagtcacattgatgttgctgcttgctgcaagccaggcaagtcacttaatatctttatccttaaaagaggaataatgtcacctacctcatggtgttacgatgaggatgaaaggaggtctgtaactaaggcactgaacatggtgtttgatactcactgggtacccagtaaatgttagttttctttgtctagactatgtagtgctcttcagttttcaccctgatcaaattgcatttgttaaaaattccaagtaagacatggcactgggtactttaaataaaggggtgctaagggaaggtcagcatgcggtagagggctgaaagagccagttacatttgtttgtttgtttgttttgttttgtaataaacaacagtggcttctcatctcctttccctggtcctgagcctgctgagtcactgttccagcccttgggccacatgatctcaggctgtgtctatggaatacagcaaaacccacaagaaaccagcactaatagatggcaggtcattttgagggatttttctttgcgttcctgtgcttgctctcctggtgagataggaaacctttaataagacttttcctaaatgatgttgcatgtgaaatgcagatttttttttttctgttctcctaacaaatgaccatttcatgaggtttcttttcattttttcttctttcctgcttctcagtacattccacaaagagcttattcctctgctggttactgattgatggttctactctgtatgccctttaattttgcaataaaccaacaaggagttgagaccacaaacttaaagagaattgacttatttgactggattcactggagccaacaggcagatttagtcatttcagtgtggtgctagggagggcaggaggagtccatgagaaggaacaccgtgttgtcaataaccagacagaaaaaagcttgcttgtcctctcattccaaagcatgtgggcatctgttctcggcagtgatgcctttccaggccttgatgaaggcaggacggcttccatgagatttgctcagaactccaggattctgaattcagtgggactttaggtatgtaggattggtagtcagtgtttccagcttctgtgtcccttttttcaaagggatcatggtataccttgaaggactgcaggaacagccataaaccctcctcagttaccagtcgttaaacagcctggcctcttggctagatgacttcaaagaccaaagacaaacccctggccctatcacctctatcctagctgagtctttaacataaggccaggacctctgtcaggttatagaggtactaatatacttcatgcgctggttcccaaatatattaagaattaattattttttttcttatttagcactaccattgtacagagcaacccatccgaaaaataaatacaaatatcatttcaaataggaaaaacaagaaaatatttcttaaactaaagacctttagttttagaggtatgcatttgaaaacacagatactatcatcacgtatatttaagactggttccagacccatgctgctctctgtgcgttgaaatgaaactgagaagacaaatgcccaaatggaatttttcccacctgtgaactcctattccagatcccagtgttgtttgtggctcttccacatttaaccagctaactgcctgctcttattctgttcttatgtgacaaccaatcttctgaaactctcgtcatcacatttcagcagaagtgaaaatattagcagagtggttggtggccaagacagaaatagaacccaggagtctgtgtcctttcccttgccggacctactggagcatggttcctcctgcctgaagactcagtgtttccaactctaacaaacagaattctaacagttgactggtttcttcttgctactcaaaatttgttttatacttaaacattttgtacagttttttctttatgaatgattttgcattaaacaaatgggacttggttaatctgatatcagtgaatgccttattctgaggaaattaatccacaaatatccgtgggaccatgagttttcatattgagaacctttttatgtgatagactagagagccaggtagaccaggtctgcgtctggtgctcccatgtgccagctatttgatctcaaaaaatacctcaacttcttgaacctcagtttcctcatctttacaaccaggatgataacgtttacctcactgagttgtgaggataaaataagccaacacaactcaagcaattggtaggggtctgacacataggaaatgcttagtgaacgtgagtttcctctcttcctccttcactcctttagaatagggttagagatgtagaaacacataaaatctcatgaaatgtgcaccatagagagagaaggataacacaaatgacataaaaagtcttgtactaagttacttggtattgattctaaagtcagggtattatctagggcaaggtggctcacacctgtaaacccagcactttgggaggccaaggcaggaggatcacttgacccttggagtttgagaccagcctgggctgggaacatagggaaactccgtctctacaaaaaataaaacattggccgggtgtggtggtgcatgcctctgttcccagctcctcttgtgtctgaggtgggaggaacgcttgagctcaggagttcaaggctgcagtgagccgtgattgcactactgcagtttagtctggatggcagagcaagagcctgtctcaaaaaaaaatgaaaaaaaaaatagaagaaaaagaagtaaagtatgagtattaagaagtgagagaaaagttagggctagaatagttagcaaagatatcatggaaaaggtaggatttgaactggcccctcaaagatggaaacttacagagtaaaggaggctatttcagactggggcatttggggtgggtaaaccatgagaaatagagaaattagaacgagaatgttataagccttggttttcctattggaataattgaacgcaatagaataataagtaaaaggataatattaatatgtgttaggcactgtcttaagtgctttatatgctaactcatttatccttaaataggtaagattgctatgccaattatacagttgaagaaagtgaggcacagagacattaactaatctacctgagtaggtgtggaataaataatctacaactagtaggcagtggagctgagctggaagcccaggggatctgactccagagtccaccctcctaacccaggacagctgcttcagtcacttcccagctcccctcactctgcattgaggatcagctaagaccattctgtgaacataccctgaaaagtataaagtaccatatacgtgtaaaatgacatggttattcttattaatgatgtcatatgagaggcgacaaatagctacctgaaaatgagggagaaaaactatggtctagcacccacatgcagttgtactgggcaggtttagccagtgcacagcatatatgcctcaccttcctctctagcgactcttgagtcctgaaagcctcacgtttcccatttggacagtgttccaggaggccatttccaagccagtatcagagactaaaaacctgtttggcatctggcagtagggcttgtgcctcaagtgtgatctgcctttggccaggacatccttttttttttttttttcttttgagatggagttttgctcttgttgcctaggctggagtgcaatggcgtgaccttagctcactgtaacctccacctcctgggttcaagcgattctcctgcctcagcctccccagtagctgggattacaggcacgcaccacaacgcctgactaattttttgtagttttagtagagacagggtttcaccatgttggccaggctggtcttgaactcctgatctcaggtggtccacctgcctcggcctcccaaaatgctgggattacaggcatgagccaccatgcccagcctcaggacatcctttttaacgggcttgtaccacatgattgggagtttgaatgttagtaaccatgatagaagatctccactccaagggcatcaccgtgggaggaagcctgcccctacttaccatgtaaatatttagccatttcaatatatttgttctggacttgttcttcttatgtgtgtctcctgtgttgagtctgtttaattgtaggttattattgtgtgtctatattgatgtcatttctttaagtacagacacagacagcattgcttcagctgcccccacccctccttttaaaaataacaccttacacaatatcccttccttgaggacatcaaataaataacttttgttcaagagcatatctgatgaggtggctaacttggaaatttgttcctaggcagaccttgtgacctctgtttcaatacatagtgagtggcctttgctcccattttatgctacagattcactctggagatagaattggttgcacctctccaggcagtgagtttggagagcccttggtggttaggatgccatttgtgctggtggcacagaaatacaagcagtaagcccagagttgcttactctccactggaggtttctcagaggctgggggggacccgagactcctctgcttcaactccgctctactatatgccactggaagtgtagctgaggctgaagggtatcaatgttggtatttatcaggttggactcccccaagtgccctattttcatacctccaaggagcaagtgattcaacagaactgttttcttggcctcaaatgagtctaagaaggggaaatcacttaataccagccgtctgtgagggaccgatcacaaagctgtgtctttctaatcctccttgtaaatcaaagggaggggaatccccagagcccaggagtacacatgaatagaaagcaccacaggtaataaaaacacctaaaaaggtcagcagaaactcggggagctgctggaaattcacctcctctgcctttctatgggactcagtgggcagtgatcaggtagcaggcaaggatacccaactacacaccaaagcaacttggccacaggacacgtacagtgcagcagaaggctggtaggatagtttcttccacatccatgtgaacctcagagtcatctgaccattggccttgttctcttccaggttctagctggccagagacttttttggcctcatactaactgcaaaattgcacacagttggcgaatacaccactggaagccactgtggctgcattgtcacagttcaccaattgtgcatgttatttcctgcagtgggcccaagatcactgacaggatgccgtcggggttgggctgaaggtggaaacagcacactagcttgctgtttgtggcctctttacaactgccggccccatctgagatccggaaccaacacgtgctaacctcagcccattggggccagtggggcagccagcagtggaaccatagctctccacacctatgtctatggcacggtagctgccggcccacagtttccactgcatccccttgcatgtgcaccccaagagaagtaggccaaagagaaagctgccttagggagccacatggttatcttgtgtgtttacttttgccaaatggcagacacaattctacttcaatgcatttttctgaactcagtggtcaaaagtagcacggaagcactacttgcgtcagccccctctgtgattgagcgagtgtgtgcttgtgcaaagctgaggagattttttttcacctcctccttctgcattccctcagactgagccactctcttctttaggggctcccctactaggcagagtgtttctctagctttgcctgtggatttcacagtgaaatctacagaagacagttttcctcagggctgataataagaggtatgaacttattaagattggaagcattctcaccataaacacaaattatttcaagttgctccttcatccccttttccttggccactgccattggttctgtgtaggatggatttcttaaggttgaagataagcaatgcaaaggtggaattttgagtacagcactcatcctaatgtgggtgaaatatatgaaacatttattctaagcagactgctacattaacagttgttatacattcattctctgcatatcttttgtggactcaacacttttaggtacagagaggttaggagaatttcccagaattgcacagcaggttagtgacagtgccagaaataaaagtctgcctgactcccacacccatgttttcttcaagccaaattgaagtttggcctcttctccacaaatatttcacaagaaaaattccccacagcctttcagaatttcccagaaaacaattgttgtgcagtccttcaagatggaaatggcaggctggaatattgaaaccttatcagcttttattctagaactgacagttgatattttctgagctgaagctaagataaaagtttatttttgtgttttttttttttaatcgtggaatgatttttgattttccagagcatggcaaaactaagccagcaaatactaaaaccacatttgtttttgtgacgctcaaactccgtaacaaatattgggtatctctatacaaagctggatgtggacaggaagggtttgggatggggagaggcatgcgtctgggagcgtggcctttctggacctaccctgttctcactctcttccttctgcctcttgccctcattgctttccttattctctttcttcctcttgtctccttctcacctccagctcctaccacagcagacaggttggggcagacaccgtcatggttggggagcaggaggacagcatggggaaaaccactccaggcctttctctcaaaccttagtgatgaaaggactcaatggacctgaacaatttctcacaggaaagttccggtctctgtctccttaaaagcaaggcattcagtaacccttaacagagccaggattaaaacttgaatttctgacttatcccaggcctctgtttggatagaaaggctaggtcactgtcatatatggcaattaggatcacttcagatacaaaagtaacatttttaaagctgtgccttaagcagagagaccatttttagtacaaaaaggaaaaaaagattaactgtgccttcagagctgatgaaaggcagagcctcgtcactttgaaagcattggatttagtgccaggcgggttggtgagtagactcagcacccacattctcttcttgcgtctctctctggccacccagattatccaggggctgctgtttacttgagagctagaagtatcaggacggactatcactgcacctcgccatcctggcccagttaaagtgattttgaaacttcctgatgtgtgttagattgtggcaggtttctgccagggagtgggcgggaggaggaagcaggtgtttttatgggctagaaatgcccctgagatgcctgaggttgcttcgtgaatcctctagcccagcctaccccttcaactctgttgcacagagacatgagttccatgaaaaatttagtttcaaaacttcccgtgggcgccggaaatgataaccacatgttatcaagagccactgaaaaccaccaaaaatttgtcaaaattcatataagattgcctcacatacttgactttcatagaagcggaagccattgacctacttgatttatggtatttattagcagagtctgaaaagacttttatcacaagattgatcttgttacagtgtagcatcttgaccatctttcagtgtatttctggatattagatttatttgtttattacttttataggtggaattctctagaccatgacattaaggcctggagaagtcacctgtcagtagatctgagctgagagtttctctctcttctcctgtgtcccatgttgccttaggaaggagagcaggcagggaagcctgcatgcccttatctcatctgtactattggtcttaggtgactccagttcacttggtggaaaatggggattacaaaatttgcctctcagctgcccccacagaaatctcagtgatggcgtttgtcagattcttgggtccttaaaaaatctgacttttaaatatcgaataattattttgctgatcatgaatatctcttctgctgaccaaacaggaccagatatcacattccaacctattctatccctggctgaccacaaactccctcttctttgtcccccaccaaaagtcaggtaaaatgagctgtttctatcaaaggctgtgtcttcaggcctggccatttcccactcaggtctccagtgctatccaattttctcttcacctgtacattctagtactcatggaaggctccagtatacaaaatggctactcatggggccccctccccttccaccccaccaaagatatttctaaccttcaatgtagagtaagttagaattgacatatacattgtcccttaaaggccaggaacattaagcttgagcagagggtaggtgtagcctgggtatagtctagtcatagcctagctaaagaaagatgagtcagctgaaggcagagggtctgcattgggcacatagactggcagagagttgggctcagttggctcaatcctctgactaatgaccagttaattctgcttattctctcttaactcaaggtatttgctgccttaagctactttttaaatacttagtggaaataagtcatctattttcattagtgtgtgtgttgtgtgtgtgttggttggattttcctggccaggagcctctgccttctgaccaaaatgacattgattcccagccttctgccttagcagttcatcccatctttaactggttcccctctatctcttttctctagcttatatgccttgctggctgtgaaaggaggacctactgggtggtctatgaatctataccccgtatttcttttttaaagatcttaatttttctccctatttttccttgtgggaaggcattaaaaatgggactcaaggtctatgtgacactatatgaggtgccatttcctatacaggtgcacctctgtaagcagcatacagttaagagggcaatgcaaagaagctttgggagtaagcattctctcatatataaagttgagttgagacagaagttactttatacaaatatagggtttcttgttccttctaataggtggatggtattcttcttcctcgagagaagctgattaagttggattctgtctattcctggcttcagacctaatcatgaccattaaaaatatctatcttttcctttgtccaagaatcccactctggtcttgcattgtaattggtggtgttgggggtgtgttgcgtgttttcaataagccttattttagggaaatagcaaaaatagcatatgtactttcaattaaattgttattgcttttgaacatattgacagcaaatatttgttatttgtcagtagtggcctatatgctgtataaaagggaatcaggcatgggttttatagctaaacaagcaaggtataaatcagcaaaggataactaatgacagtggtggggtaacattttccataggccgggtactgtgctaaggactacctgtgcgttatccagctgaatcctcagaaccatgtgagctaagtattatcatacccagagagactatgaagcttgctccatgtcacacagcgagtaaatggtagagcccaggatctaagttcaggtctgattccaaagcccttgtcctaaacactgtgcaaattgctcttacacaaatttagtactgagcatcagaagactcagtctttcccatggagcaaagcagcaggaaaaccccatgaagcgtcagttagaaaccagactgtgttgagtctgtttataaattataatagtatttcatgtgttattttaagagtatagttttcaagtctcttgattgcctcagaggaaaatatacctatagtcttcttcccaagttgtgatgattgtaatcaatgctttgggaaatgttttcattctatcctttttgctgaaaacagatttagaaaaccacaacaattcagtaagatggcatgattagcaaagccctgagtttggttgctatgtatccctttggtgatttggctttaagacatgtaattaaaagggagaggattattagcaaaataagttaggagcttgttcttttgccattggggagtgaatattttcttccccatctactctttcaccagaagtggaaatgatgctgggtatcttttgaggtatatctgtagttcagttttaggttctgtaaggtagcatttcattagttctgtacaataaaaccgtcatctcagtacaggtttccattacagaaccagtgaagtgagaataaaactgaggaaaagtggtctaaatattttagtcagtgccttgtcattgaatttgtaagtttctggagcatacagtacctttatatcttgatttcccccatgtatatggtgacatgctttgcatggtaggtattaagtaagaatttttttctcattactattaaccatatcattggagtcccaatcattttcaccaagccatcatttaaaagaatcacaaaaatattagagctgacacatttagatctctcagaagttccacattttttttaactaagatagacaaatacattattcagtttattggtagataaagcacatagtattttcagagcaatgtcagtatcttattggccttgatttaaatgactatatttttcttactaagatttttacacaaattctttgcaattaaataaaacttaggaaggactaaaataggtagaaatgatcaggtaccaaagtatatcctgatatagaaaattgtgatttagtgttctattgttagaaccaactgcctggagcctatggcatatactaatttattaacctgtatatgctcattctgaaggaaataataacaataacaacaattgcttctatttattgaatatttactatgtgtcagatactttaagtatcttacattgattgtctcatttaattctcataaaaattctatgagatagatattattttacctatgaacaaatgaagctcaaaggtacacaggatcaaaattggaatttgaacccagttttactgaacttcaaagctcataccctatattataaaagagaaatggccgggcatggtggctcatgcctgtaatcccagcactctgggaggccgaggtgggtggatcattttaggtcaggagttctagaccagcctggccagcatggtgaaaccccatctctactaaaaatacaaaattagccgggcatggtggcacaagcctgtagtcccagctacttgggaagctgaggcaggagaaatgcttgaacctgggaggcagaggttgcagtgagctgagatcacgctattgcactccagactgggcaacagagtgagatcctgtctcaaaaaaaaaaaaaagagcaatgaacacagttccttatttatactcatagagctgaacagttatttcaaggaggctacttgaccatttccagccactttaattgaagacatatcttaggtgattctcaccagtctatggaaagtagcaatacgaaagaatatgagagataagattagcaaatactgagtggaatcctgcaatatctgattattgctgcagagtgactggagactcacaagcccagtgggcacacagaacttaaaagattgtctttgctactcgagtaattcatttctttacctgaccttgccgtcccggtccctctcagccctcaattaagctgccattgatataggatttataatgtgtcactggtccattcaggatacagtgacagaggtgtggctgaaaagctggataataaaaaatggaggcaacttccatttctgttcaaatcagggtagcaacaaaaccatagctgacccttgtttcagaccagcacagtccagctagacaaatattccaagcactgaattgtgcactaaatgcctagtgcccctttcagaagggacattgcctctgagtgaccaagatgctcatagtttcttcccacgatgagaacatctaaaccttggaaaatgattgtggtattcattatgttataattttccagaaaagaatctgtatttattcttcctctaggcttctaaacaataaggtaggttttacaaatgagaattttttaggaatagtttcttgactataccaaatttgaaaatttgtgtggcattcgaccacatgaattaggtagtattagagtcctttccagggatcttaaatgttatgaactttattttgtataagtaggattatgctcatttgtgtcttaaatacacagtgagactttggacttttttttgttagaattttatgttagaatttaactatttaaaagaggagtgttatttctttagagtcaaactcattcattcctatatcacaaatttggaaataaaactctgacttttaacgataacaagcaaagaagccacaggcatccaaattttattttatttatttatttttatttatttatttatttatttatttgagacagagtttctctcttgttgcccaggctggagtgcaatggcacgatctaagctcactgcaacctcggcctgccgggttcaagcaattctcctgtctcagcctcctgagtagctaggactacaggcgcctgctactatgcccggctaatttttggtatttttagtagagacagggtttctccacattggcaaggctggtctcaaactcctgacctcaggcgattcgcccgcctcagcctcccaaagtgctgggattacaggcatgagccactgtgcctgtccccaaattttaaattattaattgtattcaacaccagtaatatcttaggttgtggttgcaattttattttattttgtttttaatttatttttatttatttatttatttttgagatggaatttcgctcttgttgtccaggctagagtgcaatggtgcaatctcggctcaccacaacctccgcctctcggattcaagcgattctcctgcctcagcctcccgagtagagtagctgggattacagacatgtgccaccatgcctgactaattttgtatttttagtagagactggccttctccatttggtcaggctggtctcaaactcctgaccttaggtgatccgcctgcctcagcctcccaaagtgctgggattacaggcatgagccactgtgcctggtggatataactttaaaaattaaagtctgataaaatgtgtacatgtgcatttaattgtggttagctgcctattatttaaccaatatgataacacccctcagtcccaacttactcagcatttagaatgaattgatagaggttttactctgaaaaaagtcagtctatttcctcagttttctgggttttgaataactgctaggccttgccagataattctggcctaaagataaagctggtgaaagtcagggctggggttttgctacctgtgtatttatcagtcttctcctaaaccatagtctgccttttgatagctctaataattaatttggtcttccctgtctttcttctcccttgccccctaccccttctccctgtctgttcacaggttatcttgacgaatcagattacaacccatctgagtggagccctggcttctcaggcagacctggtgtctccagctgatgatttgtccctgtctgaaggtaaggaatctgtcctggagaggctgaaacttgacactgacatagagccccactgcctctccacctcctgttgagagctgggagatatggctaataggccctggccagtgaacccagccggagcctgttgatttaggtttggccacctttcctggcatctgatctcttatattggggagtcttttgccctgcctctataagggagctccatttggaggccagtcactcctctgtgtgttatttcaagtccttagtatgagggctgatgaattgttaaatgactttgtttttgagactgatactcaaaggttggctttcccagtggtcccctagcaatttagccttttgcttgtgctgagttcttttggactaaaaagcgtacatcagtttcatgtgccagagatatgacattcctgatcagctttacagaagattaagaaaaaaatctccacgctggtaaatctgcaaaattttctccaccctcccctgctagcaaaggtcaggctggctatggtttcgatggcaataagctttacgtagctggggaaataacaccaataaaccagagggtggtttctagttttattgaaagtgcttacttgacatttctgagttgttatccttgtagtctagtatctttcatgcagaatgctgtgggtctgggtagacatgcatagctcttccaggcccctcctccctttccactttctgagaattgctcatgaaggaatacaggagacttttaggcctagcaaggctcctggatggctgcccaggtgatcttctgcagatcagctttgctttatggtcttagaaattgcaagaaccacacctctgcttcttagtggtggctttaggagggaaaactagtggctaatttatgaaaactgtacaatgctttgtgtacgctccttccaagttcagggatacatcatcataacccctatcagcgaggctgaaaacctgaatcatcgagcattcctccctcctgaaacttttgtcatcaagtctgcttagtacttctttccgcatgtatctttcctttgtcccctcttttttgtaatgtgtgttgtgatcagcagatttactaaactcccaattgaattattttaataacatccagattggccttcccagctctagcctctacagtttccattctgccactaccaaattgaacttccccgtctggccttgttctgctctgttgctctcctactcagaaatcttagaatagttttttttgtttgtttcttttttgttgtttgttttgtttttgtttttgttttttctgagaatgagctaaaatcagtaagctgattttaacatatttagggatttgggatttgttagcttgaaatcagccatggtgaaagtatttataccatggaaatcagcaaatgctgaaaatcaggtggcttgtttttttatttcctccctttgcgtagactggttttcaaaacaccactagataaagtgaatgatttcaacccttcataatctgtcatttcctttctattcaaatttagttcctgccgatatcttaggtgaagctcctatgccaagtgtgccactcttggcctgcccctccccactcccagctccaggcctgtgcagagacagctcacctagaacagtgcttccccctttcacttcttctgcttctcgtcccacatccactccttcgaggcttatttaaagactgcctctttcacagaacctgcttgcctatggtctcagtctctttttcctctgtggccgctctatctgctcaactgtataaagaaaaagtctagaaaattaatttaacttttcatgtttttctgcctaaattggcagattttaaagacacgaccatgtcatattctttttgtatccatgttgttatccagtgactagcaaagttctagacacatactaggcagtaaataaatgctgaatgaatatcacagtaaatacttcagaagaacagtgaccatgagaatcatataaagcacctatgaacattgttaaaaattgttataattattacacacacacatacacacatatacacacacacttaattcagctctgaggagaccagaatagagtaaactgcttccttatttgaaaatcagtaagtacttttatttgtgttgccttcctggtttatcttaagcaaagaagaagagcaaaacacatagaaaagaaattgcttcagggttgcagtataactgccacaagaaacccctgacttgtgttcatagcaaaggaagagttaccaggttatcctcccagaaatccaacaaagaatggaaataattgatttttctagattttttttttgtatagctgagcagataaagaggctatataaatatattcctatagtctataatgaaggtttttattagtggattaaaatgaacaatgtcttagaacatttatagccattcaaatatattacaatggatgttaagttcctgtgatttacacacacacagacatgcacacgcatgtataaattgctctgttttgcttcaagcattcattgtatcagctttgccattgtgttattaactgtggtgttaggcaggcccttttgatgactttgggtctcagtttcttctgttacatgacaggttggaagaatacaagattgctaaagtgttttccagctctagcatataagatcatgaggtaggtctgaaggtcaggagcattcacccactgatggggttttaattctgacttacagagtaggaagaatggccgtgttgctgatgttgccctagattaaacacaataaaaaggatctttaataaatcttagcactgatacttcggcatacctgcaggagcctttcctccctgtatgttttctctttgtcactctggggacacttctggtcttgtctgtctgtctcttgctctctctgcctctctccacacaaaggtgtacaaaatcagaagtgtgtgcaaaccagtgagaatgagaaacacactgggatggggtgactggtcaatttgcataagttccaaaagttccattctcccaatagtttgtgaatgggatagtttgtgaaaggcaggctgcaaattgacaagcacactgcaaatatgaggagatattttaagtaaatagagaaaattcagtttgccctctcattccttctcaaggcacaaagctcaggggcaggagcaatgccgggaaagtccttggcccttggggtgtacttctcccttctttggctctcccacctgggagctggataactcaacagtggaatgaaacctcaatgaagggaattataccatgatgtcaagcagtgaacatgagtctacttaatccaagccaacaactcagccacaaatttaataagggtggtggggcggggagacccagcaacacaaaaacaaagaactctcaactttacaaacactgggagggcaacagctggtcagccgagattaaaggagcgtgagagagcacctcccatctcctgacttctcctcccccatagacgtccctgcagccagccagggctcgctttttacagccctgtgcagatgaccttgttccagctaagataggagctcttttgatctcagcagggggatgctctgggcctgcagctggcagatattaatagtacaggatctgttggggtggaagagatctctcggttgggccaggtcacttgtattccctcctctgcatcagagcagaagggacttcatttccctgagtcagcccctgctgcgtactactcctcttaggtcaactcagatcattttatcgctggctgctcttggctgcttgttctcacctcacaactgttttcaagggagcactgtttaagcagtgtactgtgcactgcagctgaaatctattacaggacagggtagaccttgccccccgcccccaaatcccagtgtgtgtctcatactcactggtttgcacacacttctgattttgtatacctttgtgtggagacaggcagagagagcaagagacaagatctgaagtgtacacagagtgagaaagagacagcaatacaggaaggggagactgttgcaggtatgccagagtaccaatgctaagatttctgaaggtcctttttgttgtgtttagggcaacatcaacaacacagtcatttttcccactctgtaaatcagaattaaaccctatcattgggtgaatgtttctgatcttcaggccctccttatgatcttaactgttagagctggaaaagactgtagcaatcttctagtatccactctgtcattcaacagaagagatagggacagaaataaggattttttctacattgttctagactaggtactttgagtcacagtattttcttcttcagatttcatttcattgacagaagttcagacatataggttattatagagttccctgctcagttattgtgactgttgtgtggccaaggacacatttcttagcccttgccaattcttccttatggtcattggagatactaagaactgttggacctcagtcataggtaacatctctttcccccagagtgattaatagagaagggatctaacagtccaaatggcctaagatgccatatcctattccaaagtcacctgggatttgagcagaaccagatgagtgcccacctacagttggtaggtgagatttgacaaatggtaacagtgagccctgtgcaagattgaagctatagaccattggcttgctttcttctgacgatttaacagagtagcagttacttcattatggtgacatggcccacttcaggagttccacatggctttatggaaaagaagacattattaggctgccatcttggtattcccagcatctggcatgttgtatcctgttttctgcattacttgttttccgatagaccatagcacatgaaaactaaaaatgtaaaatgtgtggataggtcaaggaaagaacacaagagaaatagcagcacttcctagaaccaagagtggtttctagttttattgttggaaggctttctattctggttggagtcaggggaattgatggctgatttcatgtgcaagagaaagtatttggggattcatattccctaccaaaccatccctgcgaaaagctggagtccatttgaaagattatatgcaagtttgtggcttgtgttctcttttaaaataagttcaacaagcaagacagctcagaatggttgggacaaatcagagactcatggttgtgaaagaagcaaacttcaaagcgcggtatgaattttcaagtcttatttccactcttgctttccagctggatctgctctggatttactgcaggatgtttgaaaatgtggctccctgctaatctcagacagttgctatgatcaatggtttctttcatttccgataaaaaacactggtgtttctacttaaattgtgtgtattttcagctttattattatagttatgatttattgtcctgcattacccaaatttgtaatccattaaccacagactttggggtgggttggtcaagttagcagaaatctctacatgctttagctccaaggcccttcacagcccaatctcagactaaatgttcattggtttgtgtagggccatgtaccaacgggtatgagtggagtagttttaaaaatccactccttgggggtatggtgcaagttggctgtaattagtactttgaaagcctaaggtgtcaccatgtgactacaaagttaatattaacaactatgatcaacattattaacattagcttttccatagtatttttaattgtcttaaaatgatgaatttcttaatctacctcaagcaactgaagcatgaaggagagaagagaattgctgaaaggccacacagtgagagctggtgtgctgggaacagaagtcagagcccctcccgtgaagttttaaatttggttactgctgcctcttaggagtgagttttggataaaaatgtttaagtgtcctggtgacctttcagtttttgtttccaaagccatagactatatcaacacacacgattttacatggttctattcacaagggcacacgccggccagtgctctacttccctggtattcaggagtccatagcacttgactgggcatatgtcttccagcagctgttcagatgccatgaaaggcctgatttatagaaaaagattaaaagcaccaaaaaatgtgtggtattcggctaaagaaagcttaaatattatgtgagtaggggaggctagagttgagaggagatgggcacagcctgcaaatgtcagaaaagctgtaaatcccaaaagggagaggaatgtgttgaggattttcagcctggaggccagggggcaatgtaacctcagctgggagaacaaaaggagaaagggaacattaaagtcaaccaccaggaagtgcttcttggtcaggagctctgttttgctggtgctagtttgtcaaaaggaggcacatttgaagcacaagatgcattacaatcaagttagatgagagccagagaggtttctttggggagcagtccttgaggtagtttgtgtgggagttgggctagctttaaaagtagtttcccctcaccctcaaatctttttaccgtctagaatttactgtctaatttctcaaatctgcactgtttctgttaaggtctcaatgtcaagaaagctggagggacaaaaacaccaaggcatctttgtcagttgcctcagctagagaggtgacgacagggccaaaagccgagagaatgggatgccaagaggtggtgtgatcccagaggccttcaagttagaaggactctctgagaagagatccttgttttccatcactgcagagaatgctataccaagggcgagaggcctctaggtcagagatcataaagaagaaaagaatggctggattttaggggtggtgcccaacgattagtttgtgttgtaatgtggcatgaagcgtcttcagaatgcatttgcgatgtttactgggatttggaaaaggatcgtaacaaggtctagcaaggcagtctagcccaaggagggtccagttgagttccgaactagtttctgatatctatcccttccaaaactgcatgtttaattaaagaacagccctcctctatcttccccagatagaggagggctgttcttcagtcgaagatatggagtggttgtgtttctctaccaaaacctttattccattttctcaaattttagcatacatcagaatcacctggggggcacattaatacacacattatggaccatatactgtatgcctggcatcgtatgtttattatctcatttagtcctcacaaccaccctctgaggatagtgcagttggccctccttatccatgagttctgcatccatagattcaaccaaccatgaatcaaaaaatagtaggggaaaaatggatgattgcatctgtactgaacacagacctttttccttgtcattattccctaaacagtacagtataacaactatctacatagcatttacactgtattaggtattataaataatctagagattatttaaagtatccaggaggatgtgtgtaggttacatgcaaatacagtgccattttatataaaggacttgagcatccatggattttggtgtctgcagcgggccctggaattattcccctgcagatactgagggacaactgtattaattatcccattttgtagatgaaggaactggggcttagaaggctacacaattagtggcagagtcaggatttccacctagggagactggctccagaggtacatttttatccactaagctcttttgtaaggatacaattgagattatcatgactatgtataaataggaactaaaagacagccagatcacatgggtattgggaaggttgaaacttaggttattctcttcatttatctcatctctgtcttgcctttccatgacactgacacttgactttatgatctaattgacccattttatctttcacacctagtaattgtgttcatgggttgccttttcatccattcagccataacagtaaagaagatggccagtacacctatcctttcagcagggtccattgatggggggcattttcttataaggggctatatatgaaggacagattccttttgaagggaggtaaatacccaaacataacatctaatagaaggactttgtccagctgagcagatattataagtttgttaagtaggactgtgtagctctgttgacccctttagtcattttcattctcagcatcttctccttcttccatttattatttatttatttatttagagacagggtctcactccattgccctcactgtagccttggcctcccaggctccagtgatcctcccacctcagcctcccaagtagctggtactacaggcatgcaccaccatgcctggctaattttttcagttttgttttgtagagacagggtcttgctatcctgcccaggctggtctcaaactcctggcttcaagcaatcctcctgcctctacctcccaacatgctgggattacaggtgtaagccaccacgcccagcgctctcctttcaaataaaaattttgatagaagttacctatcactagtccatgccatcaagccaatatactgttttaaaaatgaaatgtaaaaatattttcttttagccccaggtaacctggctcctccttgatctaattttctttataccaataatcagcctttgaatttgtcttcaggaggggagagacgtctcttctgtttatccagaatccactcgctactctaaactattattatctggtgagatatgaggcctaaatttaaccatgtataagttacctcatattcagggacatataacagaggcacattagctagcgcaggctgtccccatggtcagccatgatctatccactgcttgagcaagggaagccagagaagacaagagggcagctggataactaaaatatgtgcagtggagaactctgtgtctgttagttacatccttttcatgatttacggtatacaagagcaaaattactctctaccctcaggggagtgtctgagttttgtgggttaaaagcaaatgtatatgtgtatatgtgcagtgtatgtgtgtgtgttgaaggtggaggttcccgtctttaatagaaggcctttttaggttatgatgttgattttttttaaccatacttccatctaataggctcatcaaagcagctaaggtaatcacatttcctggcactgtcatctccagctatagaggatgaaagaaatccagtggacaggtttaaggagacaaatgtttttttgttttaaaatatgatgtttaggtaaatgaagctagaaaagcctcaaaataaattccttctgagtaggactctaggccagagatagaataagcaattgaaatctttcaatgtagaccccagaaaacaaacaacagtcgataagtggctgccagagaccaaggggtggatccaaggccagccaggaagaagtttcttcctccttcagggacaaaactagaactgagggaaacagctcttgccctttgactggatactacaaaactaaggtaaaccagcagaaagtcctgtcttagggtcattagaatgtgaggttttttttttgtttgtgtgttttttttttttttttttttttgagacatacttttactccatcgcccaggctggagtgcagtggcatgatctccactcactgcaacctccacctcccacactcaagcaattcccatgcctcagcctcctgagtagctgggattacaggcatgcaccaccacgcctggctaatttttttgtatttttagtggagatggggttttgccatgttagccaggctagtcaaactcctgacctcaagtgatccacctgccttggcctcccaaattggtgggattacaggagtgaaccactgcgcttggccagaatgtaagttcttgtgggcaggaatttttgtcacttttgttcagtgctggatctccacatcttagaaaagtgcttgacaataatagttaataaataattgatgttaataaatactgtatgatgaatggcaataggcaattcagggaaccatgtgagaaaggaaagaacagaagtggaacagctcagcttttgaaggagaaatctcccaccttcacacaagggtggtgactgagtagcttagtgtgatacactataatgatatttattagccacctaccatctgctaggtcatgtgttagacaggtgcttgggacacatagacaaatgctacagtccctgctctatgggaagctcacaatcaggggaggggaagggctgtggctatgacggacaagtaagcaggttacatttggtgtcatgatggcattaggtttgggatgtttttggggaacagataggagtcctggcttggggatggaggctctctaggaactttacaacaaggaggcatgtgaagaattaacagcagttcttaataggagagagagaaggggaaagtgcacctgacagagggaaaagcccccgtcatggaatccaggcaggggccggattgccgagaccagctcggttggggagaccctaacccagtggcgctagaggaattaaagactcacacagaaatatagaggtgtgaagtaggaaatcaggggtctcacagcctgcagagatgagagccccaaacagagatttatccacatatttattaacagcaagccagtcattagcattgtttctatagatattaaattaactaaaagtatcccttatgggaaacgaagggatgggccaaattaaaggaataggttgggctagttaactgcagcaggagcatatccttaaggcacagatcactcatgctattgtttgtggcttaagaatgcctttaagcagttttccaccctgggcaggccaggtgttcttgccctcattcccataaacccacaaccttccagcgtgggcattatggccatcatgaacatgtcacagtgctgcagagattttatttatggccagttttggggccagtttatggcaagattttggggggcttgctcccaacagaaaggtcttattcctcatgctgatcagtttgaattttttcctgagggtaatagggagccattgaaatagggaagtataaagaaaatgtggcacatacacactgtggaataccatgcagccataaaaaaggatgagctcatgtcctttgcagggacatggatgaagctggaaaccatcattctcagcaaactaatccaagaacagaaaaccaaacaccgcatgttctcactcataagtgggagctgaacaatgagaacacatggacacggggagagaaacatcacacaccaggttgggggctaggggaggtatagcattaggagaaatacctaatgtagatgacaggttgacgggtgcagcaaaccaccatggcacatgtatacccatgcaacaaacctgcacgttctgcacatgtatcccagaatataaagtataataaaaaaaaaaaaaaaaaaagaaaagaaaaagaaatacggaagtgacggagtcattttgtagttggaagcattttctcaggcagccatttacaggttagggggatggagatgaaactatagaacttggattttgatctctttgaggcaagtcactttggggtggggttagccctaaacttcttaaagcaatgagaactttagaataagttttaacctttctgagatgttgggtggccaggtctggttctagcttcctaccttaccaacccaggagagatttctttggtataccagccttctgaataacatcaggcgagccctccatttatcaaggcgcctaacagttagaaatggtgtcaggctatctataactctgctaggatgtgagagaaaatagcaaatgacttaaagtactaaatggaactatgagggctctgtgtggtggctcatacctataatcccagcactttgggaggctgaggtgggcagatcacttgaggccaggagttcaagaccagcctggacaacatggcgaaacaccatctctatgaaaaatacaaaaattagctggatgtgatggtgcatgcctgtaatcccagctacccaggaggctgaggcacaagaatcacttgagcctgtgaggcggaggttgcagtgagcagagatggcgccactgcactccagcctgggcgagagagcaagactctgtctcaaaaaaaaaaaaaggcactatggaaattaatacaagtgttatgttccttttgctaatgattgcaataataatattgagtgcctattatgcgtcaggcactatactaagcacataaaaatgcaacaacttagtggggttcaattatcaccctcaatttagaaacaaagaaactgaagtacgaagtatttccataacttgctgatgatcgcataactagtaattagttggcattcaaacctagagtcttgctctagagtctgtgctcttgaccagtataccatactcagctcttcaagatgatcatacaactacctcagctagagcttatgatcacatatttctgtcattgttagatttgagaggtttccatgcatcactataagtgcagctgtttctttatgtgtgccctgaaatctctatgctgatagtcagtagaaaagcagtgtgttttaacagaagctgaagcactgcatttagaattgggagacttgtattcaaggaccagctttgccacaaaccatctgtactattttgagcaaggcacttaacttccctggacctcaattccctcagctatacacataagagcttgcattaggtgaagctggcaggcctttcagtttgcttcttctgtcacattctgtcttcggtgagcaaattggtatgttcaagcctcagacaggcttctctgttcacctcttgaagaaggctggaccaacccatctatgagcattttgtcacatttcttttgtcactgttattatattggatatctagagcagcaatcttttgaatctataacccatcattttttagcatattgccccaaagtatggaaaattgctgccaaaaactatagtgctactatataaagttatataaaacacaccagaaatagaatttttaaaatatgaagtgggttctagtattttttccctacatcccgttgagtcattgtgatgtattcccaccacttggtatagttcaaatttctcccttccttgtttttactgcagaactctttactgtcccaagtagagtgagactgaaaccaaaatttgagcactgggtccattcattcaattgttcattcatttacacgttaagtatgaagcatctataatgtgaaatgcttgctgaattttcaggaggccataagaacggtatcaggcttggcctctcccctctcaaacataaaggctaattctagtgtttttcagttttatctggttggaaccctagaattcctgcatactgtaatgaagctaaactttacatctaaactggctatatgtattgcactacagtgcataagacaagaaaagttacaaaaagaaggaaaatccagaacgtgaggcccacagacatgaaacagttgaagtcacactgtagtacagcatctaatgaattgccaggatgagagaagcagatttttaatatcagaggcattcacagaaaggagagatcatcatgatctttgtgatggaggcttggaccactgccttaggatgtcagggcagaactaagatgggccccttggttggtctgtcctgactcactgtgtctgcagtgcctggatatcagccagcagaccacctccatcattgagttagacccacttacaaggtggcaggctattaaccagtcccctgttccactgagaacttgccaggctggccatcatagcatggtataggttgaagtagcttagtacctgtggtggatgactgtttttctcggccagctgtttaatgagcaccaaatgaagtaaaatgctgcttggttcctctcctctcttcagacacaaacaatcgagcacatcctagtggaagggccgtgttggggaactggctttcttgtgctgatcatcttggttcccacatccgtccctcccctctgggctagagtttggaggagctattgaagaaccttgagaaaactgttaaccttgaaagtttagttattcatcatcaaatatattaacaaacgtttgtagccaaagctttactgtctatggcagttttaaataattatcaaaatcatgatttaattaatttctctctccattttgggttggcttagaggagtaggagattgcaattcacaagtactttctggtcctgtaaccaacttgcactttcaagttcaggtaatcaccttgtccttttcagtttatttacccatgacttaggttaaagttgcccatgcctctggtgaaattcacaaatgaaacttcacctagctgggtttcatatttgtaagaaatcattttttttctccatgagaatgtgcaggtcagctgagacaagcatgattaattctagacatgaattagaacaagcccaagctgaacagctctctcagaggaagtcatctgaaattggtatgtgtgacccagtatatcttttgaccaatttgcattggaaaccacagtgagcatggaagaaatataaccttgatcctctggcctaataaacattcttgcaattctaaatgtacctagagtttgtgacaagtgtgtattggaaaactcgttgaaaacacatgagttagtaatgttctctttcagaagatgaacttgcatggccgaagtgagattccagtgggaaagacctggtagagaaagagtgggagaatgcgttgacctctggagggcagattatggcatgccaggcaatgggttgtgccatcagggaaggaatctagaaagacgaggagactcaggagaaaggagatgacttctgttgacaggtcattgttgctcagacttagtgcagatgagaaaggaaatccagaaacctacatgacagctcctcttggattggatgaaaatattgattttttttttttttccctatctggaatttgacagggtcagttcatgtctgggttttcagcacttaatacagggcgcttttgtcttgggaggcggctggactggtttttcctccaggcaggtgcacagagggcgtttattgtagcctgaaacacaaacaccaagcccctaggccctgatccacacactctccagtgtggctcaaggaaataaagtgaacaatgtctcttgcaacaggcgagcactgtaaatgccactcctgaatgatatatttcttaaaactttgtatccgtaacctgatcatctcttaaaacttaattatatgtcagagaaaaggaagctattggctcctccagctgtccaggttgaacgagagcacacaatggagcatatccgattcacagccttacttaggtaatcagattaatatctcctgaattgaatttacccttttgatatggagtctttcagctgccttgtttcacatctcaaattctgacaaagctgtgcggcctttgagtaatttccctgaaatctatatgtgggaagcctgtacttcaagcagtttttgggacttgcaccaattaaatctgtctctggcacacttttaatggcatgctttcccctgagtcaacaactgctccaaaatctgaagtcatttgtttaatttaaaagcaaaggttatggaacaaccatttcaagcttcaccagccaaactccagtggctttgaaaagggagatgaggcagaggaaaggctaataaactggatttcttatacacaaaataaattaattactgtgtttctgtaagctagtatcaaatcaagtttgttcacaccctccttgccaacctagctctccctttctcttcaaactcaccctctctgggctttcatattcacgattgaggctcaccctcttactgttgttcttgcaacacaaacatctggactggatttttgtcagctggagttgagagagaactgtaaatgatgcagtgatttttttttcgtccttattaaatttatttatagccagtctgaagccaggaaacatgctagagcctttgattggaggttctcgaggaatgtacggtggatggtattttctcctgttgttttctaaataatatcaaggatagaattacataactcccaacttgagtattttttgccctgaaggaccctttattaggacattttgcacatcagaattcttccattatatttgcttatccaatatgccttcttttctgtcagtgagagaaaaggaaatgtacatgacaggttatttctgaaaaattagaaagatggagagtgagtttctggttgtttgggacatgaaccagtggcatgagtattttcttttgccaaagggacacaacatggatcctatttctacctcttaacaacctctgcaatcttaaagctgccaaatctcaaagaatttcattcatttagtcattatttaagataataaaaggccctacaagcagcttacgaaaataatttataaaatatttttctctgcccttagaccttgttaaataacaatgccttggtgtttataaaattatttaagaaacaaaactttctagaggaggctgaatcagatgatgatttcttgaggtcccttcccagttctatgatttgagatgattctttaattttccttcactgtcatttatatctgtgtcattaaaaaaaaaaaaaaaaaaagggctgtttgggaatgagatttgctacacccgtaggcattttcttcttcagaaaagagactgtttagctttctgccacccaagtcagtcatcctcagcctgaacaatggagcttaatgttctccatcttcctaagagttagtgtctgttgttatgaaagtgaattgaaaccaaatgtactttctattggaaaagctgcccttgctctcagctcatggacaaaactgagagagaaggctcttacaaaacagagggaaaaatcctcgctgtcatgtcataacaccagttatttcactgttagacctatgaacatatctttgatgcaacactacactatttgatgatgtttctgtgtcacttaagatgggcgtttcatatttatctcttagaaatgttagcagatttttttcacgagttatcttgcttatggactggaaaagctattcttacagtaagacccttcattaactgagaaggcataaaagatagctcatgttctccaccaagaaaggaagctctgtttctctctgtctgatgggaagcatttgagacagagcagcttcatgaagtgtggatgtctgttacccacttcccagtttttaaagtaaaagccaagtcaatggcactggtacttgtagtgaaatgagccacagaggcatcattactcatcaccatcacgactcaaggatcagcaaatgagagtcctgaaggtaaagaatgtttattttcaggtagagaagaaagaaaaatcacggagaggtagagaaaagtgaagggcaaaggaagaatccagcagacattaagcaacactgtatcttccaagatcataaagccaaatagttcctgctagatttaacttttattattttgggagatgaaaatcactggggcatggagttctcattctgcatttaggaacttccataatattttaataataacaataatgataataatgccaatcactttaattaaatctccctaaataagcatcttttaatgcagtgttgtttgctgtaaaacatcccaactaatggtagaggctggatgtctgccaaagacatggtgagggaaccgccacagagccgctggtattggaccctggcagagctggttcctctagccaaaggaagtgaataatcatggggaagtggttattccagctgtgacactcaggaaatttcagtagaatgtgatggccttatatatggaatattcttagacatactaggatggcacatgtaaattatcatgggaaacataatttgaggaatacagaagattataaggtattatttgattcaggtttttttatgttagtttggagccattgtcaggcatggaaatactttcattgatattcctgtcttctataattcaaggccttaataataaactggttttgaatcaatcagttgtctgatagacggctcctgggaagactggagagccttatgagggtgcccacctctctcctgtgtaaaaggcccttcactctggcagcttcactcttgggtggtgttgggtagaagtaagatcagataccctgctcactgtaggatggaagggatcacatcaaagctctgagggctgttttccccttaggcatccaaacctgatttcctcttatcacctgatatgaattttcgactgtttcactttttccttctctgtgcttgtgttttttacaaaaccatgaagcctgtaaaccacacggtagatatgatcacaacaatattagtggagaaccccatgctgttgtcagtatcaccatcataggtatgagtgcttgatgcagggtgtgagggggaagggggcagtctttttaaaaagcaggtcacggctggacgtggtggctcacgcctgtaatcccagcactttgggaggccgaggtgggcagatcactttaggtcaggagttcaagaccagcctgaccaacatggtgaaacccgtctctattaaaaatacaaaaattagctgggtgtggtggtgcacatctgtaatcccggctactcgggaggctgaggcaggagaatcacttgaacctgggaggcagaggtttcagtaagcagagatcacgccactgcactctagcctgggccacagagcaagactccatctcaaaaaattaattaattaattaaaaattaagaagcagattacctttgaacctgtttagatagtggtcttccatccatcacctcttaactcctcatctcccattttcccaaccccacacacctcatctttgcatggatgaagtgcagtctctccagaacgtttttgtgagtggagggatgcagagtagattgtcggtgccatgtctacgttgttaactgcagtccaacatgtaatctagttaaaaaaagaaagaaaagaaaaacccataaaataaattttaatagactacccctaggcaactttgaagaggaaatcattgcaagaaaatgagacttactaaataggccatttgagaagcaggcaatggctattttaaaggcttgaggttttaatatatgtatatgccttttttccctcatctcttgcaaataaataatggtttacatcaggagacaattcaggaaaaaagccttttaaaaaattttcaggaaatctggccaccgtgtttctgcagccactgataaatgacaatgccaccagcagtgacctaggacatcctgaattcttgctcttctgaagagcttgcattctcttttcaaagggtatcctgttcctattgcaatctttaagctatctcagctcaagatcaccttttttccttttattatcatacttaaaacagcactagtgctgttaagaagactccacccatagatgttgatgtcatttgtgaggaggacaagatttaaagagaaggtaactgggccaggtgtggtggcttaagcctgtaatcccagcactttgggaggccgaggcgggtggatcactaggtcagaagttcaagaccagcctggccaacatggtgaaaccctgtctctactaaaaatacaaaaattagctgggcatggtggcatgtgcctgtaatcccagctactcgggaggctgaggcaggagaattgcttgaactgggacctgggaggtggaggttgcagtgagccaagatcgtgccactgcactccagcctgggctgcagagcaagactccctctcaaaaataaataaataaataaatagaaggtaactggatattggccccaaacatattctaattcagcaaacagacccattgaaactcagcattgttatttcaattcatgttgtacaaatcaactaaatacaattttgtctattttcagggataactgagtgttcttcatccacaaaggcccaagtccgtataggacagtagcacaacggggaagaaatgtgtgtttttttttgttttgttttgttttttagtgctgatgaaaggtgttatatccaagggtaagttataaacagagaagctgtttctgattgtgaagattggctcagcctgcactgacacttctgaaaaggtggaaagagcaaaatcgcagttccctagagtctctcagttgtgtgatatccatgcatgttcggagcagaatgtataacggatccaccgttctgcttctctgctgtcttctagtttaaaacatgttgcaggctaaaatgcagagggagaagattctattggtttactcatccagttattaagacaaggatgggatgaaggatcagtcttcacagacctgcaaattccctccagtattgaccctgttgttgcctgagggcagctgggtcaacaggtataacctccctttttttccctgaacaaaggtagctggactttcaaggaaaaaaaaataatccagccctggtaatcacacaaacagttctcaaagctcaattaaactaaaatgccttgtttcagtttctttccacagtttatagattttaccagcataattatcaaactttaaatgtttctctcttccattgtcttgttctgtttggttcacctggtgatgtttgttatagcctttctatttgaggaattagtggaagataaaatgttgctaagagcaatttcgttagtattgaaaatagcaggaaagaaatagagggagcagccattgttagcaaagtagcctggttatgtgtattaagcttgggaaagaattaaggccatttggtctattgatgcaaaataccttcgttttactaaccacagaaaaagcccttggttgggttgtcttgagtagttagaactgggggtggccaagatgactggttgctgatttccagcactgtgcatcaaccaccaaatgattttaactttcaaagtttatggggaaagggtacgatatgaattttgaggtttttgctgcttcttatgcaaaacattatttcggtttcaagcagctgatcacaattgcaactgcttatacctggtgaattataatattctctatgggaactgcactgcatgtctgtgggggccgtcccatctgcctcctttgtgaatctcttctcctttcagtgcctcctaacttgggccccaaagaggggtacagcagctgaatgtcattctcttgggctgtggcccaggcatgcatctttctggaaggatgactgaatcccattcttaaatctgaagttcctcttgattagcggctccttttgtttgttgtttttaacggcatttctgtctttcatgggtagcttacagggatgtgttttagagccccttccagctgggaagccgcccaactcccaccagctgagtcgggggatggcttccctttagttccgctgctgtctgtggactacaaggactccacttccagccccagcaacagtggcccttgtctgctgtgcaaacttggctctcttctctgggttttcattctccagccatctgggcattttgggcacccctcttatcttagtaccttggcactcaggaccacatgtcatcctatcatagagatgcaaacaaaggaatccttcacctctagcttgcagttcccctggaaccatcatagattgagtgacaatcagggagatgggggcttgggcattggtcttgagtgatataaatggtttttctaatagaaggcatttggaatgggctgacaatagctaggattgttcactaccaggattcttagtgcctagcttcctcctttttctctggctatcttgaaatctaggaggaaggagctaaagaccccgtggcctctgattgccatagcctctctaggcctggaagcttcagcttagggactagaatactgctgtgtgccagagcagttcatctagcttcctattaagaattctatgtgcattacccacttttaaaattcctcctcctacttcctcaacttctggcttggggagggtttgatcagagtcattctctcttcagagaagcatctggaaagattgatccaagagtgctgatagcaagttcgctatcatcgccctgcctcgaggaaaataagcattcgataaaaggacacttccactgcccagttcactcctactccactgtgtcttctcctgtccctccccctacccctctgacccctgcactcattctgatccctcttcctgcccgaatgtctctcagtggtcaacaaggcatgagctagccaaagaaaatgcaaccaaatagtgttaatcacttccatttagacctcagtagtcaggtggggctgcaggtctttgaaaggcagacttaaaatgcttgcctcttttcagcgaatctgattttacatttggctgctgatcattcagcccctggcatttgttcatacattggaagcccaaagcttccacacagttgagtctacagagcagagtaatattaacaagacttatcttggttatgatgccaaaaccatggtgccacttcatttcacaccaaagtggatggatcttatttatttattttttaagagttgaggcagcacagagaagctcagagattcattcaggatcatccactgtgtccaagctttgatcctctggcccttatgacaggcaatgatggttcagagtacagacagagctcctgtagagcgtgcgaccaatttaactggaaccatgggttcttaattacgacttcccctccccacccactgccaccaccatccagttgccagaacccagttggttttctgtgaaacggcagctagtgacactttgcatgggttcaccagaaggcctttcagtctttgtctcattttaattgtgtatctcaaccaagaagatcaactctccacatgtaaagttaactccctttagttttcaaagtttctttccaagaaccacctattgtcagtccctcatcctgtgtctggcaaacttagaagaaacaatgaagttcacagtacagactgagctcccgaagcactgatcttttatgtatctaaatgagggaagaaggaatgcatattctctggcacaagctggctctaccatgtgatttgaagtaaatggccattttatttcacattaggaggagagacttggagcagtttggcagcagatctgtagcgggttattaatctaagaactatagttttcttccacataggagattaaatacccatctttcgtcagatcaaagcaggcctcttggactatctgatctttgcaaaaggccccatgttgggccagcacaacagtctttgcatgtattgctccctatgttaaaaacaacaacatcatcatcattttagtatgtgtaaataataaggtctgccagcattagcagctctctaggcccaaagtaaaactttaggttttttttctttttttctttttttgagacagagtctcactctatcacccaggctggagtgcagtggcgtgatctctgctcactgcaagctccacctcccgggttcacaccattctcctgcctcagcctcccgagtagctgggactacaggtgcccgccaccacgcccggctaatttttttgtatttttagtagagacagggtttcaccatgttagccaggatagtctccatctcctgacctcatgatctgcccgccttggcctcccaaagtgctgggattacaggcgtgaaccactgcacccagcccctaaaactttagttttacttgaactgactttatattaattttctactactagaacaagtcactgccccccagagtttgaagaaatgtgaatattaactagggcttatctgaatgagaacaacagcattgctcttttcgtagtgttgtaataaatatcatcttagacttatacggcattttctttagggcattaatagagtttatataacctattgttcatttacttgatagctcattgagacagtttaggtattgatgctatattcaccatctataaaatgggaagaataaaaatattaagttcaacttaaatgggttacaagaaagaatacagacatttgtatgatctatgtctccaagatactgcctagagcttttaaactttgtaagttctgcatttcacctacccaagggagtctgagagtgtgtaatttgggccagggcacaacagcccttggccaggttgaagtggacaaacaaatggaattggttccagtttaccaacctggcacgaattatgtgctggtcaaggaagtgtttttcaaatcatggggagccactagtgaaaatctactggtgctttgatggtggcctttggagatacttttataatttgaaaccattcccatggcaggccagggagaggtcttactttagccaacatgcaacattaggtagaagaaatggggcctttctgactggtttgacctgtgggtgggccctcttccacatgtttctaattaggatgcaagaaagagtagatattctgtggcgactctcctttccttctcggctgtgagacagaacaacagcgcctttgtgatgacctttacagggctgtttacatttggtgacctgcctgaacactcccgccagagtggacgcacctcttggctaatgaggaacagccatgctgtcttttactatggtagaccttggaggttaaaatgaaaaataagaggatcctctgttgatgactagtcgaagttaattttctttacagatttattgaggtataatttacatactataaaattcacccattgtaagtatacaattcaatgatttttagtataataaatttataaagtcttgtcatcatataatccagtcttagaacttcgttggagttattttgaaaacaccaaataatgatcataattggaatgtagatcatgctgaagtgaaacagaaatttatgaggctatcttgggttaaggaagagggccacccaggaaactatttgagacaattaagtctcaagcttctcaaaatacatgaaaccttgagattagcacttatatttcagaacattttccatatttttgcttaccaaatggtatgacctacttgaaaaaaaatgagaagctgctgcagaacctgcctcaggtgtcagcatcaattaatgtttcatggttataatgagaaggagcagaagatgagagtctaagctccccttaaagggcttatagttcactttgaacatatttatttacgtgccctctcattttcaagtactgtgttaggtactgcagacacatggatagtgagacaatgtctctacccttaagaactagtagtccagtggtttctgttaaatttcagtatgatgtcataaattctgtggtaaagtgccgtgtgatgtcaggaaggtcatcagtaaagactttctagagttgatgttactaagaaatcaatgacatggttaataagctcactagtcctgctgacactgagtccctaccctcggctccatttggatgaggctctgtgagatccagtccctgccttgggggctttgtcattcatgagagaaacaagtccatcactccttccagttagatatctgtgaaaaggtggaaaaagcaaagaacacttggaatttgggagagaaagagagaccatttaagggaagaattgcatttgagttgaattttgaaaaaattgagataggcttttgcccggcatgggtaaaagtgggaaacagtccagaagaaagatgtgagcaaaggctcagggacaggagaacttgggatgtgttctgagaacagtgagtaatccaaaatggattgatacatatatcacatagtatagctatttctatatacttatgtcagaaacaagggaattaagggaatcacaaggctctgctttgcctgtatcaaggaaggcttcctagagaagccattaatttcactctgtctgttatgcatgctttacaccaaggtgatgtgattagttttcttctttggtttcttctttctgaattcatcaggtggtcacacccactgggccacagaaagcaccagtggattttcactagtgattcctgtgattaaaaaacgtttttgaccagcacgtaatttgtgccagatttgtaagctagagtgaattctatttttgtccagttcaacctggccataggctgctgtaacctggcccaagagcttaatgtaatactttcaagaagattaaaaatccaacaatcccttgaaacattggttgctaacctttgaaagagtagtcactgcacctgagtagccttaggaaatgaataggaggtctgagaaaaagaaaaaaaagaagagtggtaccatttgcttaaaatccctagggccttatagggtaaacctatttctaaatttaagttgctaagaccttgaacctggggttgtttggggatattttggaaagtaaggaatattattgactttccatcaggaaggaaagaactcagttgtttttgatattactaagaaagagagagttttgcatttatttgtttgcatggacggtctacctaccgtgtggccttgttcatgacatggcggacctccctctctggggtcagtgtgaatagccaggctgcagctgtagctagagacaatggccagcactgttgggccttgccccttaagccccgaaggttaatttcctagtatttagtggcattgaacccgccaaagaaaatgctgtttcatctgggggaagataatttctgcatgtgtatttttttcatgaagaataaagaagagatatttttggaagaacataacttaacctgttggccttggctaggaaagctaaaaaagcaaggggtcagtactcttacaagtatcatgtcttaaacgtcagccaaccagtaattatttagatgccatcagaggggaagtcccatcccattgttattttttctctagactgtgagatgctttaaaaaaacctctctgtagggaaatgatctttaaaaaacaaacaaacaaaaagcctgagaatttagtgctgcatttgttgagaagtaagggccctggaaacggaggagtttttgttgttgttgttttggtgactgctttgccactctgcatgttacaaagggcaaattcttggccactgtttagggttcccaaaaaattccaagatgtccagttaaattagaattttagataaacaacaatttttgtatgagtacatctaaaatattgtactgggacctactcatacttcaaaattattcattgtttacctgaaatttaaatttaactgagccttgtatttctttttgccaaatctgcagtgctttgttacttcaataaaaaaactgtccaaggagcctgggagcttttatgattattgaaaatcactgtcaattttaaacctaaacaaaacaatagataaagctttgaaaatagaatcaagtccagtcataccaagtgaaaggagtcctttctcatttttttatcttcttgtagccagctctggagatccaattctattgggaatggctcacctaggtctactgtagctcagagttataccttgtagatcacctggatgcttctgtgttccagctttaactcagaggatcaggtcagaatggaggctccctttgaaatctaaagtgcttagcttctttagggtagctccacaccctttttaattcttctgtaaaatgtctatctagcctagagaagtggagtctcactagacatggttctgagaataatagctatcatttactgagtgcctaatatgtgccagtgccttacctgcattacctgcctgagttcatactgccttctaacaaccctatgagacagatactgttatctccattttacagatgaggaaataaagacccagagaggtttagtaactttctgcaggtcacagagccattgaaaggcagaagtgggataagcattcaaatcaatctgactccaaaaccccttcagtaaccattgtactactgcatgtgatgcccttagattctccacttttcctctccctccccaagcccccagtttggcttgatattggaatcatccctttctctccttgttctttactggctggaattaatagagtactttcggtctgaaactggccttaaagaatctttgtccgtgtgtatcacactgcaatgcaatagacgcagaaatctgggcactagaagatgttaactttggatgcctcctgttttatatgcatatgattaaaccaatggggaaagaaagccctgaaactttattacaacatttttgtagtattaaatttgacatattaaaatgtgttatcattttaatatctttaaagagcctgaggagactctcaagccttagactgtaaatagctaacagctttgagatgagcttacataggagtcaaatgattgttccaagatggctgttctaattctgcagagctaccgtagtattcagcctactgcctgccaaaggcaaggggccttgcccctctcttcctcctccctgctttcctctttgttaagaagtaacaaaaatatactgcccaacacccactttcttttagaaccaacacatattccttctggctcactccctctataaaatgatttgtcagcattttgatctcattaaataaaaagttttacttggtcaaactgggaaagtttatgaagttagcccttccatcccatcatctgctgtggccacagttgttgactgtgaaatagctctgtgggtgtggtctaccaagtatcccaatagcatttcttacactgtgggctatggacccaaaggtctggaagagttgttttcatagggtcacactagaacactggctctttctggttaaaagcttccctagcctttctcctccaactcttaacacatctctcatgtttctttcccccctgcagaagtatagaaacctcctcttttcttttcctctgcactctcctcatctgtctccaagtccccattgtgccatgtttctcctacttcctgtttcctttaaccactaacttctcacgatttttaaaatcaagcctatccaattctaaaaggaaattgaaaccctgcccaccaaaaaagtaaaactagggggaaaaagccatagtaggaggtataatgttatgatcttctctcttagccctacacatctgtaaaaagtaatcttgctccgtactgcaagactagggcagcccagtcgcccactccccttttattctccctcctcacattcccctgtccttttctaacccaccttcccacttagggtctaatttagccaatttatacactcgccaagcttgcaaaggttttggttctctccttttgggtgtggaatgctggtgccacaggggctttcagaaacaatttagtaagtgatagacttggaagagttcaaaagcagctctgggaagacatcactgatgagtctctgctcttagcattttgttgcctcttagaggcttagcaaatagcagcatttgatccataatctgctctttcttggtacccagagaggcagcacaagggtagaccttgagcaagttacttaaactctgagcttctgttgccctttctgtaaaaaaaggcaaaataatcattctgacctcacattgttgctatgaggattcagttagttaatttttaaattttttaaaattaatgtgtttatttttttgagacagggtcttgctctgtcatccctgctggagtacagtgctgcgatcatggctcactgcagcctcaatttcccaggccccaattatcctcccacttcagcctcctgagtagctgggaccacagctactcccacttcagcctcctgagtagctgggaccacacctggctaatttttgtatttttggtagaggtggagtttcaccatgttgcccaggctggtctcaaactcctgagctcaggggatctacctgcctcagcctccaaaagtgctgggattacagccatagccactgcgcccaacacaatgacttaatatttataatacacttagaacagtgcttagcatgtagtaagcactagattaaataaatgtataaaatgaaggaagaaataataatagtgtttttcttttaattcatgcatgaagaactatgttcgacttctgtatggtatcttgaaggggtccaaaataaatctgactggcagtttgaaggcctataagagagcatattacataatttcactcaaggattttgacaattagtccagcttgatggatctcttctcacctgtattttggccaaactgaccaattatttcccattccaactgccatccaaatttccttccccatcccttccacatgtttcagttgcttttgctgcctttgcttcatattgactgtcaggatgtatggccctgtaatactaggtttttatttaaaaagcctttctctcattcataagcttcttttgaggagtgaggcctgcatttctgatggttgtgtatcattcccatgccttgtgcataagtggtactctatccatgtgttttgattggctgatttgagcttttgcagattaggaaatagttggcctagagctaagtggcacctgagagaatcttcccctccaggcctcacagatgcactctgtggaaaggccattgtctccttgctttgtgttggactattaggaacctaaaagctaggacaggcctgggtagagatagccacctttaagttaggggaatgttggggagtctactgggatttgactgtgaggtgaaaggagggctgcctacaagcagaaagcttaaggcattggctttgtgtaattaccaggaatgcttttagctagcaccttgaacggttggttaaaaagggacagttagatgtttgttagatgtgtggtgttaataaccttgaccagtagattcgtgactatgagaatttcaaaaggcgaagcaagaacacacacagagggaaaacatctcttgtttctaggggcagccttcccagcagcactcagcccagagctgtttttcccccaaggagaacacagggacaaaataaatatgccttcctgacccaaagacaggagcgcccagggagaccatgggatctgggagtgagagcagattgtagggaggaagtatccaggatgagactggtattagctacaggctggacagttagtcggtggcagctaggtactgctgctagtggctgagggcagggtttcttagagacctgaagatgtgagcattcatttatttgttccttcatcattcagcaaacctttactcagtgcttattatgtactggatactgggctgagcccccacttgtgacctcactgggcattgagtctgaggccttggcagctaagggtggtgttccttagggaactgggaggccatccagacaggaggcacagtacaaacaagaaagaactaggggccaggtatggtgtctcaggcctgtaatcctaacactttgagaggccaaggcaggtggatcacttgaggccaggagttcaaaaccagcctgatcaaaatggtgaaaccccatctctactagaaatagaaaaacagttagctgggtgtggtggcaggcacctgtaatcccaactactccggaagctgaggcaggagaatcgcatgaacctgggaggcggaggttacagtgagctgagatcgtgccactgcactccagcctgaatgacagagtgagactcctggggaagcccagccctgcatcagagaaagtgatgcactgatgcttcacacacagagaatggaagcgggagtggaggcatttttctggagttcaagcttcaccttcaagcatgatattcagattccatgagagcatgcagaaagagcccagcggacctgttgaacagggcataccattgtgagtccttagaagctaaaagacagccaagaacagtaggaaagaagctgagaataaaagctaagacaggtacctccaatctctaaaaagttaaacctcttagaggattataaataaagccacactcacaggtgtacatgctataatttattttataagtgcctggcatattaataaatggtatgtagtttacttacagtgctgtttgggtggttctcaagtaatctcttgttttacattctaaagtccactcagtgttagaatggaccatttgagcccaagtagattcaacaaaccatctatacccaacccgcacatctgggcagggatgacacttgatgagccatccaggcctcatctcatagactctattcatcccctgctgtcatgggcaccaaaacattttatagtaaattgcacagtagtttgtctttcccaataaactgtatgcttcttgagggtaggtaccctatctctttatctctgacacctggcacacagcccagcacatgacaagatcaagaaccaggactggccggggctcagtctgcacgtgctctggctttcaagtggcatcttctaatgatctgaaagacctctctagaacttttttccttttatgttatgtaaataatatacttaagatagaaacttttgtgtttcatgttgtatattaatgttgaatataaagtttttttctagagtgtgactattttttcacctagttccttcaaattttcatccctaccattagtttttcaaagtctctggattcctgttgaagtatccttttctctggaggtttatatcacctcctaggctgcttttgacttatctactcatgctttacttcggtagtgctgatgctcacccccagttattcctcacctgtaccatgtggtattattaatgcaaatgaggctttacccggctatcccctcccctagcatttatgcattcttcagggaaaactctgttgtatatgtctctgagtctcccacagcaactaacacagtgccttacactccattagctcctcaacgagtatgttttaataaattccattagtggagtgaggtagttaggagcaggtatgagctcaggcctttgagtgggacaacctgggtctaatgctgcctccttcactaactacttttatgatcttgagcagtctgctaatcctccttgtgtccaacttcttaatgtttaaaatgaggataatagtagtacctacctaataaggattaagtgagttaagatatgtttttgagggttaaatgcattaaaatatgtaaaacacttagcacaatgcctggcctgtagtgagagctatcattatcaacaaccaccatcataggtacccattatcagaagttgggggtttggataaagaaattaagtttctctaggttatatttttgtgaagtctgaactggaatgaacttcttcagattcctcatagagtacttcatgccccgcccttttattgcacagggactatatctgcttcagtatgatgtagaacatcttgattaagagtatttttttatctttcgtccttgacttatcttttggtgtgtaggtatattgtttcatcacattctcattttttttttttttaaaaagagttgttccatttcccctttttctgtctactgctttctccttctacgcttaggccaagagtatattacacttggaggcatctagttagcgtggtgcttcccaaacctttccaggacccaaaataggctaaataccacaccaagggagacatcgatgatgttctattaagaacagtgaaagggaacccaggcataaatatacactcagtatacacaactgtcaccacccatagcactgaccatcctattgtaccttagaacttaacactgtaatttatctgagtgttttttaatggctctctactaagtgtcaagctctgtgctaggtctggggaatggaaaaatggtaagacatggttcttgctgttgaggtgcttagttgtaacaatttattttcatcttttattaaatactaattgaataatgttgttattctttttcttttctttttttttttttttttttgagacggagtttcacgcttgtttcccaggctggagtgcaatggtgcaatctcggctcactgcaaccttcgcctcccaggttcaagcaattctcctgtctcagcctcccgagtagctggtattacaggcatgcaccaccacacccggctaatgttgtatttttaatagagacggagtttctccatgttggtcaggctggtcttgaactcctgacctcaggtgatccacctgcctcggcctcccagagtgctaggattacaggcatgagccaccaagcccggccaatgttattattctttaagtaaaacatgtttccccaagtaaacttactgtgtgtttagtaccatcctggaccctcttactcacagtgctatttgccccactactacccagtaaaaagaaagggtgacaggttgtaaggacatgtaggggtttgaggaaagttgggcttgtgtcaatgtaataaaagccaagtagttcttcttccagcccagtctgtatctatgactagatcatgaacagagaactaaaggcttttgattataaacctccttatgcctaggcttggcccacactcaactctaatacaaatagtagtaaatgttaggagtagacataaaatgagcacaggttgccactagaactttttctataacctaattacatttttttcaacctaaaatattacatattgtgtcagccaggatgccatcaggaaagagatggtgcactttagtattccgaggctaattacagtggggctccattagtgcccctagattgagaaggtgagggaacaggctggtttctggaagcaaggagatagagggggctgtgtggaaaagactgcctagcaggatctgagaccttccatcaagaggcacagccagtccatagcccaacatcactctgctccttcaaatctcctaccggtgcaccccagtggcccaacccaggagagtcctgttgatgtgacacacacaggccaggtcccagggcagagagcaggtgaagaatgattgtgagtaaatctagaggggcacacaggaagatatccagcaaacatgtttcacacttgattttagaggtaagggtgtgtatcttaattttatctgttttagaaaactaaaattttaatagatttaaagtatttctgccatagttcttaaactatcaatctgatgatgtcagatatttttctcagtgtcattagtttgacctcccgccacatttttttggtggagaggggtgagggattgtgtataaatttcctccagagcacacagagaataaaaatgctattcttcagtttgtttttttttgttgtttttttttttttaacaaagagttgttccatttcccctttttctgtctactgctttctccttctacgcttaggccaagagtatattacgcttggaggcatctagctagtgtggtgcttcccaaacctttctcagccaaagactcctctgggaatccaactaaatttcctggttcccttttgcttttaatatcaatgaccatattacccaatgaggttatttttatttcttacaaatatttttataattaacttaagattcaacaaggagccaaaggtaaacagactgtaattatttcaagttctaaccattatgagtagatattaatcttcgagaaggtattattaaaaaaaagtatataatattcataaattaaagtcaacttataagtacaaaggaatatctgtgactataaaaggaaaaataaactggaatttaaaatttaatcactgtgccttagtaaacacgatcctggtacatttcagcacagtatttgtgtttcagaataggattttgtcttctagttattcactaatacgtatttattttactatcattcagcaagaaaccctttaaatcactgtcaaaaggtaggtgatttactggaacagctaacctacctctgcctagagtcccataggcactcacttccctatggaaccctctgtcccttcttcccttcctatatacctcaggtacctttatgcagccttgttctattgccactctgcctgttttactaagctgccctaaagtcactgcaaaattttgatcagaacattactgaaccaggacacaaagaaatgctcattacaggctttaaatatatgctttttcttagatctatgggaacaatttctctaattcttaggttttgctccctgaaattacacagaaagtactgtatcttcttaaccctttctccacccctcctttcatttcaacccaacaaacttttctcctgtgcattgctaggcagtgcttccattgtccttaagtgtttaaggtcttgtgctggtaatgagccagtagtcacaaagctagccagtggatttgttcttcaagcctttagtgattccatactccatataatggactataccatttgtggattccttgacagccatgaggagacactgagggagctatgaatagaagaaccctgtgttctcccctgtccagctcccctggcttttggaaacagaacttcaatttttcttctccatctatgtggttcacatggaactgaccccatcctccaactctagaggttgtctctgaacttgggtcagaccaaacgagtttcagtgcttggtttagaaatgaatatgtaaccgaagctgagcatgtgagaatccaaccataagaatttggccgagccttctggggaagaggagcctctgtaagctagggtcactaaattggtacagtgaaagcctgtagccaccactttggagaagcctgcctaagactaacaacacactgcaaggaagagctgaaagatggagagagactggttctcatcatcatttgaccactcaagttcagctaccttggtcatacaacccgttaaatctatccccagccctaccagttattttgtatattatgtcactttttatttttatttatgtatatattttttgagacagggtcttttgctgttgcccaggctggagtgcagtggcatgatcatagcacactataacttcacactcctaggctcaagtgatcctcccaccttagcttcccaagtagctaagacaagaggtgtatgccaccacatccagctaattttttattttttgtagagatggggtctcactatgttgcccaatctggtctcaaactcctggcctcaagccatcctcctgccttagcctcccaaagtgctggaattacaggcatgagctaccacacccaggcttattatgtcaatttgaatgtgcactctgtcacttataacccaaactcctgagtcaaataccagcacatctgagaattcaacaacttctgggatccacagccccatggaggctacaagctactaaaaagataggaatgtcagcttcagctaagaattccagaaatctacagaaggtacctttccttttctttggttccagagagcatgataatatacatacagaattctggaaacttgggaccaataatagggtgtattaccaactgtgtgtggtatctgtaattaaatattgctaaaaccctgtagaggctggtttttacctttaaaaagatcatcttaaataatctgaggatttttattttaaataagttaatgttaaaaatattttttgggccgggcccggtggctcacgcctataatcccagcactttgggaggccgaggcaggtggatcacgaggtcaggagatcgagaccatcctgaccaacatggtgaaaccccgtctctactaaaagtacgaaaaaatgggctgggcatggcgctgcacacctgtagtcccagctactcgggaggctgaggcaggagaaaggcatgaacccaggaggtggagtgtgcagtgagccgagatcgtgccacagcactccagcctgggcaacagaccgagactctgtctcaaaaaaaaaaaaaaaaaaattgatagcatgaaaatttgaagtaaagagtcaattatgttaaagaaaaaaacactccaaaatctaacatgatgctaggctacgttaacaagagcctggcattaaaaactgagtcaccatattcagcattaataagatactagcaaagctctcattcagctgccatgcctaggttgtgcttctgcatgttcagaggatgtggaaagcaattgaaatgattaaaagcatggaaaatcacatctctgaagagcgatgaaagtaggctatttaactaaaagaaaagaagattgaaggaagaaaataaatggtgtttaagtatagaaagagttcttataaagaaaaaggtgtccagatgtttcccccttccactgagtatattaagagaaaattgccttagacatttcatttttacaaaggaaggattttttcaagcaaataggattcttgtactgggtgtgacattggactagatgacctttaagatttttcttcactaagattctatgattaccagattgaggatgtacttatcaaaagagtgtggaaccacttgctgtatgtcttaaaaggtaagatgaggaaacactggctggtttgccttaggtgtcattctgcccaggagttacttccaacattcataacatgcctttgaagaagcaaatattgtatatagacaaacagcatatcagaaaaaaatcaaaacaaaaacaaaggaatactagcattaaagtaataataaaatataggatttttattttctactctttcagtatagccattagcaattcacagttagtttcttcattaactagataagataagtgaggcaaatcatgggacagtttagtattggtgacagtgtgtttggaggggtagaattaagtgttccatatggaatcaggagcatttaatgtcagctctagtatgtatgtggcatatttcctactgcaacttaattggcataattttggatccagagaatacaaaccaagactcagaaaactatattttacttttaaaatatagttttaaaaacaattctaggtttatacatggaaaagctattctaaagaacaatagctggccgggcgcggtggctcacgcctgtaatcccagcactttggaaggccaaggcgggtagatcatgaggtcaggagttcaagaccagcctggctaacagggtgaaaccccgtctctactaaaaatacaaaaattagctgggcatggtggcgcgtgcctataatcctagctactcgggaggctgaggcaggagaattgcttgaaccaggacctgggaggcagaggttgcaatgagccaagatcatgccactgcactccagcctgggctacagaacgagactctgtctcaaaaaaaaaaaaaaaaaagcaatggtgttggcattattgtggtttcaatggatctatacttatttaaaacttaaagtttaaaaaaaaaaaagtccatatgttgctccacatctttctgtactagttgggccattttgttgagttctactatgtggcaagtcaggatgttttgtgtaagtacaagctcctgtgactatagttttcatgcatccacatatctactaattagctccacaactgggttctgcaatttcctgggccacatcgctgagacagattccgcatgttctgcaccagcagtcatttccccttcatggagcccacatagtcacttaaaagtaatttatccaggagggtttccagcttttaagtgagtctgctaataacagaggttgtctgacttcacaatcaattatcctgcatagattcaagtgataatttctatatttgtagttttcaagttgcagggaaaaactgggaagggagaagaatatcaattctgcaaactggttattgaaagtattgggggggtttgctgaatatggtgattttgatggaaaggaatcttaacaataccccattcatatgcattttccaattgaattatggaagaaaaattaacttagaaaaccaagcaagcaagcaaacaaaaagccccaaacaacagcagcaaaacccgacttccaaaaagagttcacattataggcttacttttaaaaactgatctagaaacaagaagctggtttctaagtttatttccacacttgccctctgaaccctgtcttgttgaaagattcaggatatcagattctctcccataatttcctttcaacagaacttactgtattacccacccatcccccaaatataaatggctaaaacagctggctctttcagtcttggtgtatacacacaaacacaaatgagatacacacacacacacatgtatattatacatctctgcatatataaacacatactttggtcatttatttttttaacagaataaaggtaattaatcaaaatacaattcattttaatagttgaggcttgacagagatcattatttcaagaaaagccaaggagaataagctccctttcatagtattgttttctttctaaacctctatagggtgcatggctcttaactactgagaaagtttgggacagcaccatggagcagcctcctggcctacatgttaaaagatctaaattctcttggggaaggagcttataactatgtattcactcaccccacagaagagaagattttgcatctgttttatttctaattctaggctgtctctagttagccatagggcaaaaaaaccaaaactatttccccctctttccctgaagaaaaaaactgaagtgcagagagagaaataaatatctttttcttattccagttcaatttagtttcatttgttcttttctttaatattttgtgagcggagaagaaacatctttaaatcatctcatctatgtgaaacctgtttttagagagtccagactttttctccttcattctgtgattccatcagtgatgctgaaatgactgatttataattctccttcctactgactgggaaatagaggtgtatcatagtggagggaccaggaaaatggataggtagatgaaagagaaccagaggaccctgtccacaacccacccacccagctgaggactgttagctggtccatgaatagaatgctctcaccctttctgcctctgcatatactgctctgctacagagccactcagcagagtggtgtccccttgacccagttggggccatcccgggactcctgtaacctaggaccttctagccttaatcatatcatcatatgtaaagaatgcctacaaatcaataaagaaaaatagaaaaatagacgagggatataaactggtgatttttagaagaaacctgggcattcaactttacaagtcattaaggaaataaaaattaatacaaaaatgagatcccactcttgccatcagtttggcaaaacaaaacaaaaaccctaaatgttggtgagcatataagaaaacaggaactcaaactgctaatggaagacgaaactggtaaagccactttgaagaactatctggcagcctctagtctgatgtgaacaggcacaagcactgcagcccagcagctacacttctagctgtgagccttagagatacctttgcttcacaggtaaaattatgtacaacaaaggctatatttatttttatgttttaaaaaggccagaaggatgaacaccaattttttctttttaaaattaatagataacattgtacgttataatcatatacaacatgatgttttaaagtacacatacattgtagaatggttaaatctagctaattaaacaaatgtattgatcacatagttaccattttgtggtaagagcatataacatccactctctacatttttcaagaatgtaatatatttttaaccatagacaccttgctctttcataggtgtcttgaaatttattcctcttgtctcattgcaattgtgtatcctttgaccaacatcttcccatccccctctccaccacaccccagcctctggtaaccaccattctactgtctacttctatgtaatcaacttttttggattccacaaagaagtgaaatcatgtggtattttgttttctgtgcccggcttatttcatttaacataatgtcttccaggttcatctatattgtcacaaatggtggaatctcattcttttttatggctgaatagtagagtcaaccctagaaaaatgcagggatgaggggtgctaaccctcacacagtcagaaatccacaaataccttttggcttctccaaaactttattagcctactgttgattggaagccttactgataacataaacagtcaacacatactttgtatattatatataatatatactgtattcttacagtaagtaagctagagaaaagaaaatgttattaagaaaatcataaggaagagaaaacatatttaccattcattaaatgaaagtggatctttgtaaaattcttcacccatatcgtctacacattgagtaggctgaagaacaggaggagctggtcttgctgtctcagaggtggcagaggtagaagaggtggaggaatgtagtgggagataggagagacaggttggagtagctttattgaaaaaatccatatgtaagtggaccttgcagttcaaacctgtgttgttcaagcatcagctgtgttccattatgcatataggccacattttttttatccattcatctgttgatggacctttaagttgattccatatcttggccattgtgaatagtgcttccataacatggtagcacagataacctctccaaattcttggtagtggttgtcactggaggaagaaatgtgattggcatactttacttgatatatcatgtgatatataggatagatatatattttatgatatataggatagatatatcatatattttatgatatataggatagatatatattttatgatatataggatagatatattttatgatatatatacacacacatatataagtattatatatgttttatatatatatatataaaaaaacaaacaagaactgaagaaaatatagaaaatatgttggctgggcgcagtggctcatgcctgtaatctcagcactttgtggggccgaggcaggcagatcacttgagatcaggagtttgagaccagcctggccaacatagtcaaaccacatctctactaaaaatacaaaaattagctgggcatggtggcgggtgcttgtaattccagctactccggaagctgaagcaggagtatcgcttgaacccaggaggtggaggttgtagtgagccgagatcgcaccactgcactccagcctgggtgacagagtgagaccctgtgtcaaaaaaaaaaaaaaaaagaaaagaaaaaagaaacagaaaatatgttatatttttctctgtacttttctgcatttacatttttctcaaaattaaaaaagcagatagccactctttcagttgattagtacaatcagcatactttagtctcttagtaattttctgatttgcatctttgcagtccctaaacagtctttcctctatgatactaacaggtttcactgcaaccagctcaccttcctggatctggttttaagcttggtgaaggcagtgctgataaggtctgacaatgtggggagtggtagaagaggcttggaatcttttactgtttttcatagcatttcagagagttggaaaatagcttcagggatcatctaatagaatttatttatttaaatgaagaaattgtggtcttgagagccttgttcagatgcacctggctaattaaaggtagagttagaatctgtaactactgattttctagtaacaagagcagaaagttctacagagccttccccatggacaatcaggcacccaccatgggtttggtattttggaaatagccattaggttagcaatactttaagggactagaaggagaggttaaaagtctctgtggtcactacattcaagaagcagtatagcataaaggctgagagaaggtttatcagaagccatacttgcattggtgtatatcttggctctgccacttccagctgttttatcttggataagttacttaacctgtctgtgccacagtttctttaattgtaaaagtaacaataataatagtacctatttcagaggttattcggagagttaaaagagttaataatatgtgagaatgatgtctgatatataatgtattcaacaaatgttagctattattatttcatttggagaacaagctattaaggaaactgaatgtttaattatggttctgccatcttttgctttaaaccacttatctctcaaaactgtcctatcttcctttgtatttaacttggatgagtcttggttttacaataaagaaagcagaattcaaaaaggtaagatcatttactttcctagaatgatgtcatacatctgtggtaatgattatatttccttttcattatatttcactcaacacttattcatccctattggtatacatgggggctacccatgggagatgtgaagcaatctagttgacaaaagaaataaaggactgagtccctgggggtgttactgtccaatacatagattgctattttgatgcgctctgatcaattacaagcaaattcttcaagtttttaaacaaattacactccaaattcctacattttgacaaaagtgctttgaaccttaatataaaatgatgatagaattctacttgccaccaatgcatctattaaacagtgtaggtttctaggacccaaatcagattttctttctttgtatcagtttcttgaaactaatgctataatcctgatgtggcttttagacaccaacccattcaatggtggagaattcattcccagggtttgaaagacagctaaccatttctttgtttgtccccagtgcttttaaccaaataatgtagttcttaaaagatgcatttatataaggtagaatactctacatttcctttttatggttgtttaaaaatgtttttaacaaacattacagtaatttttctcatctacctcagaaaagttccatgttctaactgagatgaattcctttgtcaaactagtaagagggtgatttcatttgtagtttacttactaatttattccataatttgagtgttaatcttgctgtcagatgaatataatcaacttttggactcaatttcttcctgtggaggggagaatttctgtgtaccaaattcccacataattgcctcttttgcacacacccacatcttatttttgttggtgcctatcctagcccatcgcaacctgtaattgtccagctaaataatttttaaaagatttgatgctttcaggtaccaaaatgattcagatttaaagctgcagtggatagtttattgatacatgaattaaacctgaaataccccctcagaaccttaaatctcttttcaggacagatgtctaaagttgaccacagtttttctgtgtgaaagtagatgctaaaattagccattgtagcatgcagctttgtggaagtggctgtactcttgcatcctgtggttctttcttccctattggcatggttattttgatctgaaatgtcctttttcctttgctgtctagctttctgctgtctacctattgccattccatgggccataattctcaggtggaggtttttaaaattttcccttgcctaggctatatcccagaccagctgaatcagaatccctggggacagagcaggggtatttgagtttttaaaacctcttcaggacattctgatgctcaacctgaattaagaaccacttgcttattgcctaggttagaaatttttatttgttttgttttgttttgtttgacaggatctcactctgtcccccaggctggagtgcagtgacatgatcacagctcactgcagcctcgacctccttggctcaggcaatcctcccacctcagcctccttagtagctgggactacaggcctgtgccaccacactcagcaaattttttagtttttgtgttttgttttgttttgttttaagagatggggtctcactatattgcccaggctggtcttgaactcctgggttcaagcaatcctcctgcctcacactccgaaagtgctgggattatagtcatgagccaccgtgccaggcccaaaaatcttttatttgtaaataactgaaacccaaactatcttaacagcaacaaaacaatttgtcataaggaatcacgagactctcacataacccaacagcatgaaatacaactggacttcataagagaccagagcctggaacaggagcatttacaaggacccaggcaactagtccctgttgcccaggtgtagctctctgtctgcctggctcccttcaggggcttgtggattcagatctctgcttctctctgtacatctgctttctttcttttctctttctcagctagccactttcgctgctgctgagcacatggccaaacatggtgcatcctcattacccacatttgtacgtccttagttcgacttcccagcccagggagactagcatcaatgaatctaaattcctgagagaggatctgatcagtctggcacaggtgatatgtctgcccttaatccaaccagacaacatggcttaaacatggctgccaagggcccacccatgtgtaggttaagtttggaggctatttagctatctcaaagtgtatctttatgcttgccatattttttttcttttttgaaggaaattttgtattattttaattatttttatggacagaaaactcaacagtgtacatttaacccagttcagtggcaaagttctttaacctttgccttttcgagcttgataatgtgagctacagacttgagacccaggacattgcctccccagtgacagtggatctcatcgtatctgtcgtagttggtcctgatagcttccaccagcttagccaaagctcctttgtcttccgagttaacctttgtgaagacaacagtggtgcaggtcttcctgtggactagatgtcccagtcttgccttccccttgataatgcagtaagggaccccctttttacaacatggggcaggcaggcagaagacagccagctcgatgggatcgacatcgtgtgcagtcatcaccagctgagctttcttgttctccaccaaggtggtgaccatgttaactcctgctcgaaggacaggtggtctcttagtggggatgtcccctttgctggtagctttcttcttggcctgggccaacagcctctgcttcttctcttgctttgtctctggcctgtacttgtgggccagcttaagcagctgagtagctgtttggtggtccagggcctgggtgaactggttaatggcaggaggcacttacatccacttacagaggatggctctctgccgctgcaacctgatatagtggggccatttcacaaagcgggtgaggtctctttggggctggatatcctgtccaatgccaaaattcttaagccttttctcaaacaggggattcaccacttccttggcctcctgcttctttatgacagcaggagctggagccattttttctccttggctttctttcctttcagcatcttgggtggcgggaggagagacttatggttgccatatttttcatctagcattataccaaataactttgtttctaatttcagttttattgatgatattttcgcctttaaagaaggtgaaaagcaacaattttcatatatcaggggtgatttaacgttacagatgccactaagatgaacattgaatgtactgttctctctctaagcctagttcttcctcttataaatagggatcagtctaaatgttgagaaaattagagaattgggaaatctgcctctcctaagtagtaaaagttgaaaagtagtacagtaagatagcaatctaatagcacagtcattttctacaatgtatataattttaatcatcacaataaagaatgtttaaagaaattgaggtagtttaatcataggcagtgctgagatgtgaccatataatgatcttttagagagaaggctgctactttttctttgtctacacaagggttaaaaaaagaagaaatgtttttaggaggaatgtaacatagtgcctggcacatggttagtattcaatagtattttactaatagtgtttacttagaaatatttatcagaaataacttcaaggtgtctttggaccgatacaatgagttaccaaggaaagtaaatacatctttccttcttcctttttttaccattaaaggaaaccaaaatacttcaccctcaaatatacttctttgacatatttgagatggctattcagagaacctgcagacaggaatagccctgtaaaactaccttttgtgggggagatttacatctgtagagaaaatctacattgctgaaataaacagccagcctttctgtgctgtgacttgtctggatctaggacagatgggctcctgggagagagagactgagagtttgacacctctggggatctaatagaaacttactcttttggagggctgctacctgtgaggtttcatctgcattacaagactgcctttgctagccatgcttttcttctcttccacccataactggtcttgccagactctaagcctctattccttctgtaacctcaggatgaaaacttcaactatctgaccctttctttgagtttttcttattttttataactcctgtgcacatgcgtgcatattactatttttgtatgccttttttcctattaacctgccttttgtcagttgattttcagtaaacactcagaggttgaaggggaggttttccctaggctcctataccatcttgcatatttgggatatcccaagacatccatgacgcttggctctctaggacattgaaatctggttagggaagtaaaatatgaaagcaatggagaacagtctgcctttggcactcagagatctctagatgttttcacttgtcccatttcatccttataggttaagaagcagggaaatagagttcattacaatttcaaattataattttgctgatattttccccttcagggaaggtgagaagcaagaattttcacatatcaaaggtgattttaccttgaagatgccactaagatgagctgggcagagagaatgttaaggcaaagcacaatgttaatgactaaattagaactgaaaatgaatttaatctctttaaagaacaagaatcaaggtaactgtatttcagtaatgtgtaatgcaaaaaatgcatgatgaataaaatacatcatagaaatatgaagggttgagttatatgcaagtatattataggaaaaattagttgatctgatactgtatcagagtagcttcatcattaaatgacactgtgtcatttatggaatcattggcaattcctagaacatctattacagcactaaagtggtcagggttttcataaagttttgtggaagtctgaaccttattttcttaggtcaaagacatggtagaagcaatttataagtaatgttttattaataaagtgatttctaagtttatgataaatacaagtgacagatccagtggaatttattggctaatgtaattgcgaaggctaagaagtggatctaatgggtttccaacaatgtcatcatcgtttctgctgtaattccatctctctgctctgctttcctcctgttggtttcattcgcagcaggttttgccatatgggaggagcaatgcagcagtctctggtctgtatcacttaggatctcataaggcataaggtcttttttctctccaactttgtcagtacgttcaaaaagagtcctattggcccattagatcttttgtctaccccagtggcaggaagacagggccccagaggtaggggtggagcagttctccaaaggaaaggaaggtttcagttattagaaaaggggtggaaagaatatatgtccaccaatatatcacacaactgcatatagtgcactttcacatcctgtggcaaacaaaaatctttcactaatggaaaggaaatgatggcttgacatattgtgtatagtgtaagaaaaaaaaaatccagatgcttttttcatattcactctaattccctaggttacaactaattagtacttcctgtttgctccccatataatttgcttaccccttgactctatcacatgtttatcttccttctagaggcctatcttacagaaataggatgtgaacacttgaagacagaactttgtcttttatctctttatttccagtgcctagtccaatccttggaacacagaagccacttgatgcttactgagtggaattaaattctatcctatctactgcttatattaggaaagaaaaaaaatttactagtcaagggcttcagggggaaagtctttgttctctaggaggaaggattttccctaagtcactcttggcctttctgcttcttcactgttcctccttagggaaagtggaatggcttatctaactggtgagtctgagataaggaagcacttcgcacattcagatattgtcctccaccagccatagagggacgggacagggggccctgcctaacccagttttggggaagctcactgttgctatgtacccatgccttctctctctctctttctctctctctccctctctctctctgtctctctctttctaatgaagagtttagctttggagttaatgagcaaaagatttccttaccataaagtgaagcccatcaagtgaaagcaagtagaaaggcgcagaaaggtttatccttgtcaccatgtggaaggacacttggggagcagatcatttggtaactgttggtacttgtggcctctacatcttgtaaattcatacatgtccacgtttgacctaattgtagacttttttgaaattttcagttttaggtgaataccaatgagtacccagagttttctgtctttgttgtcctctggatgttggtcccaaatccactcaggcaacaaatcctggagttacctgctccttatctttaaagtatatgtagcccttggtctccatttctgctgcctttttttttttgcttatttttaaatttaaaattgacaaatacagttgtatgtatttatgggcacaatgtaatgttataattaataaatataatatgggataattaaataaaactaattaagatatccatcgctccaaatacttaccagttttgtggtaagcacatttgaaatttactctcttaacaattttcaaatgtacagtacataattattcactatactcgccacacaatttgagctccttatatattttggatattaaaccctaatcagatgtatgccttgaaaatattttctctcaatccaaaggttgtcgcttcatgcagttgttttccttgcggtacaggggctttttattttgatataatcccatttttctatttttgcttttgttgcatgaacttttagggtcaggtctaaaatatcattgcccagaataatgttgtgtaattttccccctatctcttttgacagcctacaatcagatatatgagcaaagaaatgatttaaagttggaacttacatttaaaagggaagcagagtgtaaaattttggataatttgcagcctggctatgtggccagagaaataaaaagcatttttaggagaggaatacaagcaggctgaggaacaaccacttgcttagaaagattagcgtgactaaaagggagccaagtgctaatttccaagacaatggggaaaaggcatatcagagatcttggagacagactctgctatcagacccagagcattatgaggaaataatggtttcagggaccaggcctgggccattgccctgctcaggcttgagacactgctgtctgcatgtgggctgcttcagctccatctccagctccagctcaaagggccccaagtacagcttgggctgctggctctggagggcacaagctgtaagctttagtggctttcatgtggtattaagtctgcaggtgcacagagtgcaaaagtgaaggaaacttcgcagattcccctagatttcagaggatgtattggaaatcctgggtgcccaggcagtagcctgctgcagaggtggagcccttacagagaacctctactagagcagtgtggagaggaaatgtggagttgaagccccccacatagagtcctcaccagggcactgccttgtggagtgatgggaagagggccaccacccgccacgtcccagaatggtagagccatgggcagcttgtatcctgagcttggaaaagctgcagacactcaactccaacccatgagagcagtcatggggtctgcatcctgcaaagccacagggacagcgctgcccatgcaccagtgtgccctggatgtgggacatggagtcaaagatgattattttggagctttaagatttaatgactgccgccgagcgtagtggctcacgcctgtaatcccagcactttgggaggctgaggtgggtggatcacgaggtcaggagatcaagaccatcctggctaacacagtgaaaccccgtctctactaaaagtacaaaaaattagcacggcgtggtggtgggcgcctgtagtcccagctactcgggaagctgaggcaggagaatggcgtgaacctgggaggcggagcttgcagtgagcaaagatcacgccactgcactccagcctgggcgacagagcgagactccgtctcaaaaataaataaataaatagcctgggtgcggtggctcacgcctgtaatcccagcactttaggaggccaaggcaggcagatcacgaggtcaggagttcgagaccagtctggccaacatgatgaaacccagtctctactaaaaatacaaaaaactagccaggcatggtggcgggtgcctgtagtcccagctactcgggaggctgaggcaggagaatggcgtgaacccaggaggcggagcttgcagtgagccgagatcatgccactgcactccagcctgggcaacagtgtaagactcaatctcaaaaaaaaaaaaaaaaaaaaacaacatttaatgactgcccttctgggtttcagacctgcatgggaactgtagcccctttcttttggccagtttttccctttggaatgggaatatttacccaatgcccatattaccattgtatctcggaaataaataacttgtttttgatcttacaggctcataggtggaaggaactcatctccagatgaaactttggacttcagacttgggacttttgattgagttggaattggaacaaattaagacttgggagaactattgagaaaggatgattatattttgcaatgtgagaaggacatgagatttggggagctagaggcataatgatatagtttagatatttgtcccctccaaatctcatgttaaaatccccagtgttggaggtggggcttggtggaaggtgttctgattatgggggcagatccttcatgaatggcttagtccatccatttggtgatgaatgagttcttgctctggtggttaacatgaaatgtggttatttaaagagtgtggcacctccccccactcttgttcctactctcaacttgtgacatgctagcttcccttcacctgccaccatgactataagcttcctgaggccttaccagaagctgagcagatgccagcaccatgatttctgtagagcctgcagagctgtgagccaattaagctcagcgtcaggtgtttctttctttttttttttttttgagacagagtattgctctgttgcccaggctggagtgcctggaggcatgatctcagctcactgcaacctccacctcctgggttcaagagcgactctcatgcttcagccacccaaggagctgggattacaggagtgtgctaccacgcccagctaatttttgtattttagtggagatggggtttcaccatgttggccaggctggcctcgaactcctgacctcaagtgattcacccaccttggcctccaaaagtgcatgaggcgtgagccactgtgcctgggcagttatttgtttatagtgatgcaagaacagactaacacaaatgggttcagaatgcagttgtggaaaaggtgtataatttaatagttccctcaaacctcacagaagaatttcagaaagatcctatatttgtttttgaatgcatgcagagaatagattaaaatataaatatcttgatgttttttatattacatatttatatcccatctttttccaaaacagatttaaagtggtttcatctttgacatggtaatctaacccatgacattcaaaagccacaaggacagaaaaagaattttctaagactgcctgaagcgcaacttcatttgatatgatttcctagcctagaatataatcaggaaggcactgatttctttctgttactgttgtttttaagcaaaaaagatcccattcctcctcttctatttctttgcatggtgaatagcttcgctagttacccagccactaaacaacaacctgggaatcaacttcctctctattctgttgccccttcccccaaacaaccactcgatcatcaagatttcttcctcgatttcatgttcagctctacatccagggtctaaattcacaccttggatttctgctgcctgaactaatccagcagtcgcactctgtagcccttcagtccctcttctgtagcatgtccaaagtgttctttctagcagaacaatgtgattgtgttactcttgtacttgaaatccctcaatgtctttttcactgtctctgggatttattccagactccctagcatacatacagggacctcaaggtctggcagctgctcagttctccagccgtatatctctgaatggtttctctctcggcctcatttctccatcacccctcctcccagtaaacacatacactagaaccattgtgaatttctcagagtacttcttatggtctaggatagtttacatttttgggtcccttttgctgctcctctgcctataatttatcccttcccctcttgccttccctctaccccccaaggctggctcagcttttaagactcaatcgaagtgccaccacctctctgaagcctttttcacacttcacccttaggaagaatgaagcatcttcttcctcttcttcccttccatgtctataatcctcaacacattttttttttcatgaattgtctgcaacactgtttgctttcgctagactgaaagatcttagggacaaagtccaagttatgctccttctgctgtctctaatatctagcatcattcctgacactttagcagtatttcataaatgtttattgactaaatgcatatttacctatgcatgaaagagtaacagtttcagagtttttgttagctgcattcctttacttcctatcagtttggggaagtagatttagtatccacaaaatgattgggggtcccctgtactgcaaagatttgactttaagaagtaggtggctgggtacgatagctcatgcttataatcccaacatattgggaggccaaggcagaaggatcgcttaagcccaggagtttgagaccagcctgagcgacgtagtagggacccattccgtatgaaaaaccatatatattagccaggcatggtggcgtgtgcctcccaaattggctgaagcaggaggattgcttgagcctgggaggtcaaggctgtagtgagccatgattgtgccactgcacgccagcctggatgacagagcgagaccctgtctcaaaataataataataaataaagaaacaggcccgtgaacagcatcagcagtttcagctactaatactagcagtctttgttcctcttagagtgcagagagctgctggtcacttttgatctttattaaaacacccatacacagtaagattgcttgggaatccaaggcagaatatatctgtgtggtttgagagaggactttaaagtgttagagagtctaatcttagagcacactaaaaagagagtagatacactaccccaggacagagatgaaataatgaatttgctgaatattccatgtgggccctgaacatcaacagggcaagagagaagtcaagaaatgaaaagtgctggtaaggtcagcaagtacctatcttggcacccaatggtaccaagtgaccattgcatggaccatgctctgggagggcatgagaaaaattaagggcaaaggacattccctcaaagagtttaccagtttaaagctttaatgtcactgaaactaatatgtcttctgtgacaagctttgatgataaatgtagactaagttttttaaaatcatataaaaatttaaaatactttgcaaagcacaaacaattttcttaggcctgccttggtagcaagaacagtttgtaatgactaaaaagtgaagaatctatggtatattcatggtctaaatcagatattgcaagctggtgccctctggactggagtcatacgatattttcaaattcaggaaattttaaataaaaattaagatttcttacttgtgatttccttgtgctctcaggttaaaatggtttatgcaagacttgatggtttgaaataaaattggctaaatggattctagtataaatgcaaaggatatttaactcacttgggagctcataggcataatgcatatgtttgtttaaaaacaaaagaagcaattgaagattaacattgactttgtctcgcctggcgcggtggctcacgcctgtaatcccagcactttgggaggccgaggtgggcggatcatgaggtcaggagattgagaccatcctggctaacagggtgaaaccccgtctctactaaaatacaaaaaaattaaccaggcatggtggggggcgcctgtagtcccagctgctcaggaggctgaggcaggagaatggcatgaacccgggaggcagagctttcagtgagccaagatcctgccactgcactccagcctgggcgatactgactttgtctcatagtttagatctgggataaacaaaccttttctgtaaagggccagaatattttaggcctttatttattttaggttttgcaggtcctataatctctgttgcagctaaacagctctgccactgtagtgtgaagtcaccatagatgatacctggacaaatgagcatggctgtgttcaataaaactttgtttatgaacactgaaatttgaaatttatataatttctacatgtcacaaaattttttttgtctttttttcagctatttaaaactgtaataactattctgagctcatgggccatataaaaacaagagatggacctcatttgacatataggccaaatggacattggctgagtgtcattgtaaaatcttggtcttaggctttttagacctgattagcctaaaaggaacaaactagaatgttctgttctctttacagggcaaaggaattctcctttccctactttttattttttattttttcattttttttggatggagtcttactctgtcacccaggctggagtgcagtggcaccatcttggctcactgcaacctccgcctcccaggttcaagcaattcttctgcctcaccctctctagaagctgggattgcaggttcgtgcccgacgcccagctaatttctgtattttcagtagagatgggttttcaccatgttggccaggctggtctcgaactccagacctcaggtgatccacccacctcggcctcccaaagtgctgggattacaggcatgagccaccatgcctggcttccctacttttttatatccatggggagcttggttgatatcctgcttgaacatggaagacccaagttgctcaccctgtgttttccaaagccttaaaggctagtctacatttcagacagcccaggtgatgagggagccttgtgttttctgtgaggaaccttatcccttaagcatctatatcccagtcatacttatgcatggaaaggctaagtaaaatctattaatatcctagctagaaagaaaactataaaattacacatagatgcaagcttgtgtgtattctgcagttcaaagtgtagtcagcaaaaaaagcatacacgctatcgcactgggaggaaatcggtgtctttgaaatcaaataccctgccattggcatatccaggcttgaaactcagctgcagcttttagcttccaccacatgtttacattggaaatctctctgtgcacatatagagtttgttctcttatgaaatcatgtctctagggaaggataatttaaagccatttccgtttgttatgtctgagctgaactagactattagggcttgttaacgctggataaacttgagccctataactgccttcatctgcagattatagaatctgtccaacaaattgcattctgatgttttcagaatgatggctaagcaagcaagggccttttaatttatattctatcaccatggttgtcaggaatcacagttttgactttcatgcttacttggtatagcagcgatgatatgactcttgaatggaccaaatccagaagtaattgagacactaaactgcatctgcatgttactatagcagagtgagcaaaggctgacagtcagaaaattgctggtgaagcatctttcttcagagtgcctcccttccccgagtcttagcataaatcagtgttaggtccactgaaatatcgtgtgtggtctgcatttagaaattttatttgaaaatgagacagatggataaatgaaaacaagttttctttaggctagtgttaagtaaatagaattaagtgaagatagacagttttcctgatttagtggaggggagatggtggttgccccaggatatctaactccctctgcctctattcatcaaatccactgaacacatttgccttcagtttggcttaatatcattcaccattttagatagtgggatactggaaggtagaaattacatctgtttgacttcttttgtgaaccagtgtagcagaactaccagtacaacttaagtaaaatcacaaataggatggcaccaggcaatagtgtgactatccaacatggcatcccctagctgggaaaggaatcctttcttcatggctctggccttattttcagtagctccactgaattcacttcttttcaataaacttgtagaaggtactgccctacgccctgaggttggggacagtggcagtggtaggatacagagacaagtaagacatagaccctgcccaaaaggtgactgtatacataaagcaccctaatccagaccagactcaaagaatgctagaaatgaagggcagacataggacagtggcattttgagtaagaaatagggtttcaactggtgggagaaagaagaacctgctagactaagggaacagcatgaactaaagaccagaagtagaaaagtactactttttgtaccaaaagtagaaaagaccaaaagtgttgagggagaatgggaataattcctctctctctctttccttttttccctttattctttattcaataattatttgatgaatgtttatggtaaaccgaacagacacagctcctgcccacacaaagcttacagtctagaggaggaacaaccaggaatcaaagaagcccaaagtaaataacaaattacagccctgacccttacctcaaaggagaggggtacattgactaagagagcacattacaggagagtggaacatactttacaagcctttactggagagatgtcctgccacctgaagagagaggaggcattgattagaggagagcgctctatggagaggagtcagcgtggacactgagactgcaagagtgagggaatgtgcgggattagaccacagtcagggagcagaacacagtggggtttttggtctttattctaagagcaaagaaaagctattgacctgtttctagcaaaagatggggtaaggtaatgagatttgctagttggaaagatcccactagctgcagtgtagagaatgaattagatgggtgaagagggacccctgccaggaggcagatgcaattgtccatgggggatattctggtttctttgcactggagtaatgaggatggggatgaaaagaagggaatatgtttaagagctgataatgagcttggccttggcaacactgagtttgatgcacctttgagatactaaggagacataccaggaagatataggtgtactggagctcactgaagaggtctgggctggagataaacaattgagtcatctccttataggtgataattgagccataaaagtggataaataaatataagttgaatgaatgatagaattaatgaatagatggtattgggtgaggaaagagcacagagtaacgagggcttaaacaacgttgtggtgctgtatttctgtaactattacttatcagttgtgagactggacaaagtgattttcctctggccaggtctgatgcctcctatggacacattctgaaagccagcaggaacctagaaagtgaccaggccacccccttgcccacatagaaacatgtctgctaactcttccaccttaccaataggtggattccaagagttcacataaaaggtggttgtttggattgtagaagtctcttcccaaaagaaactcctattttcctagggagatgccaccatagaccctaattaaccaaggtcctttctgtgagacattatgttcaataggaccttgaggtgttacaaactatttcctcacagatgcctgggcataggcctggactcttccccagaatcctcccatcccacttgccaggcactgagaaacaggactttccacttgtttgtcactggcaaggacttcatggcttcagagagggagctccaggggtttctgggacacttaccagtataaattccctgaggttcttctaagtctgtgcttgaattcattcattcattcccttcttatcttttctgaggaccccaagaattggcctgcctgtgtcctttgcttttacttgcagcaggtgggggtctggcacggtcgggggaagggttttgatgggaaaagtgaggctggtactatttttcctcccatgtttagcctatagagtatagtcataaaacttttcctcaatgtttcagtcctgaagcaagcgcacagctcattggaagtttctaaggatttttattattagcaatgtcagaaagcaagttgaaagcaaaacagccccctctgggcctcttccctagcctttccttattttgtgttgctttcctcacacccaggaggaacacatatcccaattcctgaggacagtcctgatttgcaactggcatcgtggcacaactgccaatagtaccacctttaaaaagtttagacactgaattatggtcatgctacttaaccccataaagaaaaataaagtaatgcattgggggtaatagtggatttacaaaagactacaataatctcgatctgcattttagcgagaggatatgagccacagagtgatttctttggtattttgtcccaacagctggactgggcctctatgtgtgtaggtgagggatggggtacagagaggaggacttgtgggaagtgctggaatatcagggctagaatattgccacagaaatgtgtctattttttctcctgtctctttctcagtaaccagatctaccttggaagactcagactggcactttggcaaggtgagatgaaaaatcagggctgaggaaggtgcatttgcaggcactgtggggtccacagcagagaggataaaaacgtggaggcagaggtgcatccgagtcataatagcacagagccgggcgttggggttggggcctgagccattgttgtctggctgtcgcagcagggggaaaggaggacagaagtgtcaatgtttcgtttagaatttttctaaaaagttgccactttgggtgaagggctcagtaagaccttcccctccacactccacataactatgcttctattagaagtattctgagcagttcaggccttccacgtggtggaactgtgtggggtaccctcaagcccatgggtctctaggggttgtgcctaagtcacatgtatacgttccacctgtgatgttaggcaagcaagcatatgatcctttctcatcaccacttccatgaaacaaagacattttagaactgttgacgatagcaatgttttctcgacaaagagattacttgtaaagtagtaaagaacattagaaaaaggagctatagtcatatggtcactgttctttgtggtgctatataggtggtgtgtatattataagaacttttgtgtcttccaataatgttttttggtttttggttttttggtttttttttttttttttttgagatggagtctcgctctgttgccagtctggagtgcaagggcacgatttcggctcacggcaaccttcacctcccaggttcaagcgattttcctgcctcagcctccagagtagctgggactacaggcacacaccaccacgcccagctaatttttactgttagtagagacgaggtttcaccatgttagccaggatggtctcgatcccttgacctcgtgatctacccacctcagcctcccaaagtgttgggattacaggcgtgagccaccgcgcctggccccaataatgttttaaacgagtaaaatgaagtttgtcacttctgcatgcttacaagcttaaacatcaaaagaattggccaggtgtggtggctcacacctgtaatcccagaactttaggagacgaagttgggaggatcacttgagtctgggagtccaagaccagcctgggcaacaaagcaaaatctgtctctacaaaagatttattttttaattttttttttttaattattaagaatccaaagagtttatacatttaggtgggaaaggtaacccttgggaagccctgggctagcctctcggcttgctcatgattcaagtagcaaaaagaagtagtggactcaggacagaattttgacgtgggagccccatttcaagctctgaggtctgaaatgccaagtttaagcctcttggcctcattgtgactcgatttccctttctgtgaaatgagaagataatcccagtattagggtactatccgagtaccttcaggctttttaggaagaactctagtgagtaagctctctggctgtagaggggaccgtgatgcacagtaaaaagaaccccatcttgtcactggagggatataggcagccgcccaatgggagctcccatactgtagagatggcactcttgctttggtgggactagtacagatgtattttttatgtcccatttcttatgttgcctattttttggagacatatttgtttgttaactctttgagtttcataaagaaaacattaatacaaattttattgagtggtaggttagctccaatatcctcaaaatagattgagcattttagaattcaccttaatgttacctggaatgcaaaaagatttgcctaaaacgtttagctcctcattttgttactggcttcattctgattttggaaacaacagaaagtaaagtggaactggggttttgggtctattagattctccaatttaatctcgcccatctattcctgatattaataaactctttctaatatcagttggccatggttgtcattctggtaaatacctccctggaaccggactgaataaaattcatgagacttgctggtcacagctggagattggttcagtggtttgggtttttttttctaccaaagtgaaaatagaattattgttattattgttttctagttttaaaatgactaaaagtacaaaggaaaaatggaaaagtcaatttaaatcctactgctgagagaaataacattttggtgagcaactctccagatcactctcagaatgtgcatattatacttccatgtgccattgttagaaaacaagagtgtactttctcattgtggacaactctatgtccataaataatgacaccattaattatagtgacagtatataatattccattaaacagctgtgctattatccatttatgcatttcccaattattattcatttaggtttttttatattgcttactatcatttaaaaattgcagtaaacattcttttacatccagatttccaaatttgtctaattatctcccaggttatatagccatatcttgaggatattgtagacatggttccagaccattgcaataaagtaaatattgcaataaagtgaaatacattttttggtttcccagtgcatataaaagttatgttggccgggcgcggtggctcacgcctgtaatcccagcactttgggaggccgaggtgggcggatcacaaggtcaggagatcgagactatcctggctaacagggtgaaaccccgtctctactaaataaatacaaaaaaattagccgggtgcagtggcgggcgcctgtggtcccagctactccggaggctgaggcgggagaatggcgtgaacccaggaggcggagcttgcagtgagccgaggttgtgtcactgcaccccaacctgggcgacagagcgagactccgtctcaaaaaaaaaaaaaaaaaaaaagttatgtttacactctactctattaaaagtgcaatagtattatattttttaaaaacaatatagattacctaaatttaaaatacttaattgctaaaaaaaaaaatgctagggatcatcggagccttcagtgagttataatcttgctggtgaagggtcttgccttagtgttgaaggttgctgactgttcagggggtggttgctgaaggttggagtggctgtagcaatttcttaaaaaatgacaataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgcggtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaatgacaataatgaagtttgccttatggattgactcttatgaaagattgctctgtagcatgtcatgctgtttgataacattttatccacggtagaacttctttcaaaattggagtcaatcctttcaaaccctgccactgctttgtcaactaagtttctgtgatattctaaatcccttgttgtcatttcaacattgttcatagcatcctcaccagtagattccatctcaagagaccactttctttgcttatccaaaagaagcaactcctcatcatgttttgtcatgagattgcagcaattcagtcacatattcgggctccatttctaattctaattctcttgctatttccgccacatctgcagtaacttcttccaatgaagtcttgaacccctcaaagtcattcatgaaggttagaatcttattccaagctcctattaaggatggtattttgacctcctcctatgaatcacgaatcttctgaatggcatctagaatgctgaatcctttctagaagattttcaacttactttgcccagatccataagaggaatcactatctatggcagctatagccttacaaattgtatttcttaaataataagtcttaaaagtcaaaattactccttgatccatgggccgcagcaggcatgaaaacaacattaaccttgtacatcttcatcagagctcttcagtgaccagctacattgtcagtgagtagtactattttgaaagagatctctttttttctgagcagtaagtctcaatggtgggcttaaaatattcagtaaaccatgctacaaacagatgtgctgccatccattccttgttgttccatttctagagcacagacagccattttcaacatgccttcctcactaagcttaatcatttctagctttaaagtgagagatatgtgactcttcctttcacttgaacacttagaggccattgtagggttaattggcctaatttcaatgttcttggcctaatttcaatgttgtcgtgtctcaggaaatagagaggcctgagaagaggaaaagatggggaagggctggttgttggaaagtcagaatacacacatttattaagtttgctgtcttacagaggtgtggttgatggtgcccaaaacaattacaagagtaacataaaagatcactgatcatagatcaccataacagatataattataatgaaaaagtctgaaatagtgcgagaatgaccaaaacatgacacagacatgaagcaagcacatgctgttggaaaaagggtgttgaaagacttgtcaacgcgcttgccacaaacgttcaatttgtagaaaaacatagcatctgcaaagtgcaatacagcaacacacaataaagctagacatgcctgtactcctgaagtgatgttgatgatcgatgggtccgaggcatgtttcagtttttgtatgtattgcaaaactacctgtcaggaatgtatcagtttgcatgaccatcagcagtgtttgtgaattattggtcccccacactattgcctacactgcagctaattttttttctcaatctttgtgagtctcttgagtgaaacaatatcttactgtcatttatgtttgctttactttgattactagtgagatgaagcatctttttgtatgtttattgcccacttgtatagtatttctcctattatgaaacagaataggtcctgtccaaaaactctaggaaggttatggtctggttggtccatggaatgtaggatctggactgtaaattattcttcagtcagatcgtgtgatataaaagcctatatcacacaatgtgtgatggtaaagaaattattaaaaattatttgaaaaatattttaagaatagcttgttttatgattatatcatggagtttgagtatccttaacaaaggaagaaattcaccatgcttattggagacatgtaatcctagagaaggtgggactgggccatgcccctctgctgcagtaccagcacagaatgacagaattgttggaaacctctcctaattcataccaccccacagaggagcagctgccacagtggagcacaccccacctgcttggaggtgccataggccagcctctctgagttttatgatgcatctgaaatggagttttactgcatcctcccacgaccttacgaaaaaccacgggggaggaaagaaaaacagaacccaccaagaggagcaagcagacctgtccgagggtggggaattggctactccataaggcagcaggagagtaaactacaaaagacataaagcacaccttgctttaatcccttccatccgcccagagcccccagaaagctcataaagtctccctttctgggtgattggattcctttagctcaggggcaagtagggcatttttttggttttgttttggaagagggctgggtaaaggagaatggtaatcactggggttggaggagggagaatgaaaacgggggcaatcactggggttgggggagtcccttctcttcttgcttcgaggtagtgagtgggaaacgcaaacagctgctgcctgaaatcacagcgcgtgggtactgggcagccagaccagatcagcagccattaagcagggcccacagttcctatggccgttacctctctcagaagccaggcagagctgtgagttctttcaccttttgagggctcctcttggctacctcaaaggaatcatttggaatgctgctggcaaaaacgttgctgaaagttgtgtgttgtaggggggcagtgttttttctctctctaaaaagagtggtggtggttctttgccaggatttagaagccagaactgtctgtcctttttgtttgaaatagagactttagagactagtcttttcgtttactgaaagaaggagaaagaaaggaaaaaaaatttgtctactttgcctttggtctgggtactttccacttgtttgcttttaacctttctcagtgtttgcagggtgcagggaaacggccttgtcagcctgggctgggctccttaagtcttgaacaacaaacacttaaaataatcaaaatgttatatttggcagttaaaagaagaatctcctaaaactatgtctagtcttatttgtttctgaactcctggtagaggcggggagaccatgttctccattctgtggcctagccactcttccgggccttctcttgttcctcttcactccctcttccccagatgtactcctagactgagctgcttcccagctcagagcccaccacgtgcctctgcagcttctgtgcctttgcagatgccgctccctctcctggaatgccttctccccacccttccctggctgaagtcctcctggccataaaaggctaccctaagtgcactgagcttccttgctaggcacatcttatcatcgttatttctgtaattcttcctttcattggctgacatccatgacatcagggcccaaccttaggtggctagcacaatgcctgtggcagtagtggcagcagtagtcttcgtgttaccagcagcagcagtaatgactcttactgggcatgtgccatgtactaggtctttttcatactcatctctaatcctcccaacaactctacatcgtatatgatattgtctcctttttagagatgaggaaattgggacttaggtggggtggaaagatgtgatacctttcctcactcatcatgagggtcacagctgacacccctttaacaaaagacaggttgatgataaaagcataacaaatgtatttcatcaaagttttacatgacaagggagtcttcagaaatgtagacccaaaggcccagggaagatggtctgtttctatgctttggtctgaggaagaatgggcagctgtgtagaaatgtgattggacaaaaaagggtctgatctaatgatgacagactgagggggtagacagagcaaggcctgtctgttcagattcttcttggcctccctatagcattccttcctccaggtagggggtaggacccctctgaaatgaagggttttagggagaagggagagaatgacctttctaggttttatggattgctttgggagagaggggttctagattctatgacctgtcttgaggaagaggaattctggtttctgtgattccctttaggggagatgggagacaaggagggcaggagaaggtcagagaaagactttgcttctgaggcagctctgaggctacccaatatcctttagttcagagtactcagcctgccaaagcaccatagtttgggatactgttttctgcgccctggcacttacaagttaagcaactcacccagggtcatagagctaacaaatggttggaccaaagttagaagccaggtcttactcatttccaccctgtttcaaggactctgattagatgctcaataagtacctactgagtgaatgagcggccttgaaattgttttctgaggctggggaactcttgccaggaatttcaagagccactgcttttacacttggccacttaactttgctccctagagctttagtttctcttcttctacacccaatatcatcatgtctactgttttcttcctgagtcatatcctctcattatgttttagctatggggggtaaggatggagaaaggggagagtctcctggtgcttgtttcatgtatcttattcccttgacctggtccttgttcccttgaagtcttttgtttgtctgtttgtttttgagacagggtctcactctgtcacccaggctggagtatggcggcacgatctcagctcactgcaacctccatgtcccaggttcgagagattcttctgcctcagcctcccgagtagctgggattacaggcacctgccaccacattcagctaatttttgtatttttagtagagatagggttttaccatgttagccaggctggtctcaaactcctgacctcaagcgatcctcccacctcagcctcccaaagtgctaggattacaggcatgaaccactgcacctggccccttgaagtctttatagtcgccccaaagaaattaggctaaacttaagaagtcactgcttctgtagatctaaggtggctgaatatcggccacagcatacagttcaaactaatgcagtgtatctattaaaggttataagaagatacctacaaacttccctcatgggattgttgtgagaattaaatacatataatacatataaaggacctctagtgcctaacacattgtgagctctcaaaaaaatataaatgttagctcttgtcattatttttgttaatccttgactggggtactaaaattcctaaaagagagtaagccaagaaaaatatgttaattattacagcaactaatatttattactatgcatcaagccatttttgtaaggatttttcatatattaattcattattaactaattttcatagcaatctgatgatgtaagtgttagccccattttacagataagaaggtgaggacagagaggcgaagttggggagcttgggatcaagtttctggttctagaacctacgttctttcataaccatcactgctctgaaaaagagtaagcaccagacctgaaagaaacataacagaggccgggcgcagtggctcacacctgtaatcccaacactttgggaggccaaggtgggcggatcacgagatcaggagatcgagaccatcctggctaacagggtgaaaccccgtctctactaaaaatacaaaaaattagccgggcatggtggtgggcgcctgtagtcccagctactcaggaggctgaggcaagagaattgcttgaacccaggaggcagaggttgcagtgagctgagattgtgccgctgcactccagcctgggtgacagagtgagattccgtctcaaaaaaaaaattaaaaaaaaaaagaaacgaacagaaatgttgttagctccttctcacttttatctctagtttgaatgagtgtgtttgtgaaaggcaaatgcctctggggttcttgcacagtcctgggcaccactgggaggagagagggcaacctagagacatttgtgttcctggtaaacaactgaaaataggcggagcctttgtgcactgaacccagctactttcaaatcgcagtacttcccaattgcaaacttggtgcaaaaaaacctacattgccacagttgagactttcatgaggaaagattttgggtacaagatagtttttcataccgctttgcttacccctgagactgcaaagtaccatgtctccttgttttatagaagccaaaacaaattctatcgataaacagaatttttgaaactctggtattttcagaaatttgtactgtgcataaagtaatggtttggtgaattaacataggtgattaaacaataaagtgatgcatacccatttccatagaaaatatatgcatatataaaaggaattttacagataaactgtatgatatatctgttaatatatcatgttttattttcagtgtttttgtgtattctcagtgtccgccagtatggagacaggctcatctccaggtgtgcaggctctgagtgaagggggcctcctcattggagtgtgcaggggcctcctcattggagtgtgcagggctctcctgcggcggcgcccactctgtgtccttcttccctgtttttgtttgccaccttgtggttaacatagctctgtggctcaaggaggagggttgggccggtatcatctctgaaggtaaaatgcatacatgcgatgctgtaacacagtctttctcccggcggggagtgggagtgtgtgtgcacacgcgtgtgtgggtgcagtgaaggtggagttgcccacttagtgagactcagagtctaccctcaaccactgtgcttctgtgtgctcccgtgtaggctggaagtcgtatcagccgctccattgcacagagattgcagagaaggggccacatcggtcagtgttagcgtccacaggaggaagttgtgtggtgggaaggccgcttctggctggactgcaggcttgtttgcccacacgcgccccagtgagagcgaggcctccacgggcttccttctccagtgcggggagtgtgtggcgaaggaagtatctgctgctgagctcagctttgcttcgccatgttccttcccgatccgctcatcctaaccctctctccttccgcctccatcctccctgctctccgattgccccagtgtgtgtgtccccttccccagccacccctctgatccctgactaccctcttctccctccctccctctgcgcccactcctcatcgcgggcctcaggggagccctgtctccactcaagacacccgtgaaacagagggagacactagcagtcagcgggcactttgtggggagggccaatttagaggacagattgaccagggcgagcagcaggatatctagaaagacgctttgcttctaaggagcgggagcctaatcccgttacaggctggagggagactcctggggccggcaagcctccttcccgctgtgcctggagggatatcattggaggaccgccgggcgcggtggagggctccactcgccagcagccccctcccccagccccttccactctcttttcttttgcagtgacacatactgcagtgcctctgaggtcatttgtttcccacagcctcacagggcgctgtggcaacaagggggacaatgatctctcacaggaatgatgggaggccttgttttgccttaaataagccccttcaagggagcagtaaggtctgttgtgtgtgtggtttgttttttcagaaaatcctcttgcacgtagttccagtgtgaagtactctggcaacttcaattgaagacataaagaatcttatgtgtgtgtgtgagggtttaattttatttttattgctgctttgagaccaggattgtgttttcccttctgccagttacccttttcccgctcaagctccctggacctccgcattctttcaatagttttagggcaggaattggcaggtgttaggggcagagagacgcccatgtctgggtgctggcttctgactgcccttagctttggtgagggagtgaaggttagcgtggcaggaatgtagtgctcctacacatttctcatcctatcctgggtctgaggaaagcacagggcactgggtggctagggctgggattcacaacaaagtgacagtggaggctgagggagacgtactttatgggccacctcggaatagatcatcagctttaacgccagagcttcagaggcatgtgcagaaagaaaaaggcctgtaagtagaataaagaggaggcaggttctgtgtctgattcggctgtccggtgaggaaagatgtgaagtgatctctacccacaccctggtaacaccactggaagacaaagaactgtcctgtttgtcttactgctctgtcctatgttttaaagtcttcaagctgctgaaggcagtcccacctcagagcttacatgcgtaaacattattatctgtaaaggcttcctatttgatgaatcatggtgtatcatacaatctagatatttcatctggagaaactgagatgaggcagattaaagtcttttccaaaaccacatgaggaattaatttcaaagcttgagattaaaacctacatcttgtagtttcagattattaacttaccagtgtgatctacaagttctttctccatgttctaaaaaacaaattttttaaggcaatcaagacattttcattctctcatgtgagcagtatgtatcagaaaaattcatctgtataaactgtatggcagtctaaattatatttttaacctgtcttttctttttttactttttataaatcatatcttccactgtttacaaattttgttatgtctttcacatatcagactcaaaaacagttggctttatgattgggccactagaagaaatataatattttttcacttaccttttcatttcctgacttttttttagtgataatctgaatatatttgtgaaatatttaggcaggaaggtgagttttccagatgtttctgttgattattgcaaacacagagcaattcaaagactagtgtcgctttttgataaattaaaaatactttttttgataactagttattcttgactttaataaacattcctaagattaattcttcccttaacaactttagtgtaattttaatttttcacaaatcctgaagtgggagtactggaattttggagaaataaattaacatgttgccttatttctctggaccatctgttaatgcttattctcaactaaagtactgttcatcagcttcaagtaacaaacataccatagacaaatagcctatgtctgtgacggtgataagacattggccaaatcatcctctctctgaccatgacaaaagtgtaccagtcgtagctaaagcaagactgaatctatttggtattcattgtaaaggaaacaacaacaacaaaaataactaataaaggtctgagacaagatgatggatggcaaaagaaccccctatggtcataaataagctaactttggaaatgtttgacttaaggaagtacagactatgcttagtctgcctcgtgtccctggactaaagcagccttgaaggctcatctgaacatttccccaggggtttcttgcctattgacaaatcccaccacatcttccagatgcacagaagaaagttccgttaaatccaaaatggtaaccaaaaatgttgaatagcaagaaactggcaggggtggctttgggaactggtaaataaataacaggcttgttgtcccacaccctagtttaatgctctcaagaggttcttatgttgctcgcattagtgggcatgtaaatgaaacccctgttggccttggcagatattggcctcttccgtgaccttgtttgactgaaacaaaaagtcattggtggaacaaaaattcagagctctgaacttggttgaaagaaaagggcaattctctgaattgggtaattggatcaccctcccaagtgccctagggcttatatcaaacatataagaaggggattaataacttcagtgtataaatgagcttcaggcagcttccaactgtaacatttcactctcaggagctttaggacataacagatttttttcagagcattttgaagtgctctttataaaatgcaggaagggactacagactactgtggaatctttgtaattgtacatggtccagtctgacaggcaggcaacccgaaagcctcttcaaaatggccacttaataaaactgttcatgaaatataccattttgggactgaaagatgatgacagtgatatgttttcaaactgtacttgatattcccttccttagtcataattttatgatctagactaaattacatgtatcattgagtgtgaggattccaagacttgagacagacttacgtatttatgtgtgagttgtaagggaccattggaaaagctgagaattttaaaattcatttatattaattaatttgttcactcagtatttattcaatgcctactatatatcagacttgaggatataaaaaagtataaagtagagcaaggctgacagacatttgaaaggcaggttcatgaggattgaaggaacatgtgggaagggagccattacttcttaggagtggggaaaatccagaggagactagaggagataacgagagatgagtcgacagcacaggaaaataaagaagagtattccaggcggaggatacaacacttgaaatagttacccagaaaagctggcctggtgattaatcggcccagataaaagaggtaggctaacactgttattcgtcttttaaaggagaaggatcaagaagcagttctgttgggtcctgaggaagtgggattattagtgatggacacaaagtgctggtgtcacagctgtggtagaaaaagggaaacaagagaaagcttctgaaaaaaatgttttgacaactatttttatggctgtggacatcctgagacctctgacaatcacatagaaaagagagcccatagggaacattttagaattgattcttatcttaatagctatctttttggcctgtctggttgccaaaaagaattagcagaattctgctgtttatgtattgctgaatcagtttacaggtgatgttttattactagggaaatattgctaaagctaggtagaggtgcttctaagaactaaagcaccagaaacctaattgggaaaggaattaactttagtcatgtacatattttcatttttctcctttaatttttatattaacagaaaccctgtgaggcaggtgttttacctacattttcacaaatgagcacacagcctcgaacaagttaattcctcagaatcccacagccagtgcatgctaaggcccaagtccccttcatcctccattctcccaccggtcatagctaagtcttcaagctaatgttcacctgccagagtaaaggcagaatatttgaattctcttgtatttgttttagtttagttattgactatgtttttcttcctataaagtaaatatgtttcattctttctgcacaggttttcctataatgcctgggtgcttctagctagagagggcaaattgatttcatcttccattcaactccagaaggtctatagtggccgcttggactgctgtaatggagttgctcagcagccgctcccatatgctctatgatggggcagtggtggtacaagtgctgcatccctgctaccgaggctgctgctttagtatctttacttcactcttaaagtggggaatgagagaaattgtctaaagtcctaacacaagacagccatacctacttcccaaagtagtaaacactctgctgctgcatgtagaatgaaatagagcagtgaaattataaaggagatttgcagtctaataattgggagggaaaatgaagtataaggctaaatgaagtagactacaaacacctgaagcatgactacaaaatcaagttgacattttgtggctcattttcagggtagctgccggaatctggttatggtcgttgtttttattttttagggttttcccccatctgtgtacagtgagatagcaaccacaaaaaaactaacagccttcctgagtctcttggctgtagagtacccagctcttttccctgaagcttgccctgaagaggcctggtgatacatccctcttgggagatgtgacatggttccatattgacattacccactgggctcattgcttgagtctcaaggttgtttatgtatttgatgtttcatttaaaaataaaagttacttacggcaaaaatagcctagtgccagtgggtttggctattgtaaaatttagaaacccatttaggaaaccaccatcaggatcttgttggtgctgtatcagcttgggcatattgcccttcagcacaccggctcttgcacagattgcgtccactgagttgaattatggaaaccttccgtgagaaaatgagagcactcaggaagtagtattggtgatccacaaagcattgctgtgtcctctaaggttctttcctggtctcataccatggtttcttcctgggtaaaaagtgaaactggggttctgcctttctcaagggaaaacgtgtttgctgcttggctttggaattttggggcaactcagtcagtgacatttctctttcacaaactcctcctgttctttcaaataggtgccatatctttcactttccctatcgatacttcatatgttatgcctggctgctaggtttcattccagagcctcttgtgtttaagtaatgaatggactaatcataatgactagctcagtacaggttgctgagttggagaccatggcctagtcatttctctgatcacacagaagtcatttctggacaaaaagtgctacatactatatatctatatctgtctatatatttttttcttgatctttcttctattttgtgctgcaaaaacaaacttcgaggggatgattctctcacaggatatggaaatggccttggacaatgtccagggttagtggcacagctgctgtttcctgcaagggacatctcaaatccagaagggaaaaaagacaaagttaaatatatagcaggaggataatgactgaacctattaacccatttatgcctagtgttccattagtggaacactaagcttgtgggagttatttatatcctcatgcttaagctcatcaccaaggtctgatttttcacataaaaattttgcaacctctggcataaatgggttaacaagaaggaagggatttgcctgttacaagatctgtctgtaatcacatatagccattggcagaaattacagtttacatttagaagacatgtttaaaactctttaccaaagggcaactgatccaataataatgatagcaacaacaataacatctatttatggcacctaataattttaaagttcctttgtgtacgtagttttatattcacaacaacctagtaaggcctgtaagttgactggagagggctagggtatgtaaaactaggtaaagaacttggattttatcctaagcataatgcaaagttttcagccagggatggacatgacttgactgacagtttaggaagattacttggcctgctctgtaggagtatagactgtaagggggccacatgaaagccaggagacaagtcagcaaacataacactaatccaggagagagattatggtggctcagactggggggtgtggtataggggatggcaagtggtcagattcaagataaatatgaagacattccttacaaaatctgcaaacagattgaatgtgaagtgtattttaaaaaatgaagaattggccgggcgcagtggctcatgcctgtaatcccagcactttgggaggctgaggcgagcagatcacgaggtcaggagttcgacccaatatggtgaaaccccatctctactaaaaatacaaaaaaaaattagccggacgtggtggcacacacctgtagtcccagctgctcaggaagtggaggctggagaatcacttgaacctgggaggtggaggctgcagtgagccaagactgtgctgctgcactccagcctgggcaacagagcaagactctgtctcaaaaaaaaaaaaaaaaaaagaaaaaaagaaaagaaaattaaaaaaaaagaattatctgtgtattttttatcttaaacaactgagaatggtgtcattttttccattcctagagttatttaggccaaaaaaatctagaatgttgaagagaacagattggggtgggaggtgcaggttaggggattaagagttctgtcctagagggccgggtgtggtggcttacgcctgtaatcccagcactttgggaggctgaggtaggcagatcacaaggtcaagagatggagaccatcctggccaacgtggtgaaaccccgtctctactaaaaataccaaaaattagctgggcgtggtggtgcatgcctgtagtcctagctacttgggaggctgaggcagaagaattgcttgaacgcgggaggcggaggttgcagtgagctgagatcacgccactgcatttcagcctggcgacacaatgagactccatctgaagaaaaaaaaaaggggttctgtcctagaatagttgcatttgagatatgtaagtgaccgggcgtggtggcttccagcactttgggaggctgaggcagcaggattgcttaagcctaggaattcaagaccagttacctgggcaacaaacacagtgagaccctgtctctacaaaaaaaataaacaaaattaaccaggcctggtggtgtgcacctgtagtcccagctacttggggggctgaggtgggagaatggcttgggcctggaaggccaaggctacagtgagccctgattgtgccactgcactccaacctaggccatagtgtgagaccctgtctcaaaaaataaataaataagaagagaaagatatgcaagtggacaatgacaaagcagctgaataaatgagtctgagtctagagctcaggagaatgggctgagctgtagtgagaatatggcagagattgatcctggggatacatcaacatttagaatagaagagaaacctgcaaaggagactggcagggaggagaggatcaggtgggaagaaatccatgagagtgtgctttttctggaagccaagtgaagctaatatttcaagaagcaaggagttaggtccagtgctgctaagaggtccaataagatgaggactgagaattgacccttggatttggcagatacaatcaatggtgaccttgacaagagtgatttcagtagagtgtaggggacataagcctgcctggggtaggttaaagagaaaaacaaagagcatgttcaattctttaaggtttttcactacaaatggaaacagtgaaatggagtggtagctggggaagtcaaaggaggttttttttttaaggtgggtgttttttatttcgcattttgatattgatgtacataatgcagcaaaaagagaacatgtagtaatgctggagaggaaaggataggtaaccattggtaaaagacctcaaaggtattagaagggattgagatgctcgtccaagtgtatgggctggccttaggctgaagcaagactgcttcaagagatacaaaagcaaattcattaccctaagaatggagtacatcacagcaggattcctggagagaaacagaaaagagggtcattaaaaacttatgtcaccactttaaagagggaagaaagttctgtttggctcttttggggactccagaagaaaagtaaaggtatactcataagcccaactttttaactttctagttaccagaacaccaaacaaggatcttagaatatcagattttcaattaaccctagaaaactaacagcatttgagtagaattcaaatatatgtgagagaacataatacataaataccatctgggaagttctctaatcaacattctccttccctagcactcactgttggatctgtagtacatgcatatgtgagtgaagagctctttcacaaatatgaaagaagcatagtatggatgtagggtgatgatttacttagtgtggtaagtgtctccaagcaacacagtaagggacagaaaaagctgggccagcctgcctctgggagagacatgccaagcttttctatctctgtgaatctcacaagtaaatgaaaataagtgcaagtagtactatagtaattaaatcaaactatcttctttgagagtggctttgtatgtgtgtccccattatttgctaatttactatttcccactgcttactgattaccctgagtatgttgcatttattgtcctatttaatcctctaaactctatcattgccattttacagatgaaaacatagaggccagagaggtttaaatggcttgttcaaggccacatatctaggaagtgggagagtcaagattctaagtttaatgcccatcaatgatagactggataaagaaaatgtggcacatatacactatggagtactatgcagccctaaaaaagtgagtttatgtccttttcagggacatggatgaagctggaaaccatcattctcagcaaactaacgcaggaacagaaaaccaaacactgcatgttctcagtcataagtgggatttaatgatgagaacacatggacacagggaggggaacttcatacaccggggcctgttggtgggtggggggcaagggcaaggggagcattaggacaaatacctaattcatgcagggcttaaaacctagatgatgggttgatgggtgcagcaaaccaccatggcacaagtatacctatgtaagaaacctgcacattctacacgtgtatcccataacttaaagtataataaataagaatttttaaaaaagattttaagttcagtctttgtttccaaagccagagatctttccactataccacactgcctcttatgtagtcagtgataataatagcttggtcatttgcatttgtgaagcaccttttatttgaagagctgaaactctgtaagccttatctttgtaatctggagagaggaagaaaagaaccgacatttattgggcaccttatatttgtgtgtgatgtaattttaagcactttcataccagacatgttaattatcttcattttaaagatgaggaaatgaaactcaacaaagaaattaagtaaattgcccaatatcacacaactcccatatagtcaatcctggcactttccctcagcagattctaagcaccgttggagcagagagcaagtctgtttttaatcattctgattttcctagtgcctaggacagggtctcactctggcacataataggtgctcagaaaaaaaatgattgaatgaataatgagcaaatgtgctgtaagctgaactggaatgcattgagtcttgtgttgtacttcctggtatcttccagtggatgtcaacatgatataatgagaagattctgagaaggaatcagtgaaggcatgcatgttcctgactgtgaaacttttgctcttctcagagctatacaacctaggtgatagacttccttttctttcattgggaaaactgaggcaaagtttccttggcaaagattttgcaagtcagtggacaatttgtggcacaactgaaatcttgagattctcacctttatagccctaaccacttaacaaccctgtggtcctggtggggttatagctttccataaatctggtacttaatcatttaaagagatggcaatttatcttaaatacacgcctcattatagatgtgtcacacttagcacagatggtctcagaagtttttcctggcttcccataccctaacagtatctagtatgttaatgtcaatattagctttactgttttaggtaactttggtatgcttctcattagctgaaaccgtaaagagctcagttttacctgcgctgagggatcactaaattcctattggcatctgaatgcacagtcccatgtcgaaagtgaggtcatgtttctcctggattatgcccgtatctgatgagcctcggctggcgtgaatccgagacaatgaaataatcacacccattagctcaccagggccctattaagatgtggcctggctttccatccatttctcctgcttggaaaaactgacacagtcatggtttgtaaaggttagtgcagatggaactgcttcaacaaccaaaacttagcgttaccctatttaaacttgggaagggtctgctgcttaatcttaagaaatagcacttcaggagccagggtgtgaggatgtcctttaatctctttgtatgtgatggtaaagctgaattttcctaacaccctccttccccgctctcagcttcagtggctggggtgggtgaggtgggggagctctggagttgtggtttccatactttctactttttattctatttttctttagagatcccaggttttgaaggcttgagtctagtaaacaaactgtaatggttaaatcacgattttattttctcgttgacacctagtgtgtgttatatgcagcgtcctctgcctcatgtcattctccaatatgctttctcagggctactttcccagaccctatgccttcttatgggttgtagctaacagttacacttccagagtatgccgtccctcacccacagagctcttctcacaactgtaactaactgattatttgtgtaactgtttgcatgtttaggctgtaaggatgcagaccatgtctgtcttgctcacagctgtttctctagtgcctaagtctttgcttgatacatagtgggcacttggtaaacatttgttgaatgcattaatgaatcagcttatttaattctagtgaaaaatataaagaaatatcccccttatattggcttggggagccttattctggatatatttgataggatttttgaaatgttgtcaacaacttgaatgaaaatcaccaagtttaaaatgaaggttcactctgggcaggagagaagatgatgctattggagaaggattacacaagaggcttctggaatattgataatattctatttattaagctggaggactcctagggacccaggggcctcagacttactcctgaactggagggacatgccaaataagccacctgctatttatttcacgcacacccaaggcaaagctgttggggccacttaaggattttgtaaaatgtgagggtgttattaaagtaggcttattattttacagctcttatgattgttcacctaactaccttgaacaatactgcaagtatttttctctgctcacatatttggagacatgcagagccacttcaaacaaaccatcctgacttcccatttgtatctacgacctcatgaacccatctcaaccccccaaaccacacactgaaactaagccaaattaaaaacaaaaaacaacccaccacccagcagtatttagttgagcacctactgtttgctttgtattataagctgtaattacaacagcttgagtcttgtcctcagcttcctgaaatctcccagtggatggcatcatggaagaatgagaaagttatccaagaatgaatggtctgatgtcaaggaagcttttcagcctttcctaatggtctgatgccctctgtgtgggttacaatctttggaagtataagatttcttgtaaaagtcacagcacctgccaacatagttgggcagggacccaagtggggtgacttgtaccgcattcctccctggtattcagagaccacatagtaccagaagcttgctaggcccagctcctggggactgtcagaggaacaggcccaggcagtcttctcctcagattgcaatcaaaagttgcttgataaatcagtaagattgaaaatattcttggcagtttacataggcaatggtaagaacatgtttttttgtagttacaatgagtacattatacaagggccggaagtgaccaaaatcattgattggctaattagacataactgaagggtcataatgcttcagtcgttatgtgggaatattcataaagcacttgagttcagctccaataaagaggagaaatgtacccagggaaattgcagagtaaaagtctgggaatgtagatagtataggatgttacaggtctgaaatggaagggtttactatattattgagttttgcaaacagattcttggaaaacagattcctcaagtctttcccagctttcagatgggatatgaaactagaggctttagcctttacttgtggttgtctaaaaatccaccctatttttcttaggaagggaagcagttgccttaacaccctggccagattcccaacatgtacagggtggcccatttaaaacaggcctgtggatgcttcagagtgagcgaaggggtttgttgtaaagcaccatgtgtatgtgggtgtttaatgaatatgagctgattaaattggccaccctgaattataacctcataccttctctagttcctctccagtttttagctcaggaccatattcttcctactttctgctcaaacttgttagggagaaacgttcccactattaaaactgccagtgttttccacccagtgtttctttgtttcaacgatgagcagaagaatccagccttggaaatacctttctttcaaattgcttgtccagctgcaatgacgtctgcatcagccacacccacatcacttccccttcgaaccttctcgcctccatctgcttccctgtctctggtgtaggacaataccagtatctgtctggagcagatagtgaactctgccacaaacagaggagggcttgtgtgaagaaggaaaaagctctgctttcgaaatcaagcagcctgggcttgtgccccgtttttgctaatagccatctgtgtggcttagggagtcactgtcttcacaggcccgagttccttcatctgtaaagggaaggagcgagacaaaatcagcacttctcaaattgggagctgtagattcttgaggtctgcaagtttaatgagattttaaactttttatgaagtttttttttaaatcataaagacaatactttgcaattaaaagtcatttaaaaaaataagtcttaagtttgttaagctggtcattctgaaacttaatcttaggtctcctagagattttttaacagttttgcaagtctcaatttttcccctttaaaaggactccacatatcactccagtttgagaaacactgaactcttttcatctactcagaaactgaatctagcggtaggataaaacattagctttaactttcttatccttaccctactcaacctaattacttttggcccacttcaatatgtttaagtcttttagcacatgggctccttttgttttcataactgaagtatttcctgttttcaatcactatatgttaaattataaaaagcatgtttctcccaatagctctttccctttccctttaagactcagatcatttaatttattagtgcccaacctggttaattgagaccaccttcctctattaatgtttctttgttggttgaagtgaagagatatatggtctgttccctaagtacccatgaaggattggttcaaggactcagccccatactaaaatcttcagatgcccaagtcccttatataaaatcacataatgtttgcatataacctatgcacatcctcccatatactttaatctctagattacttataatacctcatacaatgtaaatgctatttaaatagttatcatgctgtattttaaatttgtattatttttattgttatattgttatttttcattgctttttttttttcaaatattttcaatccacattggttgaatctacagatggggaaaccctagatatggagggctgactatactgcttttatctgtgatctcaagattgaatactcacagtagtttatgtatgcattctgctttcataatttgcagaatgctctcatatacattatctcttgattttcactgcagtcttgtctaataaatgatgtaggtagcatgatccccattttacagatgagacactcaggcccagaaattttgcttcatatcttctgattcagtctacttgttctcccaacaatgcttcttcatccaattacagcaacaaatacatactaggtacctgttatttgccatatgtgctgctttattgttacttgttccgggaaataacaagtggagcttctcattcaaggataaactgatattgccaggccttgctcagtctgacataagtctcatgccattatttactaaaatagctagctactctcacccagtccggttcctggtacataaaggaactcaataaatatttattggatgattgagtgaatgaataaatctaaaataaattatatcattaattaaaatttatatattggagataatttttgctaatagatttttgccaacattttttcagattccaagtcaataggatttactcagagactgccaagtgctttaaggggaaaacagagggactgctgggagaagggggtgcactggtagacaagtagaggaaatcccctttctggcttcatccatcttcctgtctatgatcggtgtcctaggccttagagtggacatggagaatggtatcactttgtctgcctgcagttaaccaaaatacttactcccaccatagggagaagagaggaatgacagaggtatgtgaagattaagtagaaagaccgacaaatgtaatcacattggaaggtagaatggagggtagaaaagttggtgggaagacaatttctgtggtcaggatacatctgaatggaaaggggagagagattttgtccattcctcccatagtatggtttggctactttccctctacttcccaagagaattattagtgaccagggacatcacattttaatcaaggcaactgttgctgggctggtaagcaaggctcccatgggtgtggtgaagttagcagggtgaagagtgaggctgctagtcacaaagggatccactcaccctcttccgctgttggcggctgctgtggtatctataaacatagagtgtgtactcacatactcataaatgctagttattgtcatacgattgcattgtgtataaaagtagattgcctggaaaaaatgattccacttcatttttatatacacattgttcctggaaccacttcctgaaatcccaggcttttattttgctgtcattctcttaaattgcctctttctcaaagcatccgggttctggagatgttctcgtgcttaaagtgtgtttctaagtagcttctgggaaccacgtaaaattgtctggctccacttgaccaatgaggagcttacttttcctcccaattattcctctctgacagaggccgttggtcatcttgaaaagctaagaatgttagatgggaccaaagtaaaattgcaaagcctattcacccagccaaactgaaacacacctgattaactgaccacacacatggtctcagaatgacatctcacttggggagtaaaagccaacagttgtggttagtgccccagcaggccccagatggttagagttaatatacacctatgttttctgccaggtagttttcatcagtttcctcaggatgtcagtgtgtgtgtataattaagagtatttaatcatattataattccccacagagagatggagtgggggatgaaggatcgctggcttttacagtctcagcaagagtcatcagtggaaaaaaataaaaacagaaaaatgccaagtctctgggctgtgcctgtgccataactcactcagaagtctggctggcaccactacctcagtgtcatttcagtgaagatgtaatcccaaatcttttgttgcaatcttagggttctcactattttaacattagcttagaacatgtggattgcaaaggaaaactgtgttctaattccctgttcatcaaggctgtgatttgtgtacacccacataaggcaaccttcagtttataagactgatgacttcagtcttgtaaaaataaatgagatgggcacttcaaatattttaagttagatcaatcagtagggtgagcacagtttaattggcatctattgatacatttctaaattaaaagagcagaatatagagccatgaatcttagccatgaaatcatgttcacatttattacaaatccataattctttcctatttccccatatatcctgttttctttgtcctgtcaattgtcaaatttagctgctggaaatgatctcttattttggattaggaaaccaagtcctaatgaccgtaagtgacttttcagagtcacacagctagttagctagttagaatctgactcaccagaattccagtctttctactttgccagatagtctttactgggaaatacttttttacctatttcttagaagaatttacttatgtgagcttcacttaaagcaatattggtctatttcctagttcccttaaactgatcatggtgcatttctgttaaaaaagccatagagttggccgggcacggtggctcacacctgtaatcccagcactttgggaggccgaggcaggcagatcacaaggtcaggagatcgagaccatcctggccaacatggtgaaaccccgtctctactaaaaatacaaaaaaattaaccaggcatggtggcgggcgcctttagtcccagctactcgggaggctgaggcaggagaatggcgtgaacccaggaggcagagcttgcagtgagccgagtttgcgccactgcactccagcctgctcaggcgacagagcaagactccgtctcaaaataaataaataaataaaaagccatagagtttctttataattaggttctaacactacttcttcctattagtcaataacagtgccacaataagtggattgggttaaaatgaaaatcaccaattgagtctctacccaaaaccccttccagttgctcttatttaggaggaaacagcttctgctcagtttctgtccactcacaagacctctcctgcatggaaccctgtccacagtttctatcactccacctgtgcttacttcagattatctctgaaacaatcagatgtaatggccagtggatgcaaaatacatataaagtaagatttgggattaggaggctcaagggggatggatatgtagagaaaagacctaggaagaacaagaacagggactggcagaaaacacattctgagacaaaggccatttatttagctctggccagttggtttatctagcctgacatttctcaacctgggcgctattggcgttttgtgccaaattattcttgattgtagagagctatcctgtgcattatggtatgtttagtagcatttctgcctcttcccactgggtagatgccaatggcatcccttcatttgtgacaaccaaaaatgtctccagacattagcaaataccctggggagtgggaaagggagagagaggaagaattgtctccggatgagaatcactgatctcactcaaggttttatctttgacatcagcgccataagatattttgtgagaggacagagtggcctttctaattcttaaaagttagggttctactccagacattccttatctactgcaaatacaaattatttatttgttcattcattcaaataacagttattacagatgacactatgtcaggctctctgctaagtctaggtgaaaagacagaacctccccacaaagacttagaacttaatactcttaaaaatcctagtcattggagttgatttgctcaccaatgctaacaaagttaagactttgaggttgtattcccttatctggctttaactcagaccaaccatttcactgattggaccagcacaatgtatcctggctactctaaaagtcacttaaaaaaacatatcctactggtggtatgttgatagtttcctgggatatgaaggtgggcatggttaaagctgaaaggactcttagcgacaagtgaaaaaaacctctttggtaaatcactagcatagtattacatggcttttttttggcctgggtgcagccccctttagactcaaaccactgttcttcctgataacacatggccttatttatgttcattgtatttatttagcttattttgattcctctttctacataagaaaccacaactggaaaaatcaattaatttttaatttgctcataaatttctacccattagaaggaaccaaggactcttgtaatttggcacaaatttcctttcagtatttttaatctctttggatatgtgtgagttgaattctctttaaacaacatgaaaatatataagctatttatataacttttaaaagtatcaaagagaagactctaacatccctcactgaagcttttccagaatttaccatgtgtaccagtgtaccagttgttctcaacccagggtactttgcccccagaggacttttgacaatgtcacagatgtggagggatgctactggtgtctacccagggacaatgctaagcatcctacaataaacaggatggtccctccaaccaagacttatccagcccaaagtgacagggtgctgaggttgagaagccatgtggtatataacacagatgtacacactggaggaaacgtcactgaagtagatgctggtcacttaccagtttcactccttcaggatatcctcttctttaaacgaggaggttgtgactagttacttcccatgaaaagcagctgacccttagggttgaaaagtatgtttattcccaatagcagtgaatgaaaaaaaaaaaacacaatgaatttctacttgcaagaatgccatctgtggttttctccaagtgttgctctcagccctcagtgttcagggtcttcttcacctgtgcattctgctgccctgcgttatcagagttagaatcagggtggaatacaaatatttccccaggcat[450 bp omitted]tattttcttccggaaaatcttgttgtttacgtggttggaactttattattacacagattattataaaaatgaaccaacactcaaaagtacaaggcaggatttcccacaatggctatgtcctggctggccttgttgctagctggcacagtaatatgccacctggaagcaatgaccattggaaaagaagccaggaaaaaaccttatgagaggcacagggcagtagataatttgtgaagcggtcgtttgcctcccagagtggcaaggctggcatgtctggcctaagtgtacactcacgtcatttatcacatcctctggtagcagcgcctctctccactgcctgtgaaggaaactgttgcacaatcctgaagatctgactgaaggaaagttgtcttgggatcagaattaaggttcctttttcttgttttcatttccgagttgcaagttatgcccctttttagcgtttccatacccagctgtctacattttaagcaatcgttatatggaattatatcttaaatgtaaaataacaagaattcatttaaaataactgctttccctccagaaccagaggtatctcaccaaagctgtcacctccccaccagtatactccaattgtgggtgacagttgtgtttagaaagtggtgttatagctccttttatgtaggatgattactctgtggccatgaccttctgggatgaacggaaagggctggacagagttacacagcacgacgacagaggagaagcttgtggaagtgcattgcaaacagagatgggcgagttaagttactcaattgccatctgcctctgttttgctaactcattagttcggacaccacattgtgttaatccccacttccctggctctgagcttggtccaggtctcgggggaacagtgagactgctcagctcgaccctcctgtcagctgggcctcagcttctctgcatcgacagcatgccaggcctgccaccctcgctgccacatcacatcaaggtgaagttttctccccagcccctggcaacagaaattgaagcctttggacttcgctcattcttccaaaagacttttctaggcagtgggatagattttcgccttacaccccctagcactctcttcccttccggcactccttcaaggcaactgcaatttcaggctgaccatcttggaagtttgatggcactgagtaccaccagccaaatgctctcacattttctgtgcctctcagaagaagagcccatatggcagctaagaaccaatgagtgaggcctaatttgtcccccaagactatacgagaagggcagtcttacttctggacctaatctagcattacgagcatccagtgatgacccttacggtactttctgagagtagttgctcataatcatcattgtctctgctggtgagctgactgggatacgcaaattgttcctatcaatttattttgacctctctggacttcagtattctatgtgtgaaagggtattttctgagaatgattagataatttgtgatgtctttttcagctttaagtatgaaaatgatatgctaattttatatgttgtcagacactactctaggcatttaacatatgcaatcccatttattggtacccaggaagtagacactattacatctctgatttgcagatgaaaaactcaggcactgagagattgtttgttcaaaggcaaaggtaataagtgacagcccagagattggctcccgagtctgtgctcttagccacttgtggtcacttaagatagtcccttaatcacttcattgctctatttcccgtcttctttccaaagtctgtgggttctcaaatgtgatctcatcaacatttagggcagtatcctttggaggttattgttgcccccttttttacaaatgggcactttgagataaaagcaggccacatacaagctattggcagaacccaggagtccagcttttgtgctgtgggttccatctgctatgtgtctctcccagtcataattaggatgatcaaaaaattcagatataacctgcttacccctctcaaccagggcaaatcagaaacagctccatagacaattgggttaagtttccaactcaaatgttgaatgatctatgcagaatataaaggcgtttacaagccaatgactgatacagatgcagcaataacatacctttccccagtcctctctttgctgtaaggcacccactgaatatcttacacctctctggatagcaggagttacagcaaattctgcatatgccctcccacatttagcacatgcagggctcatccaagaattttagcagcaggggatgatagagtttgttctctggttctttctgactgtctctgccctgatagtgcctagtacctgagtggcccttcctctgtcctctaatcccactggattgcacgtgccttttagcactggaggttctgaaagccaagcaagaactcctcctaatggcattcagtacctctttcttcccagtcccaggaggggtttcccagcaagcagagggaaggtgattgtttctacctctcatttagtccttcctttccaacttgatggtataccacctgcaaagctatcccagaaacagatgaagtttaggatgcccgaagactggtttgtgacatagaaaaattggaattgaaatgaaactgcacattcattgatatcacctctcctttgtgagtctggacctaatagagtggaatgaacaacaatactgaaataccaaacttatttatgcatttaagtcaccaagtgatttgggtttttgtatcagggatggttgttgcttttccctctgcaatgttaaactactgacccgtttcctctcaaattccagttccacgtttaactgaagacacacagaaataaatgtgtgttggcagaaagacaaaccctgagatgaagcaggaggtatgttggctgatagaaaggctgttattttaatttcttttacattgcagcagtctcagatggatagtatccaggtaacttgtagcgcctgcatcttattaaactcctgtttgattcagaatttacagctaaaatgcacctggaatacttaaagtaggaactagactttggttcatttgttctcaaaagggatgtacaaatcgattgcacaacctacagcaagtggcataaaaaccttcagaataagatgatggcacgtttttgttaataactatatttcttgatttataaattcaacaatgctaatttagtgtttactgtttgacagacattgtgcctctatagcaggatgaactcacaggcatgttttctgtacgtctgtctctttttattgcatgtgacagaaaccatactcaaagtagctgaagcagaaagtaaagttatcacaaggatactggcatatctatagaaactaaggactgggatgcagctgactcaaagaagagatggaaccagtgttaaataacattaagttagttggtctcacactcttacacacacactatctcttacacacacactctaccactacaaccactaaatagctgcactgtcgctacatagccaccacccacatgtagctactgagcacatgaaaggtgccttaagtgtaaaatatgcactgaatttcaaggacagtatgagggaaaaaaacataaaatgtcttaattttcatattgattacacgttgaaatgataatgttttggatatattgtgctaactaaatatatttgacatttattttaccaatttctatttttttcatgtgcctactggaaaattttaacttacatatgtgacttgcattgtgtgtgtgtgtgtgtgtgtgtgtatatatatatatatatttttttttttttttaattgaggcagcctctctctgtcacccaggctggagtgcagtggcacagtctcagctcactgcaacctctgcctccctggttcaagcgattctcccacctcagcctcccgagtaggtgagcttgcaggcgtgcatcatcatgcccagctaatttttgtatttttactacagacggggtttcttttgctgtgttggcccggttgatctcgaactcctgacctcaagtgatctacccaccttggcctcccaaagtgctgggattacaggcatgagccaccacactcagcctggacagtgttgttcttctagttggttttcctaaacatctacagcaacataaatcttcccatgccttagttagcctgatttagttgagaaacactgaagggacaatcagagacatatatcaccaatcaagtatatatcattctatttcatccttttctctctcctttactgtccctcataatttctacatgagccgaacacacacacttctttttgaaagtgaatgtatatattcactcacttcaaaaatacttactgaaccccaattctatgctaggtcttacatcaggcggtgaggatacaaagtccctgccctcacagagcttcctttctagcagcctcagccacttttagcttgttttcatgaatggagccctgatgtgggaagtgcacctcccagcgtggctgcatctggtccaggctgaatgattaacccttatagtgagtctaagttgaatgaaaacttggattttcagagtcgccattaataccatgttgtcaagggagatggcaaacgatgttgttattcacaagtcgggagccttcaatgatgtaaatttgtatttctcttcccatttttatggagccatatttcagaattcagaaatggaactatggaaatatggctctccccgtccccaaaaagagtccttcttctagacttcttgacaatatgtgtgaggaagcctctggattcagttgttttgtttttttaagtaactttttaaatgaagtataatatgtaaacaaaaaagtgtgtacatcgtagtgtatagctccatgaactttctcactgagcacacatgtaaccagcacccagattaagaaacataacattaatagcgcccatggaagctcctccttcctgtcatgaccccatcccacccctccaccctcatcccaaaggtaactaactactatctggacttctacaaccatggattagttttgcctgtttttgaactttatataaatggagtcatatagcaggttctctttggtactattttcttttactcaatgttatgtttatgaagtttattcatgctgttttattaacccatagaaaatatagatagctcccaagaagaaacataaaaattataatcctactacattaatatgtcagtgtttgtccttctagccacttttctatgtatatacttatgttaactttttttccaaaattagaccatagtgtgcatactactttgtgatttgctttgttgtttgatatatcagatctaccaatgtgttctaaatgttggtcgttgtaatgaggctatattctgaattgactaataggtaatacagaaaagtagaaaattattttttaagtacccataagtatttatattaatcattttgtccgatgtagatttgatccgtctcagtcaggcttccaaaagacttccaaataaaggtagcgaacaaatggatcactgattgctagggaaatctggtaatcaagaccaagttgggcctcttgtttctcaatgaatcttctaaatcactctctactgttttaaacctaggtattctgcgaatatgtaacagattaggaactgaataattctgagaatggcttgttagagtctctgttcaactcttggcttactctataatctgagacaagtctgtaaaatgttccttatttctcagacgaagagcctcatctccacatctgtttgggatcataagaaataatacttacataacattttggaatccttgaatgaaaagttttttggagttgctgactgttcctaaaatttcctcaactaacattgtggaaatccattgttgtggatatagttgctgagctaggtcataactagattgcaaatcttgagtagtggaaaaatctacgcctcgaagttctggtcatttattttaaaagctattcatttattcctagatgttcatactgtgagcttagcctgttatcattttggtttacttgctaaatattcacatttggggtcttcatccttacccatttaggattgtatctattggcatatgccattggatttgtctgagtgaggtcacctggaacactagtgttctgacattgagtttacactgcagggatgagagaagtaaatattcctattagtcagtaaggtttgaatttatagcctgagactcctcagacactgactgtctgggacccttggagacagaccagcattgaatgaaactgaaaggtagagaatatactgtggctgggaaaagtgatggagcaaatctatgcagagatacaatagtaggatatttaagagttggaagggatattagaggccctgtggtcatacttcatttttcagttggggaaactgaggcttaaggaggtcacagaatgagttagtcacagagctgggttagaagcttactttagtgtttcaccaactactcagatgtctgcactactgagatacatagagaaagagcgtcagaggaaggattagggtgtcctctagacctcattacactaatgcagtccctggtaggatctaaagacgtacttgtctccaagacacctgacaagctgagagtattgattcattctttcccaacttgggattgcaatggtgaaaggaatttggcattttatctaatcagcattggaaacttggctttcttttggagaattcaaaagttcagtttaggatatgttcacaagatactttcctccagaattaggtgggagataaattattaaatttatgagacttgtctttctttctttctttctttctttctttctttctttctttctttcttctttcctttcttctttcttttcatgtagcatttctttttcacattgtttctgatgacccttaacccctgctttttaaattcagtttcatttgtgttgtcacatatatatcagttgttgagtctttagtatgcggagatgctgagcttgcccttccaagatgttggaaggtcaactcactttatggtctaggtccaggaaacaagaatatttccaactcgctggggaccatcttggccttgagcagaaatgggatctgaattattacctaagagacctttgtagattgtcacagttggcagcctcaggacttgagctaatcctggaaattctttaacttcccagaaagaaggttccacaagggcaggctgaggtcctcagagagagcagatggaatagagcttacaaccagttgcctttacaactggacttggagataaataataacattatacccattttttttttatcatgaagcctttgactttcaggggatatctattctttattccttttaccctgtatgtggaaaaaaaatgctctgtatgaaagaaaagcaagcaaacttgttgactcagttcccatggtgaatgcaaggcagaccaggccaatagaaacaactcagatattacaaaaatgtgtttctttctggcagctgcacagtcagtcctttatatccagtcactgcaatcgccccatcacacaaaaccatttccaaggtcattattctggttgcgggggctgcttcccctacaaataaatgttggttttactaaatgtcctctctctccaactcactttatggcaaatgaggagtagcaaagcatcatttaggaagagaaagtgtagaaaatcagagagatgaaatactacaggttttctaaaggctcaggtttatctggctcaagcaatacaaattacaaactatggcaccacctgtataatctggttttaattaacttgaggaaggtacatcaatgttatttcattaaaatcaaattctgtttaaatggaaaaccaccactacagggtacattggggcattgttcacttgggttttggggttggcaagtaaatcctgtatttagaaaaacccaagcaaaccctgtttttttggaatcttcttatgcttcggaaggcttgtcataggttccttggaatgtagggggtgccctggtgaggaccaaggcacagctcaagatgttgtttgccaattcttccttttatgacccttctagtcttctgtcttcctgctccctgcctgtctccatatctctttagtgcttggccttgatgccctataggactctctctcccatttgccactttgaactgaatgatttgatccccactgggtggacagtggatgacatagggcactctataaacaaagatgctatttcaggcttacaagaggaatgaggcccacgtgatcacaaggggctggtgaataatagaaccctcttttgaaactctcacttcaccaattacctaagagctgggaggaacctgaaagatcctataatctacacacctccttttccgaggaggacactgagattcggaggtaaagaaactggtccatactagtgaaggctgtttgagtggggcctccccatttcgactcatgccctttcccctccagcctggtgccccagttctgcagacctgttgattacaacacagcccacgccgagaaaatcctgccctgtcagcagaacagctttacaagctgacataggacatgtgtgtgtttggagtcaggagaatggctgagttttagttccagttctgcctctgctttgctggcttcagcgagtcacttctccttcctttgtctatttcccctattgggaaggagaagataattaacctttccacctatcaggctcacttgagtgttataaagaataatgaggtgatatttgtaaagtgctttgagctgctgggaaagaggagggggtgagctccgtggaaaacattattagctggaaggacttatcaattgagctatttaacaatagcagagagtaaggatactcagaaatgaattccagggactagccctgctttgaatttaggaggaggattagtgggaacctaataggtattccgcttctccagtttcttcagtgcaccgtcaaactaggaaaggtaattacattcttctatgtcggattcagcccggagtttcaattgggatgtcaaagtgtgcttgtcctctattctcatactgaggctgtgttatggtgtgattgttaaagccttgggcatcttctatcccctggggtaatttcgcttaggagctatacaaagtaatttctatgcagtggctgggctgctgtttataaggttgattagtagagcttctaaatctaaagcgcctggggagcaatttggttgaagcagggaaataaaaggcaaggtctttatcatggttgatctttttttattgagccgctccatgggaattttctcagtgactcagatgcatctacagtgcaaaacgtggggcttggtggctctttgacatggcaatggaggcctagccccaggtaaaggtgaacttgccaggtcactaaatatatttagggcccccttttaacttcctttactctcacagagggtgatgtttttggggccctgaaatgtgtgggaatgtttccaaaagattgttctgatgagggatctgtttctgcaaactcctgccccactgtttgaaagaccgtctgccccaaattcaggtctttctcatttttagggccagggaagaagacagaggaagagaagaactgggggaattttgttttgaacttgtgcagtctctgtgggctgactgaacagtgagccaggcagaaggtggctccctctttagtcggcaggagcagggctgaattttatcaacatcttctgcaggtgtagggagaggtcaagatgtcatttggaatgataatttctctgatcaaagttaagttaaggaaattacagtgattgcatctttgtcccctaaagtttatgagcctctttgtaatcgctgcttccgcaaacccttccccaccttcccaagttctcaggcctccatctgcaggggctgctgggcttttccctccaggaaggacgggctcgccagctggccagaggttcctgtattagtgctgccctgtactgacttgtgagtctccagtaacaatcctccggtgtggcacagctacaagcaatgaccagggaggcccaccttgaatcctgaacctctttgggggctgactcagtcctctgaaactgactcttggattccttcctgggtttgccaccaactcatttttgtttttctcagcaaatcacttctctgccttgagactccatgaaataatataaggtttccttggcaggattctctgacctttttcagagacccagatttcttgtttattttaatttgaatgtctcaatcctctgaaagcatttggaatattttcttcatttccctctcccaaggtatctactttatcccagacagggctcccccagtgggttttgaggggaaggatgctgaggctttgggcccgggctcctgtcctttacttcacctctgccagggcaaagaccagcactgggctgacctccctgggctgggccaaaagagaaggctgtggaagccgcacgtctccgatgctgcccactgtcctttccctctgcagccacagctgcctccagcccccctcacccccgcctgctctttttctcagtgagcctcagcgccagtgccccagtgagctgctgggaacagaggtccgtcccctgcactggcctcggctccccgcaccagaacattcaggcatcaatgggaaacagcaagatctgtcggcatccccccctttcttcaggctttgagggccacattctccacggccatctgttccctttcacctctctggacaatgttgctttttaaagccagcgattcttcctcctttatcccctcctctcccgcctccccttcttctgtgctcccaccctttctacctctcctctctttgcccgattcctatgaaattagcctctcttaagataagatttgcccttcctccatacaaagctgttttgcaaacactatgggtttttgaatttttatttttacattttgtttgaagtgagggcttgctacttttaaagtttgtgattgtcttgtggagggggtagtcttttgatagggataggaagggggaggatagaaaaactttttagtcatgaaaaaagaaaatacagaataataatgagttttaggttcctgctggcaggcacttgcctctttaaagaaggaatcctccctttcctttccttgatgatcagtttaaggaaatttttatgctctcgaggtcttcccaccttttattgtattactattttgttgttgctgcaatgttgttgttgtgctgtttttaatttagagccagggcttctgtggatctggtacagcggattcctttgtcttggacagagccatatacaactccagaggttcctggattcaggcagagtgcccatggtgccttctagatgaagcaatcatcctgactcaagggctggacatcaaggggtgtttgccccaggactgaccagtgactaagtgtgtgaccttgggtacatcactttctttaagaataatgatgacagaatcatttacttcaaaaaatttttaacacatgattcttctgtttttactattacttggtttcacaagcaagacgagtccgtggtaatgtcatgaaaacttatgggttatccttgggtaaggatgtaccaagaatccaccgttagggtctagttgagcagcagacatgggaaatatctaaaacaaggacggactcctggctgtggctgcctgtcaggatcacagagcagggacacgggcaccggcagagttgggctgacagattgaatcctgtctctcctacttactagctatacagatatcagtaaggttttgtcatctataaaataggggcaacactagagatatacttcgtatggtcgttgagacaattaagagatttttatcacgtaaagcacttggaatagtttctggaacctggtcggtactatgtcgttgtccctcttcctatcccacatccacattacagatgaaaacatgggctaacgggttttctgcagggctcttcttagtctttcacattcaccttctgctggttcattttttcattgcagagtgaacactgataaaataaataatgtaattatcagattataatgatgattaacacagcgattctatttagaaatgtcataaaatagtgaaacatcctaagatacagaaagatatatgatcatgtacttctggcaaagaaggtgaaccagatgtggagatgatagtcatagaaggaaagccagtcatgattttggcaactgggatcaccttacatattttcagttggagaaaacctggagatttatttttcttttggtatcaatttctagaaacctgtcgtatgactaagagtttcccaacaatagggagagaacattattaaaatatgcttttctagaaaggcccaaatgactctgaataagaaactgaatattataatttaatgaggaaaagaaaatgaatgggatgtccagaaaattggggcggggagggggtagtttccatgcattttccctcctagaaagggagattaatggccattcttgtaatatctaaatggccaaaagaaacaatgaaaagaaaaataatgaatcagactctggggtttaaatcctgactctgccacttgccaggtggccttgggcaaatcactttctttgtagcgcagcttccttcactagaaaattggtatgataatggtacctccctcacagagataatgtatgtaaggtgtttagcctggaaaacaataattatcccaaagtgttacctcataattctttactgtaatgtcttatatcaactgacatctgagatgtgggacacattacccaaagttggtagtcttgatcactttgcggatgctggtcatttgcagtaaacccatagttctgtctcatttctggataagcattggccttcgaggaagaaggaaattggtttgcttaagaattcatattttgcagatgtgaactgactggctactgacaccaaaaccagttcccccaattaaaataaccctgctagcctcagcacattttgttcatgagctccctctcccgccatgaggcggctgcctgaaagtacttgactgccctaccctccactccccggggattgggacatgcttgtgaagagatacttgaggaagttaaagcaaggtcatctccattgcctaagccccacaccctggtaaactgcacactgtttggaccttgaaacttgtgagctgcgaattcctgtcataaatggagttttcctccctcctgtggccccagtttgtggtgagccttgtgttggcatggtggccatggggacacccctcgtgtgtgtgtgtgtaggcccccaaaaggagaagtgtagcagcttccctcagccttgcctcagaaagccgggtccagatggccaaggaagcacactgcattgaaggaactctgcagccagagtgaatttaccagtgtgggaaacaaaaacgttcgggttctggtctaaaattctgggagcaaaggacactgggattgcctccaccaaatgtcaacattttacttcttcccccacccccttctcagagcctcgagggcagcaaacatatgtgaggccagcattccattccctcccacgcaggaacatatgctgattcctatcaggatcctctgcttcccaaagaggctgatggagatggggagggaggaaagcataaccataaatcctcacactctgggcaaggtgataattgaaagcattctccaccatgacgtgctctccagtgccagggcagcaggcagctgggacagctaaagctggggaaggcctgggccggggcccagctctccctctgaccaggtgaattttggtggtcaagtcacttctctgcctatgaaacgggaataaggattgtatccatgttgtgggatcaaaggaagcactttaagtcaaattcatcagatgcacttaggcactctggagttttcaaagcacctcagcatttctgtcttgtctcacttgattctttttgctcccctacttgcactctgttcctgctgtcactgaggaaacacagcagagtgtgaactctgaaagctgacccttgtttggtgtcttgaagcaatgcaggtcaaggagcaagactgaggaggggccttaatgagggtctctgagtgaggacctgggcccggtaaccagccctggcctgtttcatgcccaggctatcagccgcccctcctaccaagtctctctgaattaatattttgggtgtctcctcagacaacagctccaagcagatgaattatggcagttctaaagggtatttacatctcttctctctattcctcttgggaagcagggtgggggattaagtcagtcttaaaaactggctaaagggcattctccagaatgatgtcttctgagattaaaaggacacagagccacatcacaagatactaggtggagattttctaatacaaatgcatgcatgatggtacatggactgtctgcgggatctgaggagtctgtaattgcaggcaaaacagcaaatgcctaatacatgattttttttcaaatgttagcatatattaggatcatctgagagaggtttttgaaaatatggactcttgggcatcacctccaaagattctgattcatcaggtttgggatggggcctaggattctgcattttacaaagttaacagatgattctgatgtatagaaacatatgaatgccctagtaatttctccagagatccaatcccatgtcttgattttatatcaatgaccaagtaatctctctggaaaggccaacctacattttcccactaatttttttgggggggaaggagagttcaaacctacagaaaagttccaagaaaagtatattgaactccccatataccctttacctgatttttttttgtgtttttttttttttttgagatggagtcttactgtgtcgcccaggctggagtgcagtggcgcaatctcggctcactgcaaactcctcttcccgggttcacgccattctcctgcctcagcctcccgagtagctgggactacaggcacccgccacaatgcccggctaattttttagtagttttggtagagatggggtttcaccgtgttagccaggatggcctccatctcctgacttcatgatccacccgccttggcctcccaaagtgccgggattacaggcgtgagccaccaagcccagctctttacctgatttttaacactttgcctcatttatttttatctcttgtatattagttaccaatttattttataatattgttaacttattataattatctttgctgaaccatctgagggcaagttacagatatcatatcctttcatccccaaatacttcagcatttatctcttaagaacaagaacttctcttacataaccacagtacaatgatctcacccaggaaattagtattgatacaatactattatataatatactggcaatattcaaactttgccaggtgtcccaataatgtactctatggcagttttttccaggatgcagtccaggattagacatggcattttagttgaaatgtctttttgcactaatggtttttaaagccattgatgttctcccagaaaaatttttcttcaagaacatatttcctaataaacaaatcatatttcttttctcttctgttcttactgcttgcaaagagccagtgatccaaagtgggcctgaagcaacagcaggcttacccaggcctgattcttcacaagctaaggcctgggcaaaggaccctctctcagccctgggtttgccttgtgagctgatttcctgaaggcaaaccacatgactgctggtgtgtccccttgctgttcagtcaagtgggtggccacctggctttctccttgtcccaaagtacttcgttggatatgtaaagcgaccaaatgttacttcactgtagtttgaatcttacccagaaagagtgactggtaaaggacatgccactttgcacccttcccagctctctccaaaggcagctggctgaatgcacacttctgagggtgatgttttttccagcactcagggatatacccagtgtgagatcagaatcagcagctgtattcattctgcctcagccagtgccatctgaaacaaacatcaagtggtcaaaaaatgagatggtgaccatgtataatacacaagacttattagaattcaactctggtatccgcctgctgcctctgactctacaatgggagcaggaaagcaaagctcataccaggacagctgaaaggtgtggtctgaggatttcatggtgaacagatagaacacactgtgggggaaaaaaaacatattttatgcaagcatctttctggcttgtcttgaatgaagctaaatttaaagagaaagtgccacagatttctttaaatggttaggtttttgttttctttgttttattttgctagtatttacttaagggtaatatgtgttttctgtaatgagtgaatttatttttaattaaaaacttatttgcaaaggtcaagagatttcactacaagtcaccattcaggattttttttttcctttccttaagtagaaggtagcaaggggaaagctgtattggagaaaaggttcaggggcatggcctcctggagaatgttgggagttgagctgatgggaggagattgcttctttttattcagacaatctagttctgttcttcttatgcctactattgttttccttgccatctttgagaccttgatgatcgacactgcagacacagcagagaatcctagtacagactgaagcttttcgtataaagtgagcatgctcactgtgattctggacagttcctacatagtatctctgtaggataacatatgtcttggttttctcagggcaagctcagtttatctctgttatcccagtataactattaaaatgtccccatttcattttcaaaaatgtcctggttggataagaacttaaagtattttgttaagactctgggaaactgaaggtattttctccctgtccatgagccagtggagttgttgagtgatttgtgctggtgcataccagtctctagcctagtggatggctcacccccgcttctcccctaccttgtgctatggaggatccatccctaactcttgcattccagaggttctgattgcctcacttcttcctgtcttctgcttcacatttcttacctttctcagtaacgagtttgctgagacttgcatcagcctaggtatgttgtgcaagtaaagcctctggactgcattcactcctttcacctccagccaagagacatcaggaatgaaattttctgctttactaaagtgaagcagcccattctttaccagccaaatgccttcctcggtgggtaaatggtattagttgaagcagttattacatagttttatgcctcagatcctgtatttataaatctgaaagacgactaatagctttaaagtattttgagaatctcaaagctcagaagattataaataacaaaagatatattttttcgtatctaaaatggtagcacaaatactgcggttgcttacttaatagatagcgtgtggtccctgagccattgcagctgatgggttttttccagtgctctatttatagagctaggtcagaaatatcacttccgttggaacctgacctatagaccattgtcaattttagagacccaaggaagtagaatgcaccctaaatacagctggttcacagattcagttagtgaaccacaagccctcaaggaaattaattttgctggaagataaatgtctgagcctatcccagtctcttttctttgacacctttgtcctgtggtctcacagagcttgtaggtcatcttgaatctttattctaaaaataacctattataggcagtttcccagctttaataacttactcatcctcttcgccttttgttgctaaaattctgcattgaatggaacaagaactgatgacctgccaagagaggtaaccaagattctcagtcccttccccagttcaaatggatggtccaataaagaaccatgctcagcaagtgccaggggcctagttttaaacaggagaagctgaattgaatggatgatgaattgaatgaatgaattgaatccttctgatccctagtctcgcactcagactcccgtctttaagctttgttactatgaagttgtgtttgctgggacttggccactggtcagcacaggtttacccatcataaagtcttactaagtagggtagactaagaaaatctctagtctggagagaaatctgctatcagcaaaagaacccatgcctgtgctcttttcaagcacaaacgggtgctgggtagggcacagcgattcaaagacagcgcatggagtggtgcattctcaaacttcctggaacaagtgaggttctcgatgaggaactcattcatatcatcaaaataccaaagactcaaagttttttaataaggcaggaactattgaggtcatttaccccttcttgtcatggatgaggaaactgaggctcagtgaggttaggtaactgctcattaccaaggcctactctgaggttctttgttacactactctccttctcccacctggtctcatcaaaagcccagacggagtcagaaatagaactgcagggtcctgctttctagccagcagctggccacaggctatcatgcattacatggaatgtgcttcaggacgtgaggacaagagatatgaacgagaatgcagttccagtggtaacataccatcttcttccctggatttatttcaatcctgaaaacatttgtaggtattgttattcctttatttttttaaatttcctctttctactctaaataaatgggctttcatctgcagggactggagggaccaaatatccagaatatccagtccgctaaggccatgaacttttccttcccctctgttcctattttgggagtcattgctttgtttttttgacttttttttttttaacatggaaaagcattcttttaaagttgacccttttgctgcagggcaaatgcttttctgttatgcactagagattcagtttgatctcctagaaatgcttagcacaggagtcataaattgaaatgttttcagagaaggagctttctcattaagagctttccaacaggcctcttctaaatactgacacgggttggtaccagaagcccatcacctttttggaaatcaaggctacatagcaacctggttatcctcctccagtctgattgcacgagggctacaccccatgtatacagagcagagagacagctccttgccttgtgagaaattcgtcttcataaccaactcccacaccaaatgagtaaggaattggatccaaaagatagtcatgaaagatattccagaatccaaatcatgtgttttaaccactttgcaactaagatttactatcttgcctcattgttaacagaataaaaaatgcaggagataatgattaaacttctttcctccctagaatttcatcttcagtgtttgatcatcattgttcctgtcacttatacatatcaagtatcttcatctaagggtcatcaagaacctctggttgcctggaggccagaattattattcacattttacagatgggttagcaatcacagaaagagaacatgctttgacttacctaaaagagtctctgagagagtggagaatgaatgttcccacagtcttttacagagccctgacttcagtgtgagtagattagatttgctctatgtagcttacacagagacttctacaggctcaatcccataacaatgaaaatcctcaaaaatgaaaatattttcaaagctcagttcacgtatttgatttttgtatttgcattggaattaaccaaattccagacaatgaagttatactgctttggcaggtctaaatatcacaatcatcaaaaaggagagagagggagtgagcacctcaatttttagaacttcctcttaaagtgaacatagagaaggttcacttatctgtttcctaaccaattaggtcatcttgcaggaaatcaccttttcttaaaagccagtaggcagattcctcctactttaaatttcccatcaacagcattaacaatcatttatgccagccctctcacaggaatgcttgaaagtcaaaagacataagagaccactaagttttctagtttaaaataaggtcacaactttatagtaacttacagtttccctacctccctctctcaagtgattctatcactgcaatcacccttcaattgctttcctatacttgaggccctattaagtaaactatctttccaatccttgccagatttttaattctacaaccagagaggatcagttccaggccacctgacttgcgtgaatccagctgctgggccagttgagtgagattaagtaacttgctgagccagagtatgtgctgtctttctggaaaccccttgccctgggttatcactgtacatcagaacagaggaagccgagtatggagcctgagtgacatgcagagctcagatgagtgataagatcctcatgacacacttccatcggtatcctcccagagatgggcctttgagctctcaagactcttgtgggctggcagaataacacgttatttgacatgagagacatgataagcccagagaaagctaattggagtagtggttaaaactcagttggcctggtttcgaaccctggctgtgtcagtaactaaccatgtgaactggagtgacttagtttctcatagcctcattctgtcaatagggatgttaatattactcacttcataggattgttgtaaggatcaaaagagatgtagctaagatatgaagctcagcaagatttaagcttacatagtgcctagcacatagtaccttaaaaaatattgcctttccaccttgggcaacatagtgagaccctgtctctacagaaaaataaaaataagttagccaatcattgtggcatgtgcctgtggtcccagctactcggtaggctgaggtgggaggattgcttgagcatgggaattcaaggttacagtgggctatgatcatactactgcattccagcctgggcaataagggagaccctttctctaaaaaaaaatttaaaaattgcctttcattatcattaactttcaaggccttgctgttattacttttatggtggattaatatttgtaagaactcctaaaaatacaaatggatatttttaaagtctatagtagactacagtcaagcttgctcactcagggtttcctttggaaacttttctgtggtcatctgtactcatggcccttacttaagacttgggtttacctgtccagaaaacaaccaaatacatgggtacttttttatactattcttattgttttagcgacgcggagtcctttaaatagttgctcctggcccaaatgtggctccaatctctgaagacatcctgtgtcttcctttagacccgagaaactcctacagtttatcaccaaaaaaaaaaaaaaaaaaaaaaagtttgagtgcttaactagcaactcctaattattcacatgtagctttttcttgacaaactttagagcttagcctcccttgatcccatcacttagcaggcatctaagcaactaatttctagagtttacttgaaaaatgtaaacctgttaattttagctaagcaagatagaattaaggatgtaaatctgctgccaaaacaaggatacaatatgattcaaaatttagtggaaataactttttaattagtcatttagtcagtattataagcatcctctgtgtctcagaccttgtgttaagtaactcaggcatgctgacatacatcaggcgtgggtttggcctctttataatatacagtcatatgtcacttaacaatgaagatgggttctgagaaatgcatcattaagcaattttgacattgtgtgaacatcatagaatgtatttacacaaactgagatggtatagcctactacaaacccaggctgtatagtatagcccattgctcctagtctacagacccattcagcatgttgctgtactgaatactataggcaattggaacacagtagtaagtatttgtgtatctaaacacatctaaacagaaaaggtacaataaaaatggtaaaaggattaaaaatggtacacctgtgtagggcacttactatgactgcagcttataggactggagttgctctgggtccgttggtgagtgcacctactgatgaatgaacatgaaggcctaggacactgctgtacactactgtagacttcataaaccccgtatccttaggctatattcattgatagagacatttttctttcttcaataataaattaacctttgattactatcacttttttacttcataaatgttttaattttttaactttttgatcttgtaataacataactgaaaatacaaacattgcatagctgttcaaaaacattttctttatatccttattctataatcttatttctgttttttagatttttttacctttttaaacttttttgttaaaaattaagacacagacacacacattagcctaggactacacaggatcaatatcatcaatatcactgtcttccacccgcccatcttgtctcactggaaagtcttcaggggcaataacacgcatgaagctgtcatctcctatgataacaatgccttcttctgcaatacctcctgaaggatcttcctgaggctgttttacagttaacttcttaaaataagtagaatatactctaaaatcatgattaaaaaaagtatagtaagtacatagtacataaaagtatagtaaatacattaaaagtatagtaaatacataaactacataaaagtatatatagtaaatacatcaatatagatatgataaaaagtatagtaaatacataaaagtgtagtaactacataactggtttttgtatttactaaactggttattataagtagaatagactctaaaatattgataaaaagtatagtaaatacatataataagatcaagtattatgtactatgcataactgtatgtgctatacttttatacagctgagattatagtaggtttatttaccctgcatcaccacaagcatgtgagtatgcattgtgctatgatgttaccattgctgtgacatcactaggtgataggaatttattagctgcatgataatgttatggggccactgtcatatttgcagtctgtcatttgctgaaacatcattgtgcagagcacgactctgtattaaaggtgataagaaaagcacacaaataatataccacaggtagaaaatgattgtaatatgagacagtaaaataaagtattatagaagtttacaggaggaagacattatttctgtgaagattagagaaattggcacataggaagtagcattgaaggcagagtagatttgggacatgtgaacataggggagttccagatgagggagggacatgggaaataagtgattaagtaggaacacagttgtgggaaatggagcagggggaagaagtctggaagggcaggtgggcgcagggtagaaagtccttgaatgccagtgttaggaatttagaattctctgaagacacttgggagccactgaaaggttttgagcctgctggttgtaaatgggagggtggtgtgcttaggtgtgtgcttggaggaggttaatcaggtagtaaaacagagggtggctttagtagggagaaagccacagcagcacagacaacaggcaactaaagcagtcacaccaggtgaaagctaatgtgggtctaaggttgatttaggaggaatggagagtcaggaatggatctaagggtgaggtaggagaaatgaatggatggatataggtaggattttacagttaaatcagtaagacctctcaatttattgcaagtgagaagcatgagagaaggaaacattttgaaaatggagctgaggttttaaaccagattaactggagggtcaaaggaaggaacagagatggagtagatttatatgggaaaatatgagcttgctttgatgatactgaatttgcagtgctaaaatttatgatgtagacttgcagttcttgtggttaaaagtggaagacaagtgttgagacaagccaaaggttgcgacaaaggcgtagaaaccatccaccttgtcaaatgggctctcatccttttcaaagtggagccatgccatgtagagcagacactgcaagcttgatgggaatgaggcatatctggctcaaaagcatgtttatttgtgtgtttttaaaagtgtaaatattgaaccaacattttaaaatcaggaaattatacttaaaaagcattgatttctggcttccgttttaaaaatcaaaattgcgctttaaagttagcgcaattaaaaaatcatatcactatgatttttaaaaatcaaaagatgtgattataaaagttttttacaattttaaaataaataaataagatgtgactaactatgaactcacattgccacatgacaacagctagagctgaacagagactgcccccttgagatcctggatgaattctcgaactcaccacagtactcaccacttcccctcatctcctaaggctttaattgaaagtcagttactaaatctatagagaaaaaaaaaataggttaatggttgccaagagctggaggtgggcagggaatgaggtgttggggactgatggccagtgggtgtgggatttctttttaggggtttgaaatgttctaaagttaattgtggtaatggctgaacatctctgtgaatatagaaaaagctgctgaactgtacacttgaaattggaggaggtatgatagcaaattatctcaatagagctgtttttctaaaatgcaaatatagttgctattgcccttgcagtgttgattttcttatagtagaaaatatttttctataagtctatttctatcaaaaaggggaaaatgaaaagttagactgagagggttgtgaatttcaagagaaatggtaaagactatatctcttagtgggggtgaagaagttctacatgttaatatgcaagcacttggcctctttactaatgtacattattttcctggatactgaaagcatctggtattagacaagaaaaaatgtggtcatgccccactccctaaggtccacccacaactaagaagaaagagaaaacaaaggcagaaaaaggaaaggagtaatcaacatggtaaaaggagaagcagaagaggccagtagattggatgccaaggaagggggaagctttatcaactgctgacaagaggtcaaggaggatgaggccagggaagtcaggaggtcatgggagaccatccagtgaggaggctgagagaggtgaagccagagagagatgcagaggcagctgacaaagtgctcagagtgcattgtttaggagatagtatttaatctcaggcatgaaggactactgaaggcattttaagtaggggaatgatgtgatcagatcggaacaatctagattatttgttttcacattaatttgtgcatattttgaattgtgtgcataatgaactgaggttaccccaaattttattctttcttacactaaattctctttcaatctgatatccccaggcttgttgagaccttggttattgatttccatctcattcattcctgttcctgcttgaaccaggaaatagatatatatggttggtgttatctgacccaggggttctcaacttcagcactgctgtattttgggctggataattctttgttgtaggatgctgtcctatgcattataaaatggttagcagcatcaccagcctctaccctctagatgccagtaacactgcgagttagacattgccaataaaatcaccctccagccaagaaccactgaactacatttgtctgttgcagcatttgggcccaggtgcttaaggccatgtgcagttagtagaccaccctgaaaggtgtctgccctggaaaaaaaaagaccaattcctactccacactgaggcgtacaaatcagatgatgtagtaaggggacaacggatgacacattcaaggcctcattttgttttagctaattcagtggacttcaacctctatgtagtctcctcatagaaaaaagatcgcatctggaggcaacaaggcacactaaatgtccaactgtgccctcctaaggttaggattcctgtcatggcctagggccaaagttggttcagaggaggccttgggcacagggcacaggggttcagaggaggcctcgggcacagggcacaggggttcagaggaggccttgggatgtgctggacatgatagtgggagctggcttctatgcagcaggacttgttggcttgccttcaagggggaaggagcaggtagggaacagaaagggttttctcatggtgatatcaagaagggtcagtaaagctttggagatgtaagatgcaatttggaggaggctaggaactcagatagagtttacttcagaccctcttccttataggaaagtcttagaaggtaaaggaatgtttctcttggaatagggatgtctaaaacagcttacctatgaaatgctgagatcttctagattcctttttttgcgttgtgtatacgggggggtgggaggaccagggaattttacatgtatatgccaccatttctatattgatagggaaaattgagttaagactcttgtctagctaaaaatgtctaacaactctattaaactaagactatttcataactggttcttattctgtggagtagcattatgccttagatattgaatggctagatttactagtagcaatggctctgagctatcttgcaatgcaacctctttttgatatataactctgttattatttggcccagtggtggtcactttcaccaaggctgaaggaaacccctgctggtttttagtctcatattccttaacccctctcctacttcactgattcctcaagttctgtggtaatgaactgagcctccaagtactctctggactactggcaatgagtaatgtctggacttcatgtgaaatgccatctcaagaaagggcatctgaaagcgtgcttttaccatttcatttcaggcacttctggatccagctgtgtgatagccgcactaggaaatacctggagtcacagtgtgaatacccggctgatcctccagtaccttgattcagagagaagacaggtgggtgctttgacagtattctctgactatgaaggtcggggaatgagatataccaagcaatctgagcgtcttctgaaaatgctggccgcattgtctgtcctgagccagcagcagctattagggcctaaagaaaccagcatttctgcttgtcccaacaacagttataataaagtggggagacaagtcacacacaggaaaaaacataagaattgatcccacagagtcagcatttctctgatatttgtaagtgaccaaggaccacacctctaagggtatccaattctctatctctaaatgatcatttcacttagattgtatttgttgaggactaatttgtatatgaattaaataatgatgatgctttttcttgaagtatgtgtactttgaaaatcttaggccagcagatgctgccaagtgaataaattattccccagatactaggtacttttacattaacgcatacacctgtagtgtaaagtactgaatgatgctagaaagacctccaaatggttggtcactttctcagagttccctatttgtggtttctatcctggccaaaactgaaaatccttcccttacatccagaaagtttactttctacctccttttaagtcttctgtcttcattcttcattccaaagaaaaggacaccactgtctgacctctttggtaaagctttggtaaaatgtttcataataaaaaaattctttttcctaatgactaacctcaactttatcctgctgtgtgaccagattcaatctagtttctcctaaaagcaggaggaagaagacgggtgattattttgattttttggataggacagaattcagaagccagatttgcccaccttgctaaatatatatcaaatccaggccatttagatacagaggcatgaaatgtcacactggtgatcctttctggagaaaatggcagaaaagctgttgttgcctttacctgcattaggtaaactggctctttttcaaggaagcaggaatcatcaaaaacaggcgtgagctattgcctgttctagacataattttccaaaccagagaattcttcttggtttgctttggactatgtaaataatattccagcttggtgatcacgtcagccatgtcctgagaagatagagctgcttgtttctattcagggaaacattcttgagttttcaggccctggactactcattacctcaatggcaccttttccctgaagagtctggtatcctaggttctgaagctgttatttctctttttagtggaacacattccaaaatattcctggggaatctaatgacctttggtagtaaatcatgttaaatagctgtgttgcagctttcagggatatcattaaggattgttgaacacacctatgtaaactttatcagaggaagcaaaattccttgtgaatcaatgttgagtcattcgttttcatggatccttgatcccactccttgaaaacttatagtttatctctgtttcaggttttagattttagaagccattcttactgttacacacggaatttatgatttcatctattatatatggtatcatgggttcaaggctcccaaatcctagttttactaattccagttagaatttataagtgaataaagaaattagagccatatttttacttttcttttgttttaataaattaaccagtcagtgtcaacaggaagtagctggtaggacaaatgctattttttatgtctctttggtgactggaggatgttggtggctcttggcttttggctgataaggtcaaatgcaggccagtggtcataaggagaaccaggagcaaagtgtagatggatcagtgacagttcatcaactcccatcccattagatgggtcagtcatgttatcttaatttacaaaagacaacttgttactatcattactaatcaataagaagcagacttaaatgccttggaatcatgttttcaaacaataattagaaattaatgtaaaatatggccagtgttaaaatggccaacccaggcaaagaacatacatttaattaatctatagaaatatgcatgcctttggggaccagttgttaaatttgtgacctaataactagaataaagtttgatatagaaaaaacatgtctctgtctagtgaccttatcttgccttagcagagggtgtgcttagtgattccctgagtctttcctgtggtcttattttatgaaaaaccatagaagccatacgaagcgaaggcttttctgggatatgtgcataaaacagtactttaaagctaacctttaaggtaattgcaccaagtagtactttcttataacaccatttagtagcagaacgtgcctagataattctagggtagtaagacctctgggacaccagccacttagagaagataacaggtatagttttttgttttttagggttttttttccaatgcccaagcagaggccactacacccagggatcaaggttatgggatgaggattatattttatcccgtttctatgacattgagctctacaccagggctcttgaatgtgaggcttagtttcagatcacaggcctggaagggggtcaggtcaagctgagcagaccttcaagccgattaacccaagagctgaattgtgttgtctgagggaaggagtcctccctggctgattattttctttacaccctggaaactttgcaaaattttataaccaagaaagaaatcttatcagggccacaagccaagttaattttcttgcttattctgcttcagtgtttgcaaaaactctcttaagaagctggaaaacattttcttttggactaatttagctttttttccatttgacttttatttactcttttcctactctgcttcaatcctgccccaccctttttgcaacatttttattcttaccaaagacatgttcttagagtagaattaaaatggcctctcctactttttgtagttgttgttgttttaaaccatcgaaaatatgttttggtctaccccgtgcatggtatggggatataaagaagtagaagactagttcctgccctcgaggtccaaacaaactaatactgaggtactgttacaaggcagtgtttgatttgttgtctaatgagtggttaaaacagtaactgctttgactctaaaggaaggtaacatcatcagaggcatattaagtcttttcaggaaaaggtgagacttgagtattaccttaaaatcagtgattctcggcaggacgcagtggctcatgcctgtaatcccagcacttttgggaggccaaggtgggtgaatcgcctcaggtcaggagttcgagaccagcctgaccaacatggtaaaaccccatctctactaaaaaaaaaaaaaaaaaaaaaaaatagccaggcgtggtggcgcatacctgtagtcccagctacccaggaggctgaggtaggagaatcacttgaacccaggaggcaaaggttacagtgagtagagagtgtgccactgcactcaagcctgggtgacagagcaagactctgtctcaaaaaaaaaaaaaaaaaaaaaaaaaaaatcagtggttctcaaacctggctgcacttaaggctcatcacaggagcatttataccaatgccaatgccccaccctgaccagttaaatcaaaatctctgccagtagagctgagcatcagtgtttattttatttgtaaagctcccccatgtgattctaatgtgcagccaaggttgggaacctctgccttaaataatagataagattcaggtagtcagaaaggggaggtgctggggtagagtgagctgcagctgaagaacaaacaggaggataggctgcatcgtcagagggcacaggctgggttttgccttgtaacaagagcagagggtttgggcactcattcatttgacaaacctttatttaatcacctcttctctgctagtcactgtgtaactagttgcgctggagattcaagaaaacaaaaacaggtaagagatggttgataccctctggttgttcacagtctacttgaggaaacagataagcatgtaaaccggacttgcagtaagagcacagtgaatgaagtaagtctagaggagatggggggtcctggcactaaggaaggttctctagcgatgaatgaggcagagcatgaggcagagaggagtggccgaggccttcacttgggaaactcttgctattacaaagtgccttctagcgagggctggaaaagctagagtaaggctggttatacttgaaagaaggaagaaaaactcgataaaaatattcacatttatacaatttctcctcaaatcctcatgaagtctggtcttacaaactacaaatgggattatataaattttcaagtgccctagaaagagtaatgaagtaaatgaatcctgactaagcctcacacccgcttgatgaaataaatattatgactctcttatttcaacaaattggaaagaggtctttttttcatataggaggtttatttaaatgaactttctaataatattttcatttctatttaggaggcaccctgaaattatgggatgcttgaggggcgagcctgaagtacctagtaaattgttgacagaaccaatatcactcaagctgctgatccacacttgaatctgtaggcttttctcaaagtcctagttttgcatcttagaagtattgcatcttggaagtatttctttgcatcttggaaatattcaatgtttcctttctggtgataggattctcagtgtccattttatattttcgaagactcaaatatcatcactgtgaagacttccctgacaccagctgtgatccgtccctcttccctctggcccacacttgcacctggcccttgtctctattcttagacttctgagccctgaattatgagccccttgaggtctataactgaatttatctgcataccctcaaatgtaagggcagtgcttgacacttacacagtagatacatttattttgaaagagagagagaaagcaagaaaaagaaatgcactccctgtagctactcgtgaacccagtctgaaggacgaaggactgcttatttagaatcattcttccgcatagaaattgagttttacaatttaaccattcctttaaaatgttagtaattgtcggtttaaaatgttagcatcaaaccttgacaattataagcagatacttaaatagaaatactgtaagaatactgaagataggaatactttttgcagaaccagcctgctgtagtctatgggaggatgggagtcaggcttcccctggaatcttatgggatagcctttgtgtaagcaagccagaaccctaaacacagacccaggctgagggagagaagggttctgcagctgctttcagggaccagatagcatgaggagggtaggaaatctttgttgctatcttctacaagtcttaacttctcctctctgtggttggacaggcttaatgaaagactgaataaccaaagaaaagttgataaattttttttcccagataagctaaagggtagatgtggggcagcatgtcaggcttatattcatattcacccaaagaaagatatcgaggatgatgttttacctgatgtaagtcatagttgtatatctccctactcctagattcctccaaagaaggattcaggcttagttgccctaactcaaaaggaacctctctcccttggtggcatggttccaggtcgctgtacttgttctcttgttttctactccagctcacctgctgtttttaggcaaggaggattatgtgagtatgtgtgtgtgtgactagatcccgccagaggagaagttcggctgtgctgcaggggtagatgaaaactctttttaagcataaatacctatagaaatagcaaagggaacataaaatccagtcaagtacattatcttgggtataaatgtctcctccctttccagagctgctcaagtgtgaaatccaagcccctgcccacactcttgcaacagaagtgctctaacaggtattaagtggattggggaaataaataaaaggggaacccagaatggtggcattaaaagaatcccttttttcaggcaatgtattggcactaggcactaggcaaatgtattaaaatctgaggaaatcctacggaaagtgtgtggtcccagtgaatgaatacaatgagctgctactcacagtgcagggactgagaaagggcaacacagacacccaagtggtcatctcccatttccatctccacatttgagataagaatacctgtatctttcctaccacccacaaacaaacaagcaaaccatgggactccctttgaaaaaagtcaatatatccaagaaatcactatttctgaatgagctcaagtagagagaactttctcttaagagggttccgctggaaattgccagctgaaaatacacaggtacaatgactcccacgctggagatgaagggtcccctttcccatgctttgaccacgatagaccgtgtacctttgctaaggtggagagtcagtctttcctaggagattttgagccaaataaaataaaaacaaaacacgggtgagagaaccaccatgatgttttaaaaggcgaaagatttacgcgatttgaagagaaaccagagtataccaccatgatgttttaaacatcattttttatcaaatatagttacaaaattaaccgttaccaccatttcaaaaaggtaaaggcactttaacaccaaaaagtagaaaggacatatctagaaggaagaatacatgtattgatatatttaaactgaaaacatttctttttatggcagacttagcacatgtccttacttctctctttgaggcgcatgagctctgaccatcacaggacaaatgactggtcctcttacagagcatgtaggtggtttaccctttaatgagccactcatttcactagcattttatcacctctgttgttctcctccagctctgacttattttatttttatatgctgtttgtctggtaccaattccccttgtgcagtgaccctgcctgctctaacttgctaagtaaactaggccaaatacctgggcaggagatttctagagaaatctgagcagttgcaggaagtagaagagacacagggctttggaaccaaattgaagaccctgttgtctggcttgggaagaaaaatattttcagttgggaaacaacatcggaaacagctatgagatctcttggacaaggcgctgccctgaaagtcaaggaccttgaaatttatttggctcatttgagaatgaagattggacaggatgttttattttagccttagctggttagctgtgagtgagaagaaaatgggcaacctcattggctagggaaagtaaaaaggaaagaagggttcaatacctgcctaaactatgaactgatttacaaatgaatcagcactttcactagaacaaaaagcatttagaatatgacagtgcccatctgagatacagtctagagatcatcttctccagtgagtctcaagtacagtaaatttaaaaatcccaggtgtttgtgaacaatgaagatcccaggccccatccccagtgctgtattcagtgagggcagtgccaagcctaggatctgcagtttttagcaagcactttgggtgattcttacatgggtgttcttcagtttcatactccattctagcccctttgttttacagatggcggtaagcaattgatattaactaatttattcagggtcacacaactagtaggtagcagaaatggaacagaaattcaattctttcaattctgaatgtgttgctattttcactttactctggtgacttttagtagatagattctaggcaaaaaagtccccaaacccaatcaaattattgggtttgcaggtgatatatttatatctctcatgactttcagtggtttataaagagctcctaaagaactgtgcaggaaaaaaaaaaaatttaagcaccatctcaccccacattgcaatcaattacaagataaaagtcatcttttaaattcttgaacccaaatctgaatatgtggctttttccaagttaaacttcacagtgagcatgaactccccagtcaagtgactttccttatagacaacatcctgccacagggctggctatgctaccgctctcctacagacagccatttgtgctcatggacatctcccttaaatcctggctccctagtccccatcttcataggctaaaggtgtgtaatgggagaaccaactttgtctgatcttgcgagcatgggagctttttggttatcacatttttgagtcagtcaatctttattttgaaaaagcagggcaggacagagggaggaagagaggctgagggcaggcagcagcctgtgtgggaacccatttcctgccatcctagggtcccatagttgataatggacaacatccttgcttggttcttgtgcaccaggtgatactaatttaaattcctctttattttctagtgatggaaaggagttagcctttactgagtacctatgagtttgcagggatcatttttgaccctttgtgttttatttccatcaattcctccaataacccttcagcatagatctgatcatctctatttttacaaatagaagaacttagctgataacataaataactcatattcagtgatagcatcaatatttgaaaccaagtttgtatagttccagaccctcagttctttttcctgtaccatgtgctctgagatgtaagatggtggttgtgttaccggaaagggatctcaatccagaccccaagagagggttcttggacctcatgcaagaaagaatttggggtgagtccataaagagtctactttgtgccagagttcataaagtgaaagcaagtttattaagaaagtaaaggaataaagtatggctactccacagcacagcaacccgaagagctgctggctcgctatttttatgggttttttttttattatatgctaaacaagaagtggattattcatgagttttcctgtaaagaggtgggcaattcccagaactgggcgttcctcccctttttagaccatatacggtaacttcctgatgttgtcatgccatttgtaaactgtcatgatgttggtgggagtgtcttttaacatgctaatgcattataattagcgtataatgagcagtgaggacaccagagatcatgttcatcatcatcttggattggtgggctttggccaacttctttactgcaacctgctttatcagcaatgtctttgtgacctgtatcttttctgacctcctatctcatgctgtgacttggaatgcctaacctcctgggaatacagaccaataggtctcagccttatttttacagcttgttttcaagacagagtcactctggttcaaatgcctctgacagttatcactgttttaatttaggaataaaatgaggtgctagaaaaggaggccttgacttggtgatgattctgctgggttgcaatgaatggtccttattatcttcctctctgactttcctgaacgatgattagacctagaatgtcatttggtttacctgtaaaacttagtgagttatgtattaggatagcccctcccaccctggggcaggaacatgaaagcagtgagatgaggagcttcttcttgctttttttctcttgctctaggcattatttgactttgaaatactcctggcattttcctgtgattctgaagtgccccttcctctgcttgtgtgtgtgagatttgaaagcttatcacacatgtggctaaagcaggtccagcttggagcattcgtcttctggctgctgttgctgggggagtatccctgctgtgagatgctacgccgcctgagcctgtggcctctgcttatctcctggggtggctgtggctgtgaggtgcacagcatggtacaatgctagttttcatttcaagtcctttcttgatgtcactgatgggtgcaatgagtggagtggggggacctcaggcccttccaaattctttcttttttgttgttgttatttagtttttatttcataatcataaacttaactctgcaatccatctaggcatgggagggaacaaggaaaacatggaacccaaagggaactgcagcgagagcacaaagattctaggatactgcgagcaaacggggtggaggggtgctctcctgagctacggaaggaatggtctggtggttaagataaaacacaagtcaaacttattcgagttgtccacagtcagcaatggtgatcttcttgctggtcttgccattcctggacccaaagcactccatgcctccacaatattcgtgccttctttcactttgccaaagagcacgtgcttgccatccaaccactcagtcttggcagtgcagatgaaaaactgggaaccatttgtgttgggtccagcatttgccatggacaagatgccaggacctgtatgctttaggatgaagttctcattttcaaatttctccgtgtagatggacttgccaccagtgccattatggtgacttcacagtcaccaccctgacacataaaccctggaataattctgtgaaagcaggaaaccttataaccaaatcctttctctccagtgctcggagcacgaaaattttctgctgtctttgggatcttgtctgcaaacagctcgaaggagacatggcccaagggctcgctgtcgacggcaaattcaaagaacatggtggggttgaccatggctaatagtacacggttttcctcagcggtggcgtccgcagagcacccaaattcttaatagcttataaaattaggggtagaggaggttgggtgcggcagctcacgcctgtaatcccagcactttgggaggccgaggcaggtggatcacgaggtcaggagtttgagcccagcctggccaaggtggtgaaaccccgtctctactaaaaatacaaaaattagccaagtatggtggcagacacctgtaatcccagctacttgggaggctgaggcagggaattgcttgaacccgggaggtggaagttgcagtgagccaagatcgcaccactgcactccagcctgggtgacatggcgagtctccatctcaaaaaaaaaaaaaaaaaaattaggggtagaggaatgggaagcagacaaaaggtttacattgtggaggtttgaggagaaatgaatcaaataagtctctagcattctgtttgactttatgttagtctgattatgttaccataacattttatgatatgctacacattatctgatgggtgattaattttcaaatgtaatacaaatcattgagctttcctgatttctgccgctgtaaataatttggaattttcagttactgcaaagttgacatagtcactccttccttcctgtaaccttcaccttaccttgttgtcccctccctgcccccaagcttccctggatttttaaatcagccagtggctcctggcaactgtcttagaatgcttgaagccgaggttttttttcactgagggtctctttctagaagtttctcttcttaccttggcagagcttaagagttcttgcatctcagacaaagactgtgtgtgcttgactgttggacattcattttattgttacaaagggaccatgattttgagaacacctttggagagcccagctcccatggttgtatcccactgcccattttctgaatcctcaactcagaattggcaatgaaagagtgaactgggattatgatctgtgattctctaacagaattctctgagagtcaaactccagaaagaggctcatctttacaaaccttaaagaattagagctaaggcacctggtatgtctgggagggattgaaaacaatccccccaaagccccagcggccctggctctctggttgctatgctgagttgattcatccatttattgagagtctactttgtaccagttattctgctaagtgctttgtgggcattttctttttcaagcctcacgaaaactctgaggtgggtattactagatatactttacaattggagcacattgaacgttatggagtttgaaaattttgctctaaatcacatggttctaaggggcaaagccagaactttccttttcctttgcctctccctcccccatcacatacatacactccctcttttatatccctaggttcttaacctttattctacaatgagtaccatgttcatgtaagattattcatgcatgttacttggaattaattgcagaacaattttttttcaacccctgtggtgtggtcaccttcaatacttatacttggtggaatactcccttcaaagagtggaatgatccattgctttgagagagctttttcgatctctgttaagtaatgattagttatttccttataactgtgtggctctgtgtggcaacagaacacttttgaggaagaataaactctacaggacatggtcttctgaatctcaccattcaatcaggggaagttctggttcttcttctctgttccaagtactagcctttccagccagcaccttttctgtgctctgggtttggcttcagtgttctgtcatttatcgtcaaagaagaaagagaagtctctgtggcatcttgcccacagtggggatggacctgtgctcacctctctcctccagtaagaacctaagggcccaggaggtatagtggtgcctcccatagatacttcccttccctcatggatgatacagaatgacatataaatgatatctatttcttcatttttttccttgcaaagtcacttttccacatactaatccatttcacggtttatctttaaatcctttctcagttgtctattcttctctgaaagtattatcccagcatcctaatgaagattccatcaatgtctagtaaaatgacaaaactctctagcagtactatgttttgtttttggttttggtttgtttgttttgtttttactggtgcctctttataataaaaagatttggtggctccagcacagcttctaacccttcaacagctgtgcctataccaagctgttctctcttatttgtaactatttatgcagtgttctctccagatatactgttccatactgacctgcattggaatgttaggctcttctttgtgactgatctctatttcctacttgtgactccgttctgacactacctttgcctttttataccatcctccctacttttctcatgtagatttgctaaaagatccccatgactccaagatccctgtaactggctctgctgagtctgtcagcatttgatccctttgacttgaggaggccagtccttctcaggaaccacctgtaatctcttttttttccttagagacagggtcttgctgtgtcgcccaggctggaatacagtggcatgatcataactcactgcagccttgaactcctgagctcaagcaattcttccaccttagcctcccaagtagcttggactacaggcacataccaccacacctggctatttttaaaattttatgtagagatggggtcttgctgtgttgcccaggctgggcttgaattcctggtttcatgtaatcctcctgcctcagtcatccaaagggctgagattacaggcatgagccacagcacctggcctatacctataatctcagtttgaattaaacagtagtctctaggacccctctgtgtaggggatcttgttacatgttgtggttgttcaaaggccaagtattttcaaagaaaacccactgagataagttggatgagtgactgccatagcagtcaatatgacacctttgtcactttttttcatatcctaatagtctaatatttttcctcaagaaaaggtatatgctgcggtttgaatgtgtctccaaaacagcatacttaagtagtagtttacttaatggccattataaactattaaaaggtaggacctgtaagaggtgatcagcccatgagggccctgccctcatgaatgattaatgccattatcaagagaagtgggtttgttattgcaggagtaggttctttataagaagacaagttcagcccccatttgtctctctgtcaccctctctttgcccttccaccatgcaatgatgcagcaagaaggccctcaccagatgctggccccttgattttggacttagcccccagaactgtgaaaaataaatttctgttcattgtaaattatctagtctgtggtatttggttataccaggacaaaatggactaagacagaagattggtactaggagtgtggtgattgttataataaatacctgaaaatatggaagtggctttggtattgggtgatgggtaaaggctggaagaatctggagtagcaggctaacaaaagcttagattgctataaatggagtattaacagtaattctggaggactcagaagaagagaatgagaaacttcttagagattacataagtgattgtgatcagaatgttagtagaaatagagacagtaaaggccattctttttctttctttctttctttctttctttctttctttctttcttccttccttccttccttccttccttccttcctttctttctttctttctttctctctttctttctctctttctctctctctctctttctttctttctttttttgtttttgagatggagtttcactcttgttgcctgggctggagtgcaatggcacgatctcggctcaccacaacctccgcctcccaggctcaagcaattctcccacctcagcctcccgagtagctgggattacaggcgcccaccaccacacctggctaattttgtatttttttttttttggtagagacggggtttctctatgttggtcaggctgctttcgaactcccgacctcaggtgatccacccacctcagcctcccaaagtgctgggattacaggcgtgagccaccgggcctggtcagtaaaggccattctgatgaggtatcagacagaagagatgaatatcttattggaaactgaagtaaaggccatgattgttatgaagtggcaaacaacttggttgaattgcatccacgccttgaggtcttgtgaaaagcagaatttaagagcaatgaactaggatatctggtagaagaaattttaaaccatgacatcgaagaactgtgcggcttcttttaactgcatacagtaaaatgagagaagagagaaataatttaaagatgggatctataattaaaagggatctgaaggattctcagcctggttgcctggtagagaaagaaagagagcattttctggagaggaaatgtgtggctaagcaaccatttgataaggagattagtatgaatagaagaaagccagatactattcatcaagacaatgggagaatgaccccgaggggattttggagatttttaaggctgcccctcccatcacaatcccggagctctaggagggcagatggtttccagggacagacccagggtaccatccacaggctgactttccagggccactcaggacgctaccttctgcatcccagaggagcatttctctgccacccagtcatagctcaagcaggcccaggtgtgactcatgttgccactctagaggcacgagtagtaagccttggtggtgcccacatagtgctaattctgcaggcatgcagaatgtatgagctcttaggccatggtagcctccacctagatttgaaaggatatattggatagcctggacatccaggcagaaatttatcacaggggcagagccatggcagagagccccatctagggcaatgcttactggaactgtggggttgcagctgccacagggagtcccctctacacctagtataggtgtcatggcagggtcacttgagactccagaactgcagagcaaccaatgtgcagccccagcctcggacagctgaagcagcaagactaacccgtaagagctgctgtgagggtgagactagcaaagccatggggttggagcttcccaaggtcttctgggtacaacccctgccttagtgtgaacagaaggtggaaatggagtaaaaggaggttattctggagccttatttgaggttgttttccctgttgagttttggactaacttgggatcagttactcctttcttttttatttctcccttttggaatgggaatgtctatcctatgcctttcctatcattgtattttggaggcacataacttgtttaattttataggctcacaactaacagggaatttgctttaggatgaatcatgccttgagtctcactcatatatgatttagatgagactctggactttggacttttaagttgatgctagaatgagttaacactttgcagctattgggatggaataatgtatttatatgtgagaaggacatgaatttggggggctggggccagaatgctatggtttgaacatgtcccaaaaaatacatgtgttggaaacttaatgaccattgtgatagtattaagaggtgggatctttaagaattgatttaggccataagagctcatctgtcatgaatggattaatgctgttattgtgaaagtgagtttgttatcacaggagtgagttccttataaaaatttgagttttgtttctttttcaccttctctttgcccttccaccatgggatgatgcagcaaaaaggccatggcaagatgatgtcctctcaatcttggactttccagcatacaggactatgagaaataaatttctgttcattataaattacccagtctgtggtattcagttatagcagcacaaaatggactaagacaatatgtattacaacttaaaatatttagtaataaatcttctagagactgtaattgtaataataatcctttgtgtgtcctctagccacagacacaatcctcttctaactcttccaatttttttgcattttaaattttttttaatttttactttttattgtggtaagaccacttaacatgagatctatccttttgacaaacagtctaagaacacagtaccttattaactgtatgcacattgtcatacagcagatgtctggaacttattcgcattgcataactgaaacggtgtatccattgaaagagaactccccattttccacttctcccaatccctggaaatcatcattcatcattctactctgtttctatctttttgactattttagatacctcgtaagtggactcatataatattcgttttctatgactggcttatgtcacctagcataatgtcccccaggttcatccatgttgcatatggcaggattttctttatatatatatatatatatatatatatatatatatatatatatatatatatatatataattattatactttaagttctagggtacatgtgcacaaggtgcaggtttgttacatatgtatacatgtgccatgttggtgtgctgcacccattaactcgtcatttacattaggtatatctcctaatgctgtccctccccactccccccaccccacgacaggccccagtgtgtgatcttccccttcctgtgtccaagtgttctccttgttcaattcccactatgagtgagaacatgcagtgtttggttttttgtccttgcgatagtttgctgagcatgatggtttccagcttcatccatgtccctacaaaggacatgaactcatcattttttatggctgcgtagtattccacggtgtatatgtgccacattttcttaatccagtctatcattgatggacatttgggttggttccaagtctttgctattgtgtatagtgctgcaataaacatacgtgtacatgtgtctttatagcaccatgatttataatcctttgggtatatacccagtaatgggatggctgggtcaaatggtatatctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtgattttgatttgcatttctctgatggccagtggtaatgagcattttttcacgtgtctgttggctgcataaatgtcttcttttgaaaagtgtctgttcatatcctttgcccactttttgatggggtttttttcctgtaaatttgtttgagttctttgtagattgtggatattagccctttgtcagatgagtagattgcaaaaattttctcccattctgtaggttgcctgttcactctgatggtagtttcttttgctgtgcagaagctctttagtttaattagatcccatttgtcaattttggcttttgtggcccttgcttttggtttttagacatgaagtccttacccatgcctatgtcctgaatggtattgcctaggttttcttctagggtttttatggttttaggtccaacatgtaagtctttaatccatcttgaattaatttttgtacaaggtgtatggaagggatccagtttcagctttctacatatggccagccagttttcccagcaccgtttattaaatagggaatcctttccccatttcttgattttgtcaggtttgtcaaagatcagatggttgtagatgtgtggtattatttctgagggctctgttccgttccattggtctatatctctgttttggtaccagtaccatgctgttttggttactgtagctttgtggtatagtttgaagtcaggtagggtgatgcctccagctgtgttcttttggcttaggattgtcttggcaatgtgggctcttttttggttccatatgaactgtaaagtagttttttccaattctgtgaagaaagtcatcggtagctttatggggatggcattgaatctataaattaccttgggcagtatggccattttcacgatactgattcttcctatccatgagcatggaatgttcttccatttgtttgtgtcctcttttatttcattgaccagtggtttgtagttctccttgaagaggtccttcacatcccttggaagttggattcctaggtattttattctctttgaagcaattgtgaatgggaattcactcaggatttgactctcggtttgtctgttattggtgtataagaatgcttgtgatttttgcacattgattttgtatcctgagactttgctgaagttgcttatcagcttaaggagattttaggctgagacgatggggttttctacatatacaatcatatatcatctgcaaacagggacaattttacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatatgtcccatcaatacctaatttattgagagtttttagcatgaagggctgttgaattttgtcaagggccttttctgcatctaccgatataatcatgtggtttttgtctttggttctgtttatatgctggattacgtttattgatttttgtatgttgaaccagccttgcatcctagggatgaagcccacttgatcatggtggataagctttttgatgtgctgctggattcagtttgccagtattttattgaggatttttgcatcgatgttcatcagggatattggtctaaaattctctttttttgttgtgtctctgccaggctttggtatgtggatgatgctggcctcataaaatgagttagggaggattccctctttttctattgattggaatagtttcagaaggaatggtaccagctccttcttgtacctctggtagaattcggctgtgaatccatctggtcctggactttttttggttggtaggctattaattgttgcctcaatttcagagcctgttattagtctattcagggattcaacttcttcctggtttagtcttgggagggtgtatgtgtccagaaattcatccatttcttctagattttctagtttatttgcacagaggtgtttatagtattctctgatggtagtttgtatttctgtgggatcagtggtgatatcccctttatcattttttattgcatctatttgattcttctctcttttcttctttattagtcttgctagtggtctatcaattttgttgatcttttcaaaaaaccagctcctggattcattgattttttgaagggttttttatgtctctatctctttcagttctgctccgatcttagttatttcttgccttctgctagcttttgaatgtgttgttcttgcttctctagttcttttaattgtgatgttagggtgtcaattttagatctttcctgctttctcttgcgggcatttagtgctataaatttccctctacaccctgctttaaatgtgtcccagagattctggtatgttgtgtctttgttctcactggtttcaaagaacatctttatttctgccttcatttcgttatgtacccagtagtcattcagcagcaggttgttcagtttccatgtagttgagcggttttgagtgagtttcttaatcctgagttctagtttgattgcactgtggtctgagagacagtttgttataatttctgttcttttacatttactgagaagtgctttacttccaactatgtggtcaattttggaataagtatgatgtggtgctaagaagaatgtatattctgttgatttggggtggagagttctatagatgtctattaggtccacttggtgcagagctgagttcaattcctggatatcctagttaactttctgtctcattgatctgtctaatgttgacagtggggtgttaaagtctcccattattattgtgtgggcgtctaagtccctttgtagttctctaaggactcgctttatgaatctgggtgctcctgtattgggtgcatatatatttaggatagttagctcttcttgttgaattgatccctttaccattatgtaatgaccttctttgtctcttttgatctttgttggttgaaagtctgttttatcagagactaggattgcaactcctgcctttttttgttttccatttgcttggtagatcttcctccatccctttattttgagcctatgtgtgtctctgcatgtgagatgggtcttctgaatacagcacactgataggtcttgactctttatccaacttgccagtctgtgtcttttaattggagcatttagcccatttacatttaaggttaatattgttatgtgtgaatttgatcctgtcattatgttagctggttattttgctcattagttgatgcagtttcttcctggcatcgatggtctttacaatttggcgtgcttttgcagtggctggtaccagttattcctttccatgtttagtgtttccttcaggagctcttttagggcaggcctggtggtgacaaaatctctcagcatttgcttgtctgtaaagtattttatttttccttcacttatgaagcttagtttggctggatatgaaattctgggctgaaaattctttctttaagaatgttgaatattggcccccactctcttctagcttgtagagtttctgctgagagatcagctgttagtttgatgggcttccctttgtgggtaacctgacctttctctctggctgcccttaacattttttcctttatttcaactttggtgaatctgacaattatgtgtcttggagttgctcttcttgaggagtatctttgtggcgttctctgtatttcctgaattgaatgttggcctgccttgctaggttggagaagttctcctgggtaatatcctgcagagtgttttccaacttggttccattctccccatcactttcaggtacaccaatcagacgtagatttggtcttttcacatagtcccatatttcttggaggctttgttcatttctttttattcttttttctctaaacttctcttcttgctttatttcattcatttgatcttcaatcgctgataccctttcttccagttgatcgactcggctcctgaagcttatgcattcatcacgtagttctcatgccatggttctcagctccatcaggtcatttaaggacttctctacactggttattctagttagccattcgtctaatcttttttcaaggtttttagcttctttgcgatgggcttgaacttcctcctttagctcggagaagtttgatcatctgaagccttcttctctcaactcgtcaaggtcattctccgtccagctttgttccattgctggcgaggagctgcgttcctttggagggggagaggcactctgatttttagaattttcagcttttctgctctgttttttccccatctttgtggttttatctacttttggtctttgatgatggtgatgtacagatggggttttggtgtggatgttctttctgtttgttagttttccttctaacaggaccctcagctgtaggtctgttggtgtttgctggatgtccactccagaccctgtttgcctgggtatctgcagcggaggctgcagaacactgaatattgctaaacagcaaatgttgctgcctcatcgttcctctggaagcttcgtctcacaggggtacctggccatgtgaagtgtcagtctgcccctacttgggggtgcctcccagttaagctactcgggggtcagggacccacttgaggaggcagtctgtctgttctcagatctcaaactctgtgctgggagaaccactactctcttcaaaactgtcagacagggacatttaagtctgcagaggtttctgctgccttttgttcagctatgtcctgccccccagaggtggagtctacagaagcaggcaggcctccttgagctgctgtgggctccacccagtttgagcttccccgccactttgtttacctattcaagcctcagcaatggcaggtgcctctcccccagcctcgctgctgccttgcagttcaatctcagactgttgtgctagcaatgagcgaggctccatgggcatgggatcctccaagccaggcgtgcgttataatctcctggtgtgtcatttgctaagaccattggaaaagcgcagtattagggtgagagtgacctgattttccaggtgctgtcggtcacagcttcccttggctaggaaagagaattccctgaccccttgcacttcccgggtgaggcgatgcctcgccctgcttcagcttatgctcggtgggctgcacccactgtcctgcacccactgtctgacaagccccggtgagatgaacccggtacctgagttggaaatgcagaaatcacccgtcttctgcattgctcatgctgggagctgtagactggagctgttcctattcagccatcttggaaccgccccaccacattttctttatccatttatttgttgatacacctttagattgtttccataccttggctattgtaaataatgctacaatgaacatgggtgtgctgatatctctttgggataagtttacaagttttaaaatataatttcaacttttattttagattcaggaacatatgtgcaggtttgttacatgggtatgttacgagatgctgaagtttgaggtgcgaataatcccatcacccgggtagtaagcatagtaccccataggtgttgttttaaaccctttcccccatcctcctcttccccatctagttcccagtgtctattattctcatctttatgtccatgggtaccctgtacttagctcccacttataagtgagaacatgcggtatttggttttctggtcctatgttaattcacttaggataatggcctccagctgcatccatgttgctgcaaacgatatgacttcattcttttttatggctgtatatgtaccgcattttctttatccagtccaccattgatgggcacctaggttgattccatgtctttactattgtgaatagtgctgcaatgaacatctaagtacatgtggtttttggttttttttttttttttttgggagaacaatttattttcctttgggtatatacccagcaatgggattgctaagtcaaatgatagtttttaagttctttgcaaaatctccaaactgctttctacagtggctgaactatctacattcccaccaacagtgtatgagcattttcttctctccacagcctcaccagcatctgttgctttttaactttttaataaagccattctgactggtgtgagatggtatctcattgtggttttgatttacatttctctgatgattagtaattttgagcattttttcatgtatttgttggctacctgtgtatcttcttttgggaactgtctgttcatgtattttgcccattttttaatggggttatttattttttgcttgttgaattgtttaagttccttatagattctggatattagacctttgtcagatgcatagtttgtaaatattttctccaattctgtaggttgtctgtttactctgttgttagtttcttttgctgttcagaagctctttaattaggttttgtttgtcaatttttgtttttgttccatttgcttttgagggcttagtcaaaaattctttctcaaggccaacatcagaatggtatttcctagattttcttctaggattcttatagtttgagggcctacatttaagcatttaatccaccttgagttaatttttatatatggtaaaatgtaggggtctagttttattcttctgcctatggctacccagctatcccagcaccatgtattgactagggagtcttttccccattgcttatttttctcaactttgctgaagatcagatgactgtaggtgtgcagctttatttctgaattctctattctgttccattggtctgtatgtctatttttgtagcagtagcatggcgtttgggttactgtagcattatagtatagtttaaagtcaggtaatgtgatgcttctggctttattatttctgcttaggattgctttgtctattcaggctgctttttggttccatgtgaattttaggacagttttttgtaattctgtgaagaattatgttggtagtttgataggaattgtgttgaatctgcaggtttctttgcacagtatggccattttaatgatattgattattctaatccatgaacatggaatgtgttttggcggggggatcctctctgatttcttttagcagttacttgtagttctccttgttgagatatttcacttccctagtttgatgtattcctaggtgttttttgttgttgtgactactgtaaatgggattgtgttcttgatttggctctgagcttgaacattattggtgtataggaatgctactaattttctgtacattgattttgtatcctgaaacttactgaagtcatttatcagctgtaggaggctttagtggagtctttagggttttctcagtatatgatcatattgtcagtaaagagggataatttgacttattgttttcttacttggatccctattatttctttcttttgcctgactgctctggctaggacttccagtactatgttgaataggagtggtgagagtgggcatctttgtcctattcctgttcttaaagagaatgcttctaacttttgcccattcagtatgatgttggctgtgggtttgttatagatgactctattttgagatatgttacttatatgcctaatttgttgaggattttttcatgaaggaatatggattttctcagaagcttccgcatctattgagatgatcatatggtttttctcttgaattctgtttatgtgatgaatcataaatatcgatttgcatatgttgaaccaaccttgcacctcagaaatgaagcttacttgatcgtggtgaattaacttttttatgtactactggatttggtttcctactgttttgttgaggatttttacacatatgtccatcagggcctgaagttttcctttttcattgtgtctttgccagattttggcttcaggctgatgctagctttgtagaacgtaactcttctatttttatctagacaagacaactaagtgttctttatgttgaacacctcccctttccctccattcctgcctcattttttcatccttcatatcctttctgggtacatatgtgtgccaaatgctgggaaaagtaagtcaaataaagctcagtttccttctatgaagagccatagtagtagaggagaatacccagtgttaatagagggaagcatacaggcaaataaatataagaaggaattgaaggaattgtggaagaggacagtgtagctatcgttgttgggatggtcagaacactcacaaggaagtgatggccagagaaggattcagaagagggtgtgatactggaaacaaaacttgaaaagtgcattggtatttgcttgatagatgaagtaggagactgaggaagatgtttgaacaaaggctctgaggtgggaactacaaatggtccttctttagtgctacaggggagcactaaatgtgtctgtacaatgagtagggatcggggaggatggggcctgtatgtagttaaagataaagtaaggaaaggaaagacaaaccagactcagtcctgcaggttttcagaagccccactaaggaacttccagcaagcctgcgacatcagatttgtaccttccaagtctccctttggcaagagttttccatacagatttggagggatttgaaataagatgcaaagaaatgagggcctgaaccaagacagtggatattgagagggaaaagagggaagagttatgagatggttaggaggcaggatccacaacatttaagcacaaagaggagatctggaagggtgtgggaagggggttgttcctgaggcaaatgagtgagtggatgaggttttactcactgaaacaggctggtaaaggagaaaaaggaggcctgggagggaggcaagagctggccctgcttggaacatgcgttgtttcctgcttacgtggacagtgtatggctgcttccattcttccatccaggcctcaatgactgccatcaagaattaggttggagatcagaaatgatttcttataattgcacagaatctttagtcaacattttgtcttcccctgcctcccaccactgtttatagcacatcatgtcatctccactctcaatgccatttccttatttcggatccctggcttctgtatagagacaatggttatcagagtgtgggaaaaatgaaaagttaagagacgccttctgcagaaagggaagatgcaaactattttcagtaaagcgcctgagctgagagaggagagggccctatggagagctatgtctccctctccactgaattctagcaaatgtaaagtccaggggagtggcatcagtagctaatttgcagaaataccagtacaggcttcaaagttttctgaaagacccacatctgcaaattgggaatcaggaatccttgctttcgtggatcatgccagtcagtggattgtttgctctcagatccgctccctgcccttcccctgctctacttgataccacagggaactgacctttacaatttgcatttcccagtctccctttccattgagtctggttagtttggagaggagggatgaagggcagaagtatgagagaagccatgtatttttgtacacacacacacacacacacacacacacacacactctctcacacacacattcctctgccttgcttccagtggtgtcccaggcagtgacattagttcctctccacgatccctttgctgtccccactctagttgggcagctccagcctctgggctctagtaacagcatctcatccttgattcctccagccctggggatggtggtagcttcttgttgttgctaatctctgggttgactcattgtcccctattttcatttcagctcttctaacacatttgtaactaattccccaaattgaatgctctctcttgaactaccaggatatgtcccattttactgatggaccttgacagatacaggtctacataagcaccctggttggtacatggttaatataagacccccaatctcttctccattgtccctgttcccccaaaggactcttctgtctaccatggttctccatccctcagagttgggctcctggcctggactgtcttgaagggcaaacatttgtgctgtgcttcctgaatggcatgagaaaaggagctcttttggcctagcctccttcctgtaggattttccaaaactttccagatgtatctaagctcaggaaacattttaatggctggaaataatgtctcatgggggttgggggtttgaaaccaacagaaccttctccaaaagaggtgtgttgaaatgttccagggtctgtatgcacacatccaaaccctgcccctcccctgttgaaagcatggcaggctcccaccctttaattggttcatgtcgtagaagagttggcattctctgaatgccctaatgacatggagcagaggaacagctccaaaggccagaactctctccaggagggaaaggattattaagcggttagtgatgcatttggattctaattcagattccacctcagattctgtaaagagactcctataaccctcttcttttggccttatttggctagtaataatggttgtaagattgatctaaatcataataaatgttgtctaaggctgctcttactgacttaatgaattggagcattctgagttttttgtgaggataggcattatccaactgcagaatacatattgattctttttcaaacaggctgtggcttttactttgcaatgttgcccacatttcatgacaactttcagaacaaactctgttgagggatgaagattattgctatctgaatgcattcatcaaagaaaagtagaagtggaagaactatacttctgccttctcatattcttcagcattgggccaagagtagaaagtaaccatcatttcagccaggcacagtggctcacgcttgtaatcccagcactctgggaggccaaggcaggtggatcacctgaggtcacgagttcgagaccagcctggccaacatggtgaaaccccgtctctactaaaaaatacaaaaattagttgggcatggtggcggacacctgtaatcccaggtacttgggaggctgaggcaagagaatcacttgaacctgggaggtggaggttgcagtgaggcaagatcgtgccattgcattccagcctgggcaacaagagcgaaactccatctcaaaaaaaaaagaaagaaagaaagaaagaaagtaaccatcatttctagtctgtggggatcaaactccagaaattgctaaattattgcatgttctaatactacagggaacagctgaaacctcatccttttgagaactggacttgaatccaagccaatattgatttatttgggatgtgtcttgcaagtccacaaatgctttaacacagtaatcactaaccaggatacttatgtagttgtttgatgactcatagaactttatagaccttggggtcagatatatgttttatatgaaaagagcaagattttaatgaaaaggaagtaggtcatgtgcaacaatgtaactacagtttctgtgtctctgaagtgttcagttttgtatgacattgttagttctttcttctgaccaagtttccttcattagcctacaagggagcctatgaagtgaattcacagcaccagaaataacatgagaagaccataattttttaattatttcagagattaagattaatttaggccaggcacggtggctcacgcctgtaatcccagcactttgggaggccgaggtgggtggatcacgaggtcaggagatcaagaccatcctggctaacacggtgaaaccccgtctctagtaaaaaaacaaaaaattagccgggcgcggtggcaggcacctgtagtcccagctactcgggaagctgaggcaggagaatggagtgaacccgggaggaggagtttgcaatgagccaagatggcgccactgcactccagcctgggcgacagagcaagactccatctcaaaaaaaaaaaaaaaaaaaaaaagattaatttatggattctagtatataacatacatacataaactactgtcttcatatgtgggtacctggaaaaatttttccattgcaaaaaagataatgttattctaaagtaaaattctagctctgtttctaattagatatgtgatcttggacaaatgactctgagtcacaggttccccttctataagagaatttcatgatctagaagatgatttcactttctggttctatgaagaagaagcaatgccatgctatacctcagttactattttatacagtgggaaaagtctcattatcaacgggcgctggccacattgtttgtgctaaaccataggatataaccctaacactctgctcagttatttatttggctgacgacttcctcttgtaatacttcttgacaggtggtcagaggaatacctcttggaatccactggcagagcttgttaaaaattcagattcctggacttcccagactaaatcagcagctttgggggtgggtctagaaatctgcatttctacattgctgggcaattcttaaagatacaaagtctgagatccatggccagtcaacagcacgtagtgttaatatattctatgatgtgaattactttaactctctttactctgcgtccagtctgcagggtcttagcccagggcctactactgactggatgatttggtcacaacctttctctctctaggactgttttcttatttatgaaatatggggtctggagtattagtctctaaggaatctttgtgttctaacagttcatgaaaatagttctctagcagcatctgagagagttactgaaactaccttaacaaatcctatttcttgagtgcctactatgtagtaggcattgtgctttttttttttttttttttttttttagctagagtctcgctctgttgctaggctggagagcagtggcgcgatttcagctcactgcaacctccgcctcctgggttcaagctattctcctaccttagcctcctgagtagctgggactacaggtgcatgccaccatgcccagctaatttttgtatttttagtagacatggggtttcaccatgttggccagcatggtctcaatctcttgagcttgtgatccgcccgcctcggcctcccaaagtgctgggattacaggcatgagccactacacccggccggtgcagcttttatgtatgtttcatttattctttatgctaacctgtgatattattattattattattattattcacacttaacacttaaggaagtggaggctgtgaaaagttaagtaacttgtccaagccgacttaatcaataagaggagctgcagtaaagtggaatgaaactggggctgtgaacacctaaagaatgacccaggttgttgctccccctgaaacttcacaaggcctgggcctcatgcagtgcactgctcattcaccctgtgttccactctcccagcaaaggagtcctggttttggtttctttcgatgtttacttggcctcttgcttaagcatttgcctttcctcctcaataacagtgaaaggactgaaaaataataaaataaagaaaagaaaatcccagggctggaaacattttgtttcctacaaaaagaatattttgcggccagctctgtggttgaaagtatttttcctgtggtctagggatgagttggatcccatctcttcttggccagggtctgagaacttagcctgtggcttcccatcgagtcagcacatagcatgctattttttgaacgagtgtctgatgatgttgaatgtgttcacgagtggacgaataggtctgtttgggtgtataagaaatgtgcgcatgtgcctctgactcttccagggcagaaggaacctgggagtggttttccacatgctatacatatcaacgtagcttttaagttttcatcactcacatgatgaccaaaaaaattcagatgctgacaaatgagaggagggtgatatgtgagccttatgtggatttgcaagtaatcagaaagccagggaatctaagattccctatcacatttctttccattttcaaatggaaaatgtcacatttctttccatttttcaaatgctcaaaaccaagacatggggttggttttattatggcagggtggtctgatggtaatgcagaagatgggaattctgagagctgccccagcttgtccaccttcagcctttgggacaccaactttgcctagccttgaataagtcactttttctcaaggactgcattttcctatatgaaaacatgaatttgtgtttaaaaaaaaaaaacaaaactttctgctttcaagaataaaagcttctctagtgagggatgaattttgaatattcaaaccgaattcatggataagaaatagtagtgctaggtaccttttctttactcataaagcattatgtactcatatttgtatgcttccagtatgactttgaagtgtatattagtgcctagaacttttcagcctgttctccatggcatggccttcatgattctatctcttacattcttgtaaagaatgaagaacgggtgttctctggactctcattgcacatggttttatgttcagttacctgctgactgcctccctgtcatgccagctgcaagtcacagcacagtgcctggcacagagcagatgcccaacttgtatttgttgacttaaataaaacttctccaaagatgacaagctactgtttgtaacttcagtattctcttgtgcgaagtcctctacatagctctccattcagggacatttctagagctcaaatcatcatgacttccaggaagaaaagttgtagtcactggattagggggcattgtttgaggaaataagcaaattccacaggtggaaagaattgtgaattgtgtgtgtgtgtgtgtgtgtgtgtgtgtgttttgaggtgaaagaggtttagggaaaatttgaaaagctattggaatggaaattaaaccatccagagtgttttattttagagggatagggtttaagatagactcagcagtggtggcattggccacagggctgcacctaccctgggatgcagaaactggcccatccaagtcagctccatgggaaagaatgaccacaaagtgatcaggggtcaccagtgagaaaaactggcatttgctgtattttgtcacacaggacagtagaactgttctcacagtaggagcagggatggggtggaggtggtggtggtgattttagtaaaccagttttctggtgatgggggggcatatttctgtttttaccccttaataatgagacagcaacccaaataacagatccctcagtacactgaaatgccaaggctaaatgaactggtggaactttgtggctttggctcttggcccacaggcatatccgtgcattagagccatggcttggcagtagacaaagcagctgtgtgggtcctcggggagctctctggctctgtggctttctttgatatgcaactgaactttggcaaatttttcctctcatggcactgtttatgaggtccagagaccttcattatggaacccaatgccaacagcaaactagaactacaggatgtcttcccacattcacactctgcttgcaggctgaagagttagcccacaaggctttcaacaaagggacaatttaggggaagagactgcagaattctcttctcagcttcacatggctgtaaacccataggattggccagacctcttaaactttctttccttcagaaggaaaagatctcttacttaaaaatgattctgtataagattactaatttactgatttccaattcaatagtatttaaaaacaacaacgacagtaacaataatagctagcattcatcaagtacttgaccatttgctaagtactaaagtgctgtgcatgtattaataaaaatgcatttattatcaacatctttgtaaggtaagtactattatccccattttatacatgaagaaactcaatcccaaagagattaattgttagttgttattggtcttaataattattcaccaatttaaggtataatcctgcagatatagcttataattgactggctttcctgaaccccaccttcctcagtctatgacactgggccacagatactaaaataattaaaattatcattcttaattgttaacccacctcaaactgtaactgggtcttgatgagtttcaagtagtatcatccttatattgggaaatctataattaagacttttctaaagtcatgagcaggtatacagaaagtgattgacttggtgaatgagagggatcaactatcctccagagcttgtacagtagagtggaaacaaatgtggtgttggactgagaacggtttaaggtattggaggcaatgattctgttcaagtgccaagattaaaccaatagactctagaggggctcaaaagtgaggctacatgtcatggtttgacgtctaaattatagctatgcaactttctttcctacccatttctactgtatcctctgtgctttctataatagccgctccagggaatgctgataataacattatcggctgccatttttatgccaggcacatgataagagctatacaaacatcatctttataatatgctgtgaggtgggtttttacaataacactgtgaagtgggtattactaccctgaatttacagatggaagaaatgggctatggagattatgaagtgctctgaagttaaaacaactagtaaatggtagaaaagagactctgaagtgacttgtagctactagtttgtcttgcctcataaacaatgtgatagacatctggtatttctgcttgcccttgatctcttaccccttctctcatacctacactatgattttcctgtaaggaaacatgcctcttcaatttttttcagcctatgttgtctagttagagctgagggctgattgtacccactgggttcatgtctgaccaatggaaggatcacatttcctttctacagagattggtttgcaatagttggttaacccaagctaagttgaatagagtaagcccagaattttgctgaacaataagagttgctaaattggtaggatataagcctggagctccttgtggctgtctttgccaccatatgaaggaactcacctcagaatgacaataaatcaacgtagagaaaaacaagagattgagagaatgttccaggtggaaggaggaattgaataattgaattaatataagattatgaggccatcatctgaggccctggatccaactgtgcctcaggtcagttactcctgacattccagttaagtgagccaataaattcccttttttgtttggtctcaatcacatctctgttacttgcaacagaaagaatactaaataatacacatattaagctgggtgcggtggctcatgcctgtaatcccagcactttaggaggccgaggcgggcggatcacctgcagtcaggagttcgagaccagcctgaccaacgtggtctactaaacccatctctactaaaaatacaaaattagccgggcgtggtggcacatgcctgtaattccagctactcgggaggctgaggcaggagaatcacttgacccaggaggcagaggttgtggtgagccaggattgtgctactgcactccagcctgggcaacaagagtgaaactccatctcaataaaaataataataataatacacatattagatcctcatagttacatacaaatgtgggccagaaaattctaataatgagaacctgtattgttaagttaaagagtttattcccccattaagtagagataatttctgattacttaggtctactttcctggttcctatattattccattccttttcttttcctcttccatcttatgcatttgctgttcttcttcctagtttccttttggcctttttattattcacctccaccacagtagagagaaaaaaaaaaagcatgaaacttacaataaacagcttttctggcttataaggctctttgaaaagtttcagatgaagagtaagttaaaaaatattaactaaaaagcattaaacttacaataaacagcttttctggcttataaggctctttgaaaagtttcagatgaagagtaagttaaaaaatattaacttaaaagcaattacgaaatcatttttgggttttagttagccattctatccatgacctttttttttttaaaccacatattaagcttgatgaaagtccttgatgtcattgcttccacgacaaaaatacaaccttttctgggttagtttcccttaatcattaatgatgagctgtaaaatattctttccagttcaaaagtggcatcaaataagtaactaagatgaaattagtaataattttggaaatgtggtcatttagcaagctgatatttactgaacatctactgtgtactaggttaggctctggaaaaagcaaagatgaataaaacataattttcaaaatctagctggatcggcaagtctgaattgggagtgagcaggaggggcagaggtgagggctgagcctggagcagccagttggcccatactgaggaggaccttccaaaggctttggaaagtagatactatagggagctgaggatggtcttcaagaagtgaaaaatgtgctaatccactggggagagcttacgggttatatacaagggtgttatttgtctgacagagaaaactcactttaagattacatgaatatatgatccatatagtctaccaggacatctcttttatatattgaccagaataatctgagaaagctggaagtacaggcatttaagccactaaagctgtggactacagttcaccctaagcaaggaagcgagtgttttttaacatgtcatctcctggattcccgaggctttctgggttagctcaaacctgggccatttagcttcttatgggcagggacctcatcatgttcatctttgctttccctaatgtctaagccagtacttggaacataggaggtactcagtaaatatttgttgaattaatataacattaaataaatcattcagttctgagtagtcattgtttatacttgctgtaaatatggttttatgtaatttccaagtgtgtctgccctttttaggtcctgtattttcattttggcatagtctgctttcagtggcacccagctagaatttgcctgctaaacagaaaatctctggtgacaccgaattgcatatcctggcttgattgctgatggagaatggcagagcacacactcttatctttagcttgactttccatgtataagagaggggatgtttttgtttgtttattctgaaatggaaaacaaaaaagtaatgcatgctagttgtgaaaaaaaaatcaagcaatatagtaggagggaaaatcctctaatggtatataatcttctaggctttttctatgcatatatcaaaatatttatgtactcaccatatataatgttatataaactactttaaaattaatccacacattatggataatttttcatgtaaatatacatattactaaccgtttttcatagcagcatagtattcatggtatggatatacaggaatgcagttaagaggataacataaaaatgaacgaaatgttgtgttccttaaaaactcatatcaggaaaatctaaagtattttcatttctaattatttttaaaaaacaacaaaactttgtttcaaaccaaagaggtagcaatatagcttcatttcagaaattgctaactccgtgcatgaatattgtagccgtgctttgcttcatcattaaccttctctaattcttctacctagggaccccaaagagcatggtaaacattttacaaagtctccttaaagatgctggtctggactgaatggatctttaaatctaactgtttttaaatgtcttttagtaaggcccaccttaattgagcttttttcttaagatcctgattttaaaggggtggatggctcagaaaactgctccagatcaccaaataaaaaatcaagttctgaacagtgagacacctttaggcccatccccccagctgtccccaagatcacactccttcatcatgtgtctcctgagagtcagagatcctgcagctgtgcctgaggaggactgaggtctccaggctcttgtattgctaaacctagtttttgtttttgttttgtttccattctcttttttcttgcctttttttcctctgtggtgtctcatttctcctagagtcccggctgactcccctggggatgaatctgcctgcctgtgcatacaggaatccacagtgtcattagggtagttatctctaatttattcttcctccttgtgattagaagaactcggtctgaatattgaagaaaactcatgtgggctcttgtctttgtgataaaagcttctgtcccatagtaattaggcagagctctagtttacttctaaaacatgattaactccttggaaaggaggggaaaaaacggaaagttatttaagatgggtaccctaggggaacaaaggagaggcttttcccattgttatgcctcctaattaggccaagcccaaggttgctgtgtgtcattccaggaggcagtggcctgcctggtaggcggataggagcagaggggtgacagaatgaagctgacatcagaaaggcccaaaaagagcttagggctttttttttttttttttttttttttttttaagatggagtttcactcttgttacccagactggagtgcaatggcacgatctctgctcactgcaacgtccacctcccgggttcaaacatttcttctgcctcagcgtctcgagtagctgggaatacccaagtgcaccaccacacccagctaatttttgtatttttagtagagacggggtttcgccctgttgaccaggctggtctcgaactcctgacctcaggtgatccacccgccttggccgcccgaagtgctgggattataggcgtgaaccaccacgcctggccaggactttttaaaagactatatcttctgaacttgcctcctgttccacctctgaagggccctcggggagagacggagcttagataccacactctgttctgtagttcctcacatagtttttctcactcagaaccactgaaagaggttaggttgctttattcctcatgactctctgttttgcttgacttgtttatggtgaacatgtggtatttacataatcagaaaaacataaagccatattcatagtgtaccaaccgggaaagagagagaaaaattaattgtttgttgggactggcaaatagtctcacagtgtagtcaagtcaacattaacagtaagaagggtatatgggattatgaaactgtaaaaggcccctgaggattctgagcagagttcattcttagcatgactgtgggggctcagtgccaggccatgctgcaccccacagagggccctgtccagacttctcagcacagggaatgcctcatattggacagtttttgactcctgtgatggtcagtattctcagcttcagggccctctgtttcaggcaagataacctattcactcattctatagaatgctcagcctgatggtatgtgtgttaagtaggtagactgcctggaaacacagattgagcaccaacaaatgattctaatgagaattttagaattttaaactccttatatatccagtctggttgctatcaagctcttcctaccaagttctttctgagatccttctggtgcctatacctgtttcttgaattatttcagtctgtgagcttatttctatgaattaaagataccttaattcccttataatagttgataagtgagtcattctatggttatatatagtgtaagatttagaaacattcacattaaaaatattgaaaatacaaaagacgaagctgacaggttcctggttataccctgacagcactggggagagttattgtataaagttctagctctcctccatcttactgaaactaatttcgtttgtgcttaaaggaaaagacaggaagggtgccctgttgtctctctgttacactcttcaactcatctgaaatcctgtcttgtgttttcttcttgtcctttgcccttgcatttgctggaggaggactttagggaaatagtaagaatgctgcggtaacagagagaattaatttgaccgtgctctgaagaaagagcatgttgatttctcactagaattggttcctccacccatcagagcagggccagggatgtggtacattacacaaaccagtcccatttgaccagctgtttttggatgtgtcaagcccagatttcagcccctttacatagaaacatgttgccttccttgaatgggttcctgtgagactaaagaaagtcccgtgtggtccaagcatgatgtaacagggatgtgtgcttcagaattcaagacacaccctctgagttcctggcatctttttactatagtaatcacacagccatagtcttccttctgtgacccttgaaggccagagctgccttgcctctgctgcattttctaatgggcctggacaggaggacccagctctgtttcttatgggtcttgtggatggcgctgggaaatcaggcttgcctaactggatatacagagcttagcattaacagctggacagagctcttgtgcatcttgttttttttggttatttaaatactcctgatttagggtggagaaagggaatggatttctgttgcttgaaattccttgcgacagtatttgtttgctttaattggcgctagattgaagttaccaaattcagatgatgatgaaaccagttcacacttatttgaaaattgaaattggtgatacttatgttaacttttgattttttaaaaaaacaataaaaaataaaatttaaatgtagtatttgatggcgatgagcttactgacaataaagtcaattctcacttccttcagcatacccaatggtaatattaaacaaatggtaacattaacaattttagaaatggttagaaatatgtacagttctgtagcatgtgtgtgaagttgtacattagccttgcacacataggcactctcacatggacagcaaggaaaggcagaccattgaactaactctttagcctttaaaatggggcaagttactaacttttctgcaatttttatccccataagattctctcatcatagtggaaagaaactaatatttctcaggttcctatgacgtaccgcatttttcactaatttctttcatctctttaatcctcacaataagcctatgagatgagtgctattgtgttcattttagagatgaggaaagtaagtcttgaagaggttagagtacccaaaatcatatagccaagatttgaagccatgcttgaccagatctaaggtgtgttacattttgtaataatgatgattgtacttgaccccaagcctcctttttttagccccctataaccatgacttgataatagctaaaaaattgtattgagtagccttaagaggagctatttggtacatattcacatgtgggatgtgtgtgtgtgtgcacatgtgtgtgtatgtgcataaccctcaaactgatattaagataatgttactaaatcactacctaattggagatagaaaaactaaagttcacaaagagtgcctgcactttaatgtggaggtttgaccacatatgtatattctttctcatgattcatttgaaattatgtctgtatgataaactaataaagttaatccaaaaagacaaagagagcatgaatctttttgagatatcaacaggcttcagcaaataatagaacacatgaagtgatacaagattggcaagaaagaacagagacacttttgtgccctcaaagtagtgtagcagtagaacacttgagagatttcttcaggacttagaagaaccagatatcatagaagacagaagagacaaaaacagcagattggtttaaaattgtatatgaaatatatgaagtagctgaaccccctttttcaccctggaaagctaagtgacaagtctccaacccaggataaaagccataatttatctttggagaaagacttgggactctagacaaagcataggacaaaaatgggcattttattaaaacaggggattatgcctgccagatggtgagtctacagcccctttctctgccctgcttctagaatgtagcaaccaaacaagagatttttataaatatcaatccacctctgagaaggtatctccagttattgactctacagtggatcccaccgtttacaaatgctgtgtatatacatggtgcttttaactgtatttttagtaaaaaaatattttatgttttaaatatgattgaaaaccaaggatcaccagactttggaaaatgcctctcatagcaaggagagaagaaaatagagataatgtgagactcaaaagaaaacttaaagtataattaatttcctcagagagttaaagatgacataagaacaagaataggaagcactgaattagaagtggtcagaagacaaggaagagcacctggaaattaataatataataggtgacagattcaattaaagagctagaagataatacaaaagtgaaatcatttgctgttttcaattttatgtgtaaacattaagttgattaaaagatcagttgtctagtgctgtgaaaacttttaaaacagaaaaaggaggagtcaaaattgaatagggggagataaccaagatagatactgaatcaggatgtttacattttggcttaggagactcaattttcagcatagtggaataaggcactcccaaactctacacctccataaaagtaacaagaacattgacaaaaacttaaaaaaaacttcttcagaattctggaaattaaataaaggctcacaacagtctgaggagtgtttatttgagaaaaaaaacaagtgactctcaggaagaacagcaagacttgtggaattttaacttgccctaattccattctcctttcatcagtgctacagtaaccttgcacaccaacaatctttatttgtggcatctttgaaagccagcatggtagcagccactggagaggatagaacaggtttggagcaccttaaaaaccccatcccagagaattgctattatttgacctgtccaacagcatgctaaaaagctccattctcagggcttgtctttatttgacttagattcagaacttggcctgtgtgaacagcactatccacagagcatttgtcaaaaacagccagtggtaattgctcaccatcatggctgcccaaggctccattaccaggtagtgccaacaagaggctgaccaaaaaatacaaaaggaaaatctgggggaatgagatagctacagtgggttttataaagctcctacatacaccaggaatctagagggccacatagatatccagggctttgtaagagctgagaaaacctgaagatctcacttccagctgaccttgaggctgtgtgcaagaaggaagtgaagaatgaaacagagttatatggcttgatggagtattgaatgcatgccccaacatacacacacacaggctgaaagatttactgattcacagcatttaaggaaatctgtcatgtcattagtggaccacgaagtggcttcatgtataagggaccttcaataaaattaactgactgacttctcatcagaaaccacagaagccagaaggtaattgaataacatattcaaactgttgaaacaaaaagattgtcaatccagaattctatatccagcaatattatccttcaaaactgaaggagaaattaagacatttccagagaaaacaaaatataagagaaacacctgccatacagaaaatactacaaagaattcttcaggctgaaatgaaaggacactagagagtaactcaaatcagtatgaaaaagtaaagtgtgtagccaggtgtggtggctcacacctgtaatcccagcactttgggaggtcaagacaggtagatcacgaggtaaggagatcaagaccatcctggctaacatggtgagaccccatctctactaaaaatacaaaaaaaaattagccagacgtggtggcgggcgcctgtagtcccagctactcgggaggctgaggcaggagaatggcatgaacccaggaggcggaggttgcagtgagccgagattgcgccactgcactccagcctgggtgacagagcgagactctgtctcaaaaaattaaaaaaaaaatttttttttaaaaagtgtgttggtaaagataaatatgtaggtaaatgcaaaagacaatagaatgtattttcatttgtaagtcttttcctctcccatctgatttgaaagataactgcaaaaagcaagaattataaaactgtgtagatgggcttataatgtataaagatgtaatttgtatgacaatagtacaaggaaggggaagagaatagagctatattgatgcacattttttgcaaacaattgaaattaaggtggtatcaatctgaactagttttaagttaaaatgttaatggcaatcctcagggcagcctctaagaaaataactcaaaaatgcatagtggaagaaacaacaagagagttaaaattgtacactagaaaaatacctaacacaaagaatgcagtaatgacagaagatagtaatggcaaaacagaggaacaaaaaggaaatacacacagaaaacaaatagcaaaatggcaggcatatatcctactttatcaataattacattaaacgtgagttgattaatgctccaaccaaaaggcagagattgacagaataattttttttaaaaacaacatgatccaactatatatgctgtctacaggagacacactttgagtcagacacaaataggttgaaagtaaaaagatggaaaaatacatgtcatgcaaacagtaaagaaagctggaatggctatgctactatcagacagattagactgtaagacaaaaatcattactggaaacaaaaaaagagacattttataattataaaaggattgctccatcaggaagacataactataaatgtatgtgcacctaacacctatgccccaagatacatgaagcaaaaactaatagaattgaagggagaaatagaaattcaatgataatagctggaggcttcaataccccactttcaataatggataggacaactggacagaagttcagcaaagaaatagaagactcaaacaatactctatgccaactagacctcaaaggcatctatagaacactctaaacaacagcagatacatgttcttctcaagtataaattagactacaagttgagcctcaataaatttaaaagattgaaatcatacaaacttctccaatcacaatggaatgattttttttttttttttttttttttttttttttttttttttttttttttttttgctttttttgagacagagtctcactctgtcacccaggctggagtgcagtagcacgatcttggctcactgcaacctctgcctcccaggttcaagcaattcttgtgcctcagccacctgagtagctgggattacaggcatgcaccaccacacccaactaatttttgtatgtttagtagagacagggttttgccatgttggtcagggtggtcttgaactcctggcctcaagtgatctgctcacctcggcctcccaaagtgctggtattatagatgtgagccaacacgcccagccctgggatgaaatcgataatcagtaacaaaaggaaaatttggaaattctcagttctgtgcaaatttaaaaacacacacagacacacccctaaataagcaatagttcaaagaataaatcacaagagaaattagaaatgagtgaaaatgaaaacaaaaatacaacatatcaaagcttatgtggtgtagttaaagcagtagttatagggaaatatacagtttaaatgcttatgttaaaaaattattgcatgtatattatacctaaataaagctgatattaatgtagaaagaattggtggcccatatttttgactgtataaatttgcatactaccatatatttgtagttgataagttttctctgattgtggtataattcaggaagaattactaatactttctttttttttgagacggagtctagctttgttgccaggctggagtgcagtgacacaatctcagctcactgcaacctccacctcctgggttcaagcgattctcctgcctcagcctcccgagtagctgggattacaggcacgtgccaccacgcccagctaatttttgtatttttttttttttttttttttagtagagacagggtttcactatgttacccaggatggtctcaatctcctgacctcgtgatacgcccacctcagcctcccaaagtgctgggattacaggcgtgagccactgcgcccagccctaggaattattaacactttcaaaccacatgtaaagttcactgaaaaaaaaaaaaaaaccaacatggtttttaaattgtgttaataaatattaagcttgtagttaactatatgcatgctaaagtagttagagaaaagtgtactgatgtttgcaatttactttgaaatgtaataacaaccagaacaaaaaataagatgggttgatagataaatagatatgtgctaaaaaacaagtgtaataaaattattttggtctttttgtttccgttttttgagacagggccttggtctgtcacccaggctggagagctaatcatagctcattacaacctcaaattcctgggttcaagtaataaaatgttaatggcagaaccagttgatatgtttatgggtattcactataaaattctttcacttttgttttatgtttgaaaaggttcataataaaatgttgaggaaaaaaccgtaaactcaaaatgtcattctgaccctgaactatttactattccataatttactaagttaacatcctactgatcagaaaaaattaatattttctttaaggagccctagctcttttctaggcaatactttcttatactttgggaacttgatgtgttatattataggtaaacattttgaaaacaatcaccagagaggtgttatacaagagcataatgatattctatgaggaaataggatcttataacctcagggtcaaaattcctaagagactcttcccagagactacaattatattatttatatatcatattattatattgtatattattatttatattatattttttagggattcagatcagcttactttatgtcccctaatttctgtagaaaaacttgggaagtaggccacatgtagacaaattaataaattcatgcctgctcaaatacagttcatttttccatcctgccattttccagcactgtattacttctacagatcttgctcttctattatgagaaggcagtttagatgccgctaaactcattctctgctctgcccgcataatcctgcaaagctgctggtgttgaggcttcagtgttccatgcagagtgattttccaagtgatgaagcagattctaatcagtctaagatccaactacagactgggagttggacctctgccacctttccctccagctctcgcaacacaatggggaattcctgtgaggatcactgggtacacttcaagctcccctgatcctatggcctcattccagtcacagatcttcctgtctggagcatttccggcccttctgtcctttggcttggagagttcagctcaacctgggaagggacagaagactttggggttatcaaaagcctgttgaattatctgatgcaagactaactggtttgtttgcctccctggctctcttcctgagcttcaaagcagctgagaaaacaacttttttctaagtcttggacaaggaggaaaaccctggcatgaaggatttctgtcgcagacacttggcatagctagaggaaaggtttgtttaacttaccaatgggttttattagcctaggactccagttgaagtgagataatagggtccctgtagaaggacatttcagtcagtgggcttcctccctaatttctcgacaggacccttgcatgcagatgaaaagcatcagacacattcaacaaggaaatccccactgaatttatcaacgaccacgtaatcttgctgatcatgagggagactgagacaggattaaaaaactagcaggacaggaaattgtgtatggatgcaaagtcatattggggagctatctacttcaattgcttcttgctgaacttctctttgctgaacgtattacattgtctctgggccccacatcttatagcagatagcagggatagaaagaaagccagtcctaccacctgtccttacaggaagaaactcttctgcttatacttttcctctgccaggtcatttcactcttcctttcacctcccaaccaatgtgagatttggggttggggtgggaaggggaaggaaatagaagagaggaagaattcatgactggtgtacaggaagccttcctggcacaggaattagagaagagaaagtagaagaatcagtgccagcttaccctcagcctcatggccgcctattcatgtctgctttcctgggccacataggcaaaactcactttttcctaaggttggggctgtattgcaggaactcatgtaaactgccaggaccagaagtctataaaagcagcctccaggccgggcacagtggctcacacctataatcccagcactttgggaggctgaagcaggtggatcacctgaggtcaggagttcgagaccagcctggccaacatggtgaaatctggtctctactaaaaatacaaaaaattagctgggtgtggtggcaggtgcctgtaatcccagctactcgggaggctgaggcaggagaatcacctgaacctgtgaggcggaggttgcagtgagccaagatcacaccactgcactccaacctgagcaacaagagcaagactccatctcaaaaaaacaaacaaacaaaagcagcctccagggtagcctgtgcccaaggttcctgacatctctgtgctgcctgctccacactggccttcctagccacccatggagaaggactgggctgggttgcctcagatgagggccacacctatactttaaaaaggaggacccagacactatccctagaaggtgtcgccatcctggagaaggcctggggtgactatgcccagcactttctgttctgtggctccttttccactttctgagcctcttggaagtgggatcaggccaggaaaaacatgtgatgctatagcaagctgaaaccaaagacttgactttgggcctggccaagccaagaatcttggcagtgattgactgggaagcctgctgttttctatggcattttctgagtcccctaactctgggaagagggaaccagataagtcctaaaaatggatatgaatcagtagagcttctgtgggtcatcaatttgtgcatttattcactcattcattcttgtatttcataatgaagcttctcttacgtatatagcaccacactagaggtttgtgggaccagaaggagcagcaacaacaagaatgggtcaaatagattatgttaaattgaggtaacattaaccataaaacagtaaagaaaactaataattagagagtacagataaagtatgaagagattagagagagatgactttaggctggagaaatcggctgaagcttctggaagaggtgacatttgtatttagactttcagggatgaagggcagaatgaagactgccagtgtggaagcttgcgaacagctgaggcagcccgcacggataccctgtccagctcccttctttgtcttgaatcatgcaatatccatgcagggaaaaaaaaaaaaaaaaaaagcccttatttgctgttatgtatcctgcctcatttaatgtattatcccagaaaagtagattgagttgtatgtggcagattgggagctgccatcatggtggttaaaagtacagaccaggtagtacagaaccaggtagcctgggttggaacccagcttcagtacttataagctacctacctttgaggattattgtgaagattaacgtccattggttgttgttgttctcatcagcattattactgtaggaaccctggaagtctcccctacccacccaagtcctattgcactttctatcatgacagaccatttctcttttttgagagtcttatattacaatgcagacacacctgagagggctaatgcgtgaaggtttaccagccctcactttaggggtagagataattagctgacagcttatttactaagagcaaaatagaaacctggggagagggacataaaagaaggaggagagagtttacaaggagaagcccatgggccccaatggccaattttccttccacgctttatttagagtacataggcctctgtgtttctacttgtcattggagagaaacctccacacaccagcatagggatgaagtgaagaacagtgaggaagatgcctgcccatcattctaggagccctcagctgaaaagcaccgtattgggccctagagaagggaacagagtgagattacagaaaatgccccagatctgctgagtcccactgaaaattcagagcttgcctctaaaaaataaactgaggtagaaacaggtagcagtattttaataagtgcacatttacagagtgtaaattgaatctgcctggcccagagtgtggtactcaataaatgtttgttgatggatggattgaatgccctagagtgaggagcacgtagtggaatgtcacagtggaaaaagcccaaaggcttccctgtattgtctgtcttctgccaccagaatgtcagctctatgagatcaaggacctctctgtcttattccctgctctatcccctgcacctacaacagtgccaagcacaaagaaaagagcccagtaaatatttgtggattgaataagtgcatggatgggtgggtggatggcacaaataacgaaaattgcttccagatggtagtgggattggggatccagcatcgagtacatattggatataccttaaatgttcctccaaagaattgatggatagttggatcaattaatcaaaacagagtctcacgatgttgcccaggctggtctcaaactcctggcctccagcagtcctcctgcctcaacttcccaaagtgctgagattacaggcccgacacctccaaagaattttaaaatatgggtgaccactttccttgcaaggataggtaaagagaggagaaagtgtatttgttagagtgcagttaaagccaagctggtctgatatgaaggaaatattcaagaagaaacaatttggctatttgtgggagatgggattaactgcccacataccacatacctaccacaaggagccccaggctttctgagccacatatatctacactcattcttgctcagttacatatttctttgaaccctcagacttccaaagccaactttcacacattgcacacaggtttgagtgcgatcagaatttttcactagggccctgttgttttattaagtacctaggcctccctgcagggcaccatgtattgaagaagatagaatgatacttgaaaaccacctaagtcagacaatgattagaactccccagatttatgggatggatgaacatctgaaccagcacagcctaaattacctgctggggggttgtctgctttggaagaggatagtttatagtttgaatggcagaagggtcatggggcattaattcagatcaaaaaaagggaggaatctatatgtatccacaaagatacatggcaagcatcactttttttcctgaaatatattgggctagaaagctaatttacacttcccctcactagtatataatactatagaatcttcaggttagaaaactcaaaagcaatgtgcatcttcatatagtatatactactagcatataatattacagaatcttcaggttagaaaactcatagtgaaagcaatatacatcttaatatagtatatgctagtatataatattacagaatcttcaggttagaaaactcatagtgaaagcaatatgcatcttcacataatatgtactagtgtataatactagcatatgacagaatcttcaggttagaaaactcatagtaaaagcaatatgcatcttcacatagtatatactagtatataatattatagaatcttcaggttagaaaacccatagaaaagcaatatgaattttcactccagtcctcttaccatgatgtttgcattgaagtgtttgtggtcattgattgctttgggcctctaaccaccttcttgtttgtcattttttcttttggaatttgggccccagtccaaacacattgcatcaggcatggtttcctgggtgaggaggagagcaggactatcacctcccttgttccacatactatatctccattgatataacctgagaacttgctagatttttgaaaattacatctcacagctgactaatattgaactatagttaaccaacattccattttctgaatgctgaatctcattctggctgttccataatgaatcattggtgctctgttctcaaggacaaggcatttcatttagttcaataaaattgcatcccaaacaatgtgtaggatttgttccaacattctaaccaaattgagatttgttttgatatcatgtttatctgatctaatatatgacctctttctctaaattttttgtcttctgttaccttcccatcaattcagcatctcatcattgggtttagttacatgattcacaagtccaaatgtcacctcttcagtgagatctcatgatactctattcaaaattgatgcccccacctccaatccagtacacttcctgtattctttatctgctcttttcatccattgcacatatactcattgaacataacatattttatttattttgtacttcttatctttctttagaatgtaagctctattagaggagcagtttttgtcagttctgttccctgctagatttcatatttgttgtatgggtgtaattgaatacatcagcaatcttattcaagtcagtaagaccaagctagaattctgtacattctactagaggttgctgcccctcaccaggttactactgaccttttggtcactcacaagtccacttaatggtattagcacccagctcaacttatcttcactttatccagaaggctatcaagagagtttgtcacattttttgctgaaatcagatattttttattggtgctagccctctgatctatcactctggaagttcttttccaaagaaaggaaatggaattcatctgacataacttatcacttccttttttctgactgcacacagatcatccttttgatgactcattataaatcctgctccagaaggacagtgcattaatcagtgacctgtccgaactctttgatttccggcagagaggtccctccaggtgtgagatccttttggctggggttcagggcttgctcatagactggctattagaaggtggagttagcaccacagagttggaaggcttaggctcagatgccattcttgtgtctcattgaaatattacattctttttttctgggtctcagtttctgcagtgcataaaataaaaagggtaatatttttaaaaatatagcatgatactttatttattgctatttacacccttttggtttcatgtctagttgctacatacagacaacaaagatctgagatttttttatatgtttagtttatttttactgctatttgatctaaaggatttacgtttatcttatccatttccttttttaccactctttctggcacagctatagtttaggcccttatcatctcatcactgaattattggagttgcttcctaactggccccacatctcccatctcttgcttctccatcttagactcttcaatcaggctaattgcctagaacctggctactcaaaatgtagtctatgaaccacagcatcatcgtctcttgggagcctgttagaaatgcagactctctcaggctccactcaaaacctaaagaatcagaatatgtaggtcaacaggacccataggtgatgcaaacccacattaaaatcgagaaccactgttttttcttctaccatgccattccccttctaagggatatccttaaaattcacattgaaccgggccaggcgtggtggctcacacctgtaatcccagcactttgggaggccagggcaggcggatcacgaggtcaggagattgagaccatcctggctaacacagtaaaaccccgtctccactaaaaatataaaaaattagctgggtgtggtggtgggtgcctgtagtcccagctactcaggaggctgaggcaggagaatggtgtgaacccaggaggtggagcttgcagtgagccgagattgcgccactgcactccagcctgggtgacagagctagactctgtctcaaaaaaaaaaaaaataaataaataaataaataaataaataaataaataaataaattcacattgaaccatctccgaactgtctcaggcagaaagcaatctaccttaattttcaaatgagatatttttgacatgaaagtgtaaattcccacctatactttcttctcattggttctgagaatgatgaattagtgtatctaaataactttagaacatttgtaaaaattactgcaactcaactggagactttcttctggtaggagccaagtatattgttatttggtgagtgagggttaagggaaccatatgtgatgggttagttggaaatgttcctattatttattgtgaacttattttgtgtttgacacagtgacaggtattttgtatacttaatttaatcctcataataatgccacttaggaaggtgtttttatcaccattttacaggtggggaaactgagacttaacaagtttaggttgtccagagtcacagttttggttagaattcaggctgcactgtagcatcaaagatgtcaaaatacagtggttgagccaagtggctctgccctgagaggactggtgaccccgagtgggagacactgatgctctctgaagccacccagcttccctctctcatgctgccttgtcatccccagagtgttgtccacacccatttgcttggatctggttcctgccttgggaagagcgaaagagaaagtggagggcacgcagttttcttatgaaaacataatccagaatttctacctatcatttgtactcacattctgctagtcaaagcttggtcacatagccacacctacttgcaaaagaagcagagaaatgtggaaacttggggagttatttactaaagggaagaaggggaatggctgctagaggaaaattgtaggctctgccataggctcctagccaatcagtggaagagctagattccaagcctatgactaaaacctgtgatcttttcatcacattttcccaccacttctcatagttgacagcaaatatttgttgaattaagataggccaagatattatatataagccttttgatcatttgaaattgtttcttccttctctcttgcctccctgattacctacacggttcagtgttcaaactgtctttgtttctgataatgttttaatgtgtaaaacaggaaactgataattaatcttcttcagtagaaatactataataaaataatctactaattattagaggttctgtagaaccatatgagatgtgataatggcttaatgatactgatttttttaaatgatcaaataaccatctcctttaaaataagtgttgtcttaggaaaatgccattgctgaaaacattttttgatattttggctggtatatcagttaactcttgctgcacgcactaatgcttcatgactccactaccaaaatctcagaggcacacagtgatatttaacttgtgtatctgtgggtctctaggggtcaactctttagcctgagccttcctggccaactctgtttcaggtatctattgcccttcttctgagatagcagactagcatggacatatttttctctgacaatggcacaaacgttaagagaacaactagaaatacttgaggctttttgaggcctcggctgggaactggcacaacctatgtcatgccacctggcaagtcatatgcccaaacccacaatcaagggccatgggaaatgctctacaccttaagtaatagaaaatgtagtcacgtagtagagggtttggtgaaggaccagggccaacaaagaaaccttcaattgctttgcctttcgcaagttattttgaatatttgcagtgatagtaaatcttttaaaggtagctttgaatttttttagtaaaacagctaagtttataaataaaattagagaatcaagctaggtttatttttgggcagaaaggtagctatttaagcatgtgttataaaataatgagacttatttctagaagaattgattcaagaatatggcatttgatgacagaatagttggaataagcatacagccttttaaggtgaccactttgaaaggataacactcatttaaacattgggttataaaatggtttttttttttttaaataagccttgtgacttacagtcctatgttaccactttgtctcaaagtgggaaggggagtgaatagaggcccatccctgatcctttgactaaccctagaaaaatgtgctttatgtgcagattcttattgccaagtcccctctggctcccttcacctcatttgtctacaccatcaaggaggaaggcctggttcttcaaggtaagatccttggattaagccatttctttaagcttatgctcagtgctgcccattgctagtggtaattagtgctatggttctgatagaagctagctccagacagaatcaaaaaccaagatgcattggccagtgatatttaccctagtgagagcaagagagcggcagttgtggcaagaatttgacagagaagattgaggtagggccgaaggagacctacagaatttcctaacagaatgagacaatcaaaacatgaggatcaaaccaagaaagctcggaattgctaccaccccattcctctttgcagatcctatggcatgaagtgggcaatgattctgacaccagtgtggaggtgaggagccagtgctgccccagagccttcttgcttaacaagctaaagaaccatctgggttggcagcctctggggcacaatgtcatggctccatgagccctacttccctgactccttctggttatcttgtttccttttcctgtcctgtcctgacatggtcttcctgctggggaccagacctttaggacctgcaccttgtgacgtgagcccaggacttagaaggagctgagttcttgcttagggtatagcaccctgaggccacatcctggaactcactgatctacaatggtgattcattctcagatgctagatacgccagtggttaggaaaggcacccgattacaggtctttccagaaagcaattaacatgaaggggtaaattccagcactgttagaagagtcagcccacaatgtcagatgtacaaaactgctttgtggatgaggaaggatctgcacagaagtgctcaggatatacatctgtcctctgctgtggggcaggagaccccaaccacagagatgcttaggtgaatatctggcctgaccctagaggagcatattgtcactgctgtccatgggagaagtcctgccctgaaggatttataagttaaatatttttcccaggtttatgaaacagggcagtccctgtaatttccccatggagacacaatgcagtgcaaagacctagcagggaatatgcagggcaggctggagagttcatgcttctaactaaggaacaggctgcagccttccctttccttccccttctaaaatgtctgcttcttaatggactcacaaagcggcatgtttgtttggtgcagctgagctccacagcggggactctcaggtccacgaaatttggggtgagaactacgacctttggctcttagcctttgacttatgctatccaagttccttggtaaatatttttttttacaattgcaaatagtgttttctgacaaaggagcagagattttaacaccagattaagcaaagcaaacagcaggcctctttgttacatactctctacgggtgtataactaataagcaatcagaaagctggacttttatttacccagtacacagggtggcattcagctcttcatttttagaggccttcttaaaagattagaagtatagtaagtagcaaatttcgttgaagatttcaagaaattctatggaagattacaagacaatttcaggaggaaaaaagtttgttctgctcagatgacgtgtgtgaagaggcttgatgtgatacacgcaccctgatcactaggcattttgttaaatagcatttctaagcccggtcaaatctggataacttttgggataacatttgtgagaagaagagtcactgagttgcctctctgatgttcattgctaagatcatgattttaagagggaagagaaagttatttagagaaagtagagcctggaaatacaatgaattggtagagtttaaaaaactgcaaggaatgacttttcgaaaaagttggaaaacaggggagaaagtggatcactaaaggaggctgacctggagctgtgtccaggaaagagaaaaattcaggaaaatgtcttataattcaagaacaacaaccagtaaataaaatgcttggttaggagacctcagaacctcacctggttgctttctaagttgttttctctatcccactcccccaagctacacatccctctctgaggtttcccagaagcagtggaacacctctgcttttaccagcaatgcccttgaaaacaaacctcttggcacactctgccttcttgctgtgtgctcccaaagactttgggaaaacaaaaaatgcaggtccccagaaaatgcaggcccctcatttactagaaagaacctttggattttaccttcagctttggtatgatcttgagaaaatctctgggccttgcttttgtcagctggaaaatgaaaacattaaccttgattcaagactttgaaaactgtcgcaacccattggtgggtcatgaagtgaaattgatgaatcacaaccagcatttgaaaacagagagagagagaagacagaagaaagagtgaagaaaaaatatcagattatatcacacatattgtttcatttcataaaatatttcttgtgtgattgtgtgtttgtgaatgtccacatacattatgagtttgtgtgggggctgcagcataaaacgtttttcttacgtggattgttgtaaccatcctgcgggatctctaacagccttgtcacatcagctttgtccgatcctcctaggagaggatgtactcatcattcccttagctcagcccagttgtacccttgagatctccacatactgcaacatcaaagctaatttttcccccttcttaccacatgaccaaactaaaagacacctgcatgattccccaggtttaaagcaaagaaacccttggtccctgggtggaaaacttggaaaggtaccatcagtcaaggccaagtagcttttcttacatgaggagctgcactggcaggtgagccccgagttggtgtggaggttggcacctggagctctgggtgggatgtgcagcccatgtccagggacttagagacagacagggcagctcctgtgctgccaactagaagggaggccgccagccactgtggccgacattcggtcttcaatagagccacctggatggtggaaacaagccaaccacaccagctacccgtgggggtagggaatgatccctcagtgccttttatcccttggcaagccccaagatgcctactggcctgctagcccggagattttataatacctgaagaactcctgagtgctcaagcagagggagggaataaaaggtgagggcagaattcgatttaccagctccacaggccatttccctcaccggttctcaaggattaggatgctgagaacagtcagcaactgggggacttctacccttccctcccctttgttcactgggatgggaaggacaataaagcggcaggctggagagactgaggggctggttagagatttctcaggctgctttttgaaactcttgaaggagccggtccatgctattgttgtagtaaaatagaaagcggaactattctccttttgcaaaaaaaaaaaaaaggaagaaaaaaagtaaatgaaagaacccccctcctcccagcatcttcaggaggcctcaactcaggccattaacatggtaataccatcctgtttgcatctcctttgtctgtccagcgtttgtctgggatcctggcctctggatgctggaaatacttaggccccaaaggagagggagctcacagccaccagtttcctgagggtttggactctgagatcccaggcagagagagagttgagcctctctgtgcaatgaagtgggaaatgttggggtaggaggggatctcatgaatccatttttcctttggtccccagagttcaccatgcaagtctcagtgcccactaagtgaaaaagctcagcagtttggctagcctcttagagtgatgctcaagtgtgctggggcctagtggagaggtaagagcaggagttggttctgggaatcagctttaatggtgtgtgcccacagaagcatctggcagcagaaaggaaagggagtttacagtgagctccaggttgacccacctctcctctggtcatgtcctttgttcccttagcaagccccgaatgttgtgccacccagaacacagctgggactcaaggccaagaataaagattctgtcattgaaagcagctgggctgtgttgctggcgctgcaggaggcctagaggaaaacccaggtcccagctctccgggagccctcctagttttcaggggctcataggcacaaacacctgcggacttggtgaaacagaacctaaggaaggggaggtccaggggaatgaagggttgatctagcacagcctccccgttactcctttcctcagggatctggggaggatttgtaaaagaaaagccaggttgtttggaacaggacagaagatagtggcttagttcctcagtaagacagaagtgtgttttttatatcatttttgcaaaatcaaagtcaggtatgacaggtttaatttggatcctggggctgtcgtctattagtgtaggtttgaatgagcgggagctggggagaccagggcaccctgagacaggtccggagaaggtgctggagatgaaattagtttcccatatctccaaccacttggcatagggtggcagaagaaaacagaaaacaaagcaacagcgatcttttttagagctggaaagctatgtgcctcatctttcttgctttgcttttgcaatcaagaacagtttgatcaccttttgaaatgtatcaggacaggcattaatctcttctgtttgttcccttgtcacaaacttgcgttaagttttcccaccccatttttttagtcactgagccagctggatgatttattgacaaaaatgtccccccaaataccaccacttgagttcatcagatttcagtttgaatcagtaacctatcaaaatgttttatgctgctggactcaaagtgacccagaagattctcaatttatttccatccaggtacagaggtatctgcatggtaaataccacctccgcacctggcacagcctggcattcttgtaggagcctgggcaaagagccctggaactcaatggagcaaagagagtgaactcctctcccagaggtcatggagaagaaggcaaagcaggcctgtcacattgtccccagcctgccaggtgccactgcagcctcggaaagtttgtctaggccaaggcgctctcctttgctgcttctgcctgcctcttagtgtgggacctcccagggagatgagaaaggagaggaaggactcgtatctgttcagttctcttctcccctgtgcacattcactttacatcccctccctccatgacatcttctcacacaggctctctgctttgtttactttttttttctggcaatcagccttgaagagagattttacaatatttggaaatattttataatatatgaaaaaaaattttaaatacagaacagtacagaaaatcataaaagaaaacaggtgaatctaacaccccaaataaatactaaaattttgtcccatttgtttcagattttttttttatttacaggaatgaaacttgacaaactttaggactcctttgtacctattcctggtccattccctccttatcccacattcctccacaaaagtggaaactctccagagtttggtctacatctttcctctccattcttaaaaacttttctacatatatgtgaatccacacatagtataatgattgattttgagtgcattctgaaatttgcataaatgatttattgtacacgatttcacaacttgcttttgttgcttaacactgtttttgtaatatagccatgtgatacacaggtcacatgatacacaggccacgtgatacacaggtcacattctttcaccttagatatccacatccattcagtgtgtgaatgtaccacatgctacccactcccctacttatggaaattttgattatttgtaacaattttattacctgtgcttcttgatgtttaggtatgagagtttcactaggtatatataaaaaatggaatggctggtcagagtgtctacacgtttccatttactatatcttcccaaattgctctccaaagacttttaccaatttatactcgttctggagatagtagaccaatttctctgcagcctcgtataatcgttaagtttgttgtcatctttccataggcagtcttctcatgccttctttagggatgcactgcactctagcctgagtgacagagcaaaaccccatctctctctatcttaaaaaaattcttcatttccctaaagttaactatataatagttcccagaaagtgagcttttaatctcatccatcaccctgattctcacttgaggaaactgagttccagaaaggtaaagtaatgttcactgcctcaaaattgggtttgtagccatttctaagccctcagcctgggctcctaagattttagaaaatccgaagtgggtttgggccctctcatcttccatcagggaagcccctgtgacaacttacctctcaggcttcatgagcctctgttgagatacttcaggcctgtcctgaaatttgaatctggaaattctaagctaaaatggattggtcatactgatacaataatccttcaacgaagtccctgagtgcagttagattataagtttggccaggtgtaactataacctaaactaacagtggtatacatgatagagatgtactgcttcctcctgtagtgccgaggaggaatgcagtccagagctggtttggcagcttagctctacatgtctatcgaagagcccaggccattgactttttgctctgtcacacctaggatgttgccgttaccatggtccagaatggttcagcatcatgccctccatcccagtagcaggatgtgcatgagatagagaatggtggtgggagagaaagcatcccccatcccttaaggacattaaccagaagttatacacattatttctgtttatatgatgttggccagtctgtaaatatatgatcagaaaggctaaaaatatagtcattaatctgggtggccatatacccagctaaatttcgggatttctgttatcatgagaaaagaaaatgaatattcggtgacacagccctttctgaagagcccagttgcagagattaggtgcaatagtacagacgtaagggctgggcttgttgcataatagagttatactcttaaaatgcagcataaatattgtatgtattgaaaagtgccatcaggaccctctttggttccagactctaaagtagaagagaaagggtatcacttcaccaaggatcagcacccaaaaatcttgttctgcccacccaaaacagaatctccttcaggaaggaactttagtatgtgttttgcttttatgcagtatccaggaaagaaacttcaatgagagctactattgcttatagcacaaggcagggcatgaacttgggtccaaagtcatagaccaaacacttttttttttccaaaatgttttttcctacctccacttttaaaaaaaaaatgaaacaaaatatcagttgaaataacattattgagaaaaactttattccaaggcctggactatagttagactggatttacatttctcttttagaacctggaagccacttggctatctttgcagagttaacaatttgcatttgcaaaaatggccaggtaacagtaccaaaatatgttaaatcaattcaggttgttgattttctttgaaagtctcttccaaagaacttcatgttctttctggaatatgatttaagctgcatttcagtgagttcagttcagcaaatatttgttgagcatctattgttcacaaagcatggtgctcaggggtcaagagatataaggctgaaaaaaaaaaaaaaaaggtcccttccttttagtagcccagaatctagttaggagagatgtagttaaataagtttaatcaaaagccaactgtgatacctattaccaaggttcaaacagtggaatatagaaggataaagggaatagacttattccaagtaggatgactgaggtaggttcttgagagtacgtgggacttggactggatttcagcttgtgaatactgacaaaaaccgcattccattgtctcttgacagaagccaatttcttttgctatttgaggatagattcagggacactggggaatgctgattagttccatcactaatgctgattagtagtgaatgttgagtcatgctgactaatgtgttctaaatggattgactcaacaataaaggcaacgttgagagtcaagagttcagatcctgaatttcaccgatgaagtgtaaatcatttcgccacttagtgcttaatttttttgtcaattaaaatgtgctcgtgggtgagaatccagtaagtcatcttgacccatgagggctttacaaacttcaaggataacagacagcttaacagcaactaccaggacaggcttatgcaacctcaggttattcatagctcacacagagtcagaacacccatcacatgctgctcgccagccatgcgaaacttctgtttcctcacacatgccatgagaactgacaaacagtgcactgaactcacaaaacccgacaaatagaggagcttttgaaaaatcttcctatctacctactggggtgtctgtgtctttctacaacaaatgtcgccacagaactaagggcttgcattgcagacacagctctttctctcttttgacatctccccagctagactgcttgagaacctggccttccatgtccagatgtttactgaattctgaagccctcccagagagcccaggttcttttgttgctctccaaatcatttcccacagaggctgaccagtgtcctgaaggagcccttcaatagggaggataaatgaaggcagatgaagacatgaccccctgaggcttgcccacatccactggaacaaagggtgtgaggcacaaccttgtaaggagtgttttggtcagccgcgtccctatgcgaggccaagtctcccccacagggctgctttcaatggctaccatcatagtggaagtattgggcatttgttaaggactgtggtgtgctagatatagcacaaaacatctaaatcatggtcccctgcctttgtgagggcttcctggctacagatggcagctggctttctcaggggaaacttgggggtcatagagaaagctgaagaggggtgcttgcttctgtggatgacctcttcccacccagtgcagcgacactccccttttgtctatagctatccttagtcaagccagggctgcgggaccctaacccacacttccgctgtgtttctggatctctggtttgcaaggccagtggctctgtgggcaatacgtatgaaagaggactgctgttggaggaaagttccatttaggttgctggtgggaagttagtgcatttcataacaatttttttttttcaaactttctcttttttttttttttcctttaggccaagagaagccatagggatactgtgacctttgtctagagttgatgggggtgtgatttgtgaaataaaacaggaccgtactgcttggaagaaggaaacggaagctgacataatggggattaattagttgattgctgttgagatggtaacagatttgctcctaaaccattgagctagcgatttcagacctagcagggaaggtgaagatgaagaagcctttgttcaggtctctagatgtgtagggctgagggctttgccgccatgggatgtcaacagccataataataatttgcacttatatagcacctttcaaccaggcacctcaaagcggtttaaccacattaattaattaaagcccacaatcctcctggggagaggaggaggatgactaacaagatttgtaattacaggagggaacatttccgaataaagtattgtctaccagataaaaagagtaggtgtaaaggaattggggtctccaaatagtaaccgattcagaaatgaaatcatggaatgatgtgggaggctgggggcgggcatgggcaagggggtcgactctgtgtcagagggaggtcgatgggctcagaattcactgacaggttcagatccagccgagaagtggagcatgtatggtattagtggcatttgaaggtcattagtggcataactattgtagtgtaaattcaagttttattggtatattgtgtatagccctgcagaacaaagactgagactcatgcagtatttaataaaggatgaaatgatttctttagatttaaagcccaaagctgggccagtcaattagcaaataaatcaattggtgacccgtaggataatttagtcgtttccagtagaacacccagcctacacactcctactgccatgaggctctgattgaagcatcagactgggttcagggcaaggtctgggggctttagccccttcaaagccaggcattaaatctttccagcctttggccttgtgacctatcttacccaggttgttagtgacctcaagctgtcctctgtagaatcactttgtacctgctcctccatcagagatttttagtgcattgagggctagaatcaagtctcatcctatttcatgtctcctatgagtgcccaacagagtgctgtgcaccaagtaggtgcagattgatgaagattgatgaagaaagactgagtcctttaacgactcagtatttgttgagcgcataccaagtgctcaggtaaagcttgaaaacaaagctcagtgtgtgcctgccctccaaaaatgtactccaaggaatgggaaaagacttacaaactattaactataatataaagcagaatcacatccaagccccgggcagcaagggcaataggaagagcatcttattcagctggagtgaatcagggaaggtattggtgtgctgtgcatcggaaggcaagaaggatttgggtagacctggaagaggcagagcaggaagatgtcccaggctgtgaccatgtgtctccctctgagtgaggtacattttgagaacttgggatgttcaatagaatgttggtgaaaaccaaggtgagttttcgtatttaatcaggaaatatacatttcctgtggattcttatgacatgaattggttaatttcagacatcaagggactatttgagaagttggaggtagggttcaggatacagtactccaaaatccggcacgttggccttgaaaaaacagcagaggcaggaaggccgttgtcaccttcccctcacccctcctctcctgaagcaggttgtaaaatgttcattcctgaagtgttcactctctacccagaggaaaggaatgtccttatctctgaagacacagggacagagaagaatctgaacaaacaggccttgctaaatttcccccagtttattcccattagatcatactctttagtcctccaatcatacttctgcctgactgtctactcttcatcaaacttaagcataaaaatacacagatttccctggtttgggggtggtctttcttcttattcttctttttttttttttttttttttgccagagtctcactctgtctcccagtctggagtacagcagtgctatcacagctcactgcagcctcaacctcccaggctcaagcaatactccaacctcagcctccgaagtagctgggaccacagatgggcatcaccacacctggctaattttttattttttgtagagacagagtctctactgtgttgcccaggctggtcttgaactcctgggctcaagtgatcttccaggctcaagccaccttcccagctcagcctcctaaagttctgggattacaggcatgagccaccgcgcccagccaggtcttcatttctaaaggttctcatgtcacataaaacttacgttaaataaatttttatgcttttctcttgtaaatcttgttgttgttgctgttattgttgtttgagatggagtgttgctctgtcacccaggttggagtgcagtggcatgatcttggcccactgcaacccctgcctcccgggttcaagcaattctcctgcctcagcctcccatgtagccaggattacaggcatgtgccaccatgcccggttaacttttgtacttttttttagtagagatgaagtttcaccatgttggccaggctggtctcgaactcctgtcctcaggagatctgccctcgtcggcctcccaaagtgctgggattacaggtgtgagcccggccttctcttgtaaatctgtcttttgttatgggggccttggccatgaaccttgcaatgcgttcatgcaagatattactttttctcccctacagtttctggtgcccaatatggggtgactgagacaccccactcattctggatcttgcagatgagatcctggggcaactgacaaaaagctggaaaaattagaattcttatcaaagtcagctctcccagatctctgtctgtagtgcttggtcaagagagacgttagaaatttctccttgtcccttccttcccaaattcagattatcaggaaaaaaaaaaaaatgtctatattgtgactctctgactaaatctggctttaaggtactcgtttgttactgatcctttccctcgcagggactgctgtctctttccttgtttttctcaatttctgtcctgataacttggtttgattttctccctgttggggcatgcaagctgtcttgagttccccaaccaacttcaggggagggaactcaagaatacggctggacagaaatgtgggttgcaccctatttccagctatcctaccaagtattgccagctcttggggggtttatttgtatatttcttttgactctctttgggggtagttctggatttgggagggctgcactctcttttgagaaccccttcttagtccatggtgaagtcataaaaggctctttggttttggttgagtcacttagtaggtactttcagtttaaaacaagaaaaaggtaaatgtatatgtttttctcttgttaatctgtgttttcttgtagtgctctcagccacgaaccttgagataggtgaggaaaatatattatttttcctcccttacattgagcaagatgctgtctgttctctgcaactcctaattgttctctcttcacctccattgtctgccacgaaaaaaaaaatgctacattgttcacacattaaaatggatcactcaaaagtgtctgaaaaaagcaagaggaaaacatatcctaattccaaatgtcaaaaattaagtggctcctccttgagactacctttttgaccccaagaaacaataagagagtgccctatacccagtgtttgacaaaccaatacagtactctcctgcccaaggccctccaggccttcaccacaaaccatgctgcagggacaggacgtaagcactgcctctgatatggagcacttgctgcgtgtctgacacacactttacatacacaatcttctctaatgcttccagtaatcttacaggtagaattttgtattattccttctctacagatgaggaactgaagcaggagaggttcagtttgtcaccagaaaggatgaaatgtggatttgaactcaggcagttctactctcttttctctttcatcccttgccctgtaatatttctgttcacaactcttattcatcctaagttcactaaagtactcagcataatactacacacacaatagtaaagaactcagtgaatattttctaaataaaagaatcaccaggaacaatgctagtagtttgatcttctactctgagcagtgatgctcagaatatagtagaggttccatcactgccttatcatgtcaccatttttaaggagcagaagacatgcacaggaaagttgccccaggaaatgttcacaagaaagaaggacacaggtagcattcttccccgtgagctgataatctgccaagctggtaccacccatgagattctagtgtggcattttgtatcattaattacttttactgaaagtaattacttttactgaaagtaattaatgatgcaattcagagatattttaggggtgtgtgtgtgtgtgtgtgtgtatgtgtgtgtgtatcaaagttcaactttgtctccctaatcctgctagccttctggccattctattaaggtattgcagtcctggtgaagattcagaaatgtgtggtccccgtcagcctacagggtgaacattttggattaacccagagagccttgaactctgtgcataatgtcttttaggttgtgtgttgtgaacaaagcaaaatgactgctcagagacagggttgtaaaagtttgtccagcaaaaccaggattgccaaatgagaattctggaaagggaggataaggattaggtaatgggagaaaagtgagtgaaggcaaggagaagtgcaaaatatctgattctagcctaaaaactggtcttggaaccatttggaagggtcattttttccatgttttattttcaatatcatcaccatcacttttatcctgtggctgtgaaaggactttcttcattccactccagaattcaaagaggcttcttttgcacaaatggagggaaggcactcatcacacttctcagccaaacatcctaagtgtgagagaaaacacactgcctacttctgaatttcggtgagggcagggttcagatggaacacatattttccaaaactccaaatagatctgggaggagaggaaaccattaaatcactagacataagtcaggacacatttggttttgttccctatcaaacagtccccccaaatctcagtgacttgcaaaatccatgcatgtctgagactctccagacaagctctccatgtgtgactcaatattgcacttcagtattaacatgcactgccacagttgccacagtaggggaagggaaaggtggatgggggagagagagaagaaagtaagaaagagagagagattgagcactgataattaagtccttccctcaaaaaatgatatacattccttctactctcctggccatgcagccactcctaacttccaggaggcaggaaggtaccacttcctccatgttctgaaggaaaggggaactggatattggtgaacacctgtaatgtttggcatgcacagctatacccagtgggcttgcaaatgtttccttcttccatattcacgcttgtatatacctttccctcagattacctggcatacatcaaagatttatggggtagtgttcaggaagaccaaacagttttgcagcctattttagtccacaggtgaccttttgaaatagaggggtagccaagaaagaccagttaactctgggtacttttcccctagagctttcagacacaagtaactctgggaagggatagtgggttcaagggagccatggcctgatttcaatgacacattcaagatagaacaactagtttgagtgaccccagaccatcatgccttgtgtgaaaagacttttggaaatgtgcccttccatttccattctgccgcttgttaccagacatgatgcacgttccttcaaagccctgtgacttttccagaaagcagctctccctgcaagagagagaaactttcccttattattctttcagtaatgaattcctgctctgaatgggctgcctccatgtgttttcagtcaagtgctgatggcagccttgcctgggggcatttccaaagctgaggacataagagatgaaggaggtctcatattgacaagagctgcttttggttttccttccagtttagccctcctgagccttgaaatgggagataacaaatgattcatcagttcttgttggtgaaccaacatgaccaccacacctctttgctcctttcaaccaatgaaaaaatcatgttttaaagctttcctcagagaggtttgtggacctggattttggtgacttaacagggatttaactttctcagaccaaaccagtattttgtagatgccaagacttcctttcttcaggtctcaaacatagacttcgcgtaccctgaggtgataagaacaaaggagaaattaggtcaccctgtttcctgcctaaaacctaatctcaagtacacaagctgcttccaagtaagctgtggtggtaggccatgtttgctgagagccagcccactcactctccctaaagcaaatgtcttcagacaataattcagctttcaacctacctgcatgaaacttgtacaaacttttagttacagttgggctattttctttctttttcttttttttttttttttgagacagagttttgctctgtcgcccaggctggagtacagtggcgcgatctcagctcactgcaacctccgccttccgggttcacgctattctcctgcctcagcctcccgagtagctgggactacaggcgcccaccaccacgcccggctaattttttgtatttttagtagagacggagtttcaccgtgttagccaggacggtcttgatctcctgacctcgtgatccacccgcctcggcctcccaaagtgctgggattacaggcgtgagccaccgtgcctggcccagttgggctattttcattgggaagaggagtctcaattatctccggtaaaaggggacacatactgttaaggatataggtggtgcagaattggaaagccttctggaggggaggcagccctgggaattcattatcctggggtctctgcttttctttacatgtctgcccagggctactctcactctcccagcagattttgtcctgcatactatagtttatttactcaaaacttcagtttgcacatggctcaccctgtgtttctctcttagcctttcaacttcagttcccattggcttttttccttggttaaaattctgaagagagaatctgattagctcggacttatcttagtgttttgtctcagacaacatcattggtcactggctaaccaaacctttgttggataaggaagtcgctgaaaacatagctgcccaagcagcaggaggtgtgggaaggccagcttttcctagaggggctgtgagagggcaagacagtgatgaactccagggcatgctttacaccctctaactggactactgcaagcatactcattccctcttgcttcttgctcataactgtagacctggtccccttacaccctcacagcctaggcatctcttttcactgctcacctccagcccctgactccaggatcttacttctcaccctgttaaagtgcccagtcacagaggtataggactagtgagtgggaaggaagagctgttgagatttatttaagaatatacagaagattagggaaggtgtgtaatgaaaagaggaatgaaaataaaatccctctctcagctaaagaaaattgtgttcccaccatgggacccagctacctttcctccttccaccagtctttggagttacttccttttcaaaaaaaaacagacatcagcagaagcaagaggagcttccattgaggaaccctgaccaagcaagtgggaagatattctctcttcattaacccccaaggtcttctctgtcccctgcaaggatcccttgtccctatccctgatccttgcatttctccagcccccaccctcaggtcttgtaaagtccagattcttgactaagaagtcccaaataactttcaaactaagattttaaaacacaagtgaaggactcggtttggatcaagtttttgccaattgtgttcttagtgcccaaagctctttattggaagttattcacaaatcttcatgatggtttttggacgactagtcacgtgtggtgttgccctatttcaaatgagtcagagaaattgtgctttatatgaattcatgcatcaaccagaggattagggggaaaactgaattgtggtagtatgctttaccatttattcattagatactattacttttgtacctcatcagatggctaaaagccaaacccaaaccaaatgtattcaaatttcagtctgcccatattatttttagtggacgtgagtctaggagtgaaggagaggctagtctaaatgtctgtgtttccttgccctttcttgaactccgggtatgtcaaaggtgattaaatcattggtcaaactttgtcctgtgactgacacttttatctagtgactagaattgcaacatttccctaggagcctatgatagtttttccaaacctgctactgtggggttctagtcagttcctccagagcacctccagatccctgcccattctatttagaatcggaggtttaagtctattgccactggctgtcctctggggcccagaaacctatatggggtttgtccagcctctcatcccagcaccatcgtccaaaccccacagtcattaccaatctaacagcttgaaagttgatacaaagatgaggcagaagccagtttggctttctcccagttctctgtgcccctccggagttaatcaacaacgacctatctttgtgtcaataacataagcctctctaactagaacacctggtgaaaagccggaggaaagcttaaaatgaagcaaattttgcagtgattattctgaccctcactgtttaagctggactcaggatctccagacaaaaactgcttgttaaacccaaccaactagttggatgaaccttaagccaccttgggttttgctaatatttttcatgcccacacctcaactccaaagtctgtaaactttaagcatcaactccccatttcaagcacacagggtttagtgagatggcctgagttcatctcgctggtagaattctttagtggcatctcctcatccctttcccaccctcaaagcccatcctgatggtgcggtcacaccactggagaaaccatagaccttcttaactgggattaccaacaccttctcttagtacgtattcacatggccttggatgttaggtgactgcctgttcagagaaagtggggagggtgaaagggagtgaaaaggcagagggcacatggacaacagttccttgctgtattcgtctgctcaggctgcataaaagaataccacaaactgcatggcttaaagatcagaaatgtattttcacacggctctggagactggaaatccgcaatccaggctccagcaggtttggtttctccggaggcctctccccttgtcttgcaggtggacgtcatctctctgtgtcctcacatggcttgttctgtgtgtgtgagctcttagtgtctcattcacttcttataaagacactagttctattggattagaactagtatcttcttgctttttattttctgtgtatccattgtatgttttttggtttgaggtcaccatgaggctaggacctcatatttatgaccttgtttaaccttaattacatccttttgttttatttttggttgttgatcatgatgtacaattcattacttttttttctttttttttttgagttaagtctcactctgttgcccaggctggggtgcagtggcacaatcttgactcactgcagtctccacctcccaggttcaagcaattctcctgcctcagcctcccgagtagctgggactacaagcatgtgccaccacacctggttaatttttgtatttttagtaaagatggggttttgcaatgttagccaggctggtcttgaactcctgaccagaggtaatctgcctgactgggcctctcaaagtgttggattacaggtgtgagccaccatgcctgctcattaattaccttcttttaaaggccttatctccaaatacaatctcactggaggttagcacttcacatatgaattttgaggggacacagctcagttcataacacctaccataactgttttcctcacagaacatcccttatcctctgatcttgcccttcttatctgattgggaaaaaagtagatgctggccaagaaatgcaagtatgactatgcagtttgagaattgctaagctaggtggggagggtgcatgagacaggaagaatgaaaacgtgggtggatggatacatgaatggatggttattacatggaaagacaaatgaatgaataaatggctttggcagtgtgttgatggcaccaggacagaaattacgttctgtttctttagggtttgtcttttttttttttttttttttttcaataatacagggcttacaaactcaaatgtgcatgccagacaggtaaaaagagttgcaaaaagaggccaggtgcaataataggcagttgtagggactgacagattagagagagcctaccgtatataaaggggcaccagttactgacaaagactctcattctgaccaaacttgagtcaggctcctctgagtcctctttctgactaggccccaaccttgggctctgtccttggcttgcttagtccagttttagcaagaatcctgctaagtcaattgagtgaaaattccccaccctttgtatttgatcaccctcagtacctaatcaaattcctcagcccccacccttaataccctatcacccttgcctgccttcagtaagaatcctgccatgtcagtttagcgggaatccccctagccttggtgtttcttcttagtaatttttcatccactgacatccaccctgctctttggctacacattatcacttttccttgttgtattcggagttgagcccatctctctccaaggctgcaaaaccccattgcagtgttccttcttgaataatgtcttacttaaagtctttaacaactgtcatgaaaaatttctctttcacagtctcagctctagacaattgttatcttgtgggatgctgacctcatgttgccagaatgtcggattttacaagggaagccagaaatctgggttttcagataaattttttcactatttttattttatttatttattttttgagatggagtttcactcttgttgcccaaggcggagtgcaatggcgcaatctcagctcaccacaacctccacctcccaggttcaagcaattctcctgcctcagcctcccaagtagctgggattacaggcgcacgccaccacgcctggctaactttttttttttttattaaatttttctttaaatcttgaaattcaaaaattataaaatattgtataagccaaatgaatgctcttgtagtccgaatgcaccctggaggctgccagatttcaactcttgggatgctagaaaggcatctgtaatgttatcacatgaagatatagatgcttgtgagtttaggctcatgagtagactgcctgggttcatactgcaatccaccacttactagctttgtgatctcaggcaattatgcatataattcttagagttattataaggttaaaattatttaatgcatgtaagtacctagaacaatgcctgctgcctagtaagaaagcagtaactgtgagctggtattattagctagtatcatgaaatctcttggtttccaataataccatttctgtaaaatgggggaaacccacttgccttttttaccccctaaaggcttgttgtgcaagtaaaagaacaactgtgaaagagcttgaaaaagtagacacattgctaagaaatacaccaggcatttctatgttcctattcccacagatgaggcacagcctttcccagtgcagggctgggactctgtaggaagaggaaaatagcagtaactagaaccagtcctttattcttctcagggtcatttgctgttttgttgttcttagaatttggtgagtttttctttttctttcttttttcaattatgataaatttcaacattcagaaaagtaaagaaaataatataatgaacacccaaatgcccttatctagatttcctaattattacatttggcagatgtgcttcacttggtgagttttcctggcagatatatgtgaatggaacatgcagagatgtggtagagaagtggggagaattgcagaataaagacagactgggaagctgagagccgtaactaccgcagcctctacttattttttaaacttgtaagatccaatcaagtgtggatggttgccttttggataggaccctggagaagggacttctgtgcagaatggtttgttatggagaatacattgttagcaccttaaagaaagtaatataaatgggataacagaaatgattttattatttatgtgattttaatttatttttaaagtatcaattcttttgcaaagagaatatattcatgtattgcttatgtcattgaaaattaaaaatttctagagagactttcaatgtggaaatgtctctgccatgaagaactcaggggttgaaacttgtggatctgagagaagtctgataaaatcagtgatttaaaaaatgttggtcactaaaattgaaaggttttaaaggcagaaacactccgattcaaagaaagtatatgctaattataagtgattcgtttctggtagattatttgaaaagattctctaagacatattgccccatttctcaacatcaactattactgcatttaaatgctaactcttctctctggaaaggatgtcttaacaacatgaaagcaactaaactttgctttaaaattctattattcagactccacattaatttaagctgacactccttctcaattggggcaaatcatcaaagctttattgtattgagaaccttgaattcagcaacaaagagcgtggggtatggagggaaaacgttgagaggggaagggtggagagctcccaaggccaaaagaagggaggggcagggaggaacactgcaggaaggacagcagagagaaagatggaccttggagaggccaaggggagagcggggagttagaaaaaggctgagataagcaatgggaggcctcctcagaggggccttacactgtcaaactgcccctggagcctctgctcattaacatggtagaagcaaaactagcctacaactttgtagtcacaaatttttctccagagttatggataaaaagggagctaggagatagagaaagggaaaacattccctttcttcctacatttggatgcctctccaatgtccttcctaaggcaccctgcccagtggccagtgcctgccagtaagcccactccacagaccctgaggcctggagccccagccctggtcatggattagtgcctggccaagttgcactccaaccccaggcccgcagccgcccttcctcctcctttctgttgtgattgactctgagatatatgatgtgggatatactaggtgcaacgcatcatgttcgttattgaggcataaggtaaggaaggatcttttgaaatgtgaggacatcatccacaaactgtcactgaccatttacgatttataactagaatgtaataagatttataagatgcactttaaagcctaaaagaaaactgagttttttcaacatgtaacaacatgtaataaatattaatttcaaaaaccaaagtagccccagttggtcttttctctacaccaaaacaatcctcaaggatgcatgaaagcccatggacactgtggagcagacagctcctagtgtccagaaacccgtcttagtccaagtgggggggcactgcaagaattcagtccccagcctaccaccttccagctctgggccctcagagaatgcccatagccttcccgagtcccaattccccagtttgtaaaatgggaatagaaataatctgcctaatcttcatgccagggggcctgtgaagatgacagggtagataaatgattggttttccaaccttcatggaaggcctaagcctgagtctatgacctcctctccagttttaagacataaatcagatcatgccattcgtctgctcaaaactctcaagtaacgctttttcactcagagtgaaagtggagtccttccacaggcctagaaagccccaccgattccagcggcacctgcttcttcgcctctcacagctcctcgcttgctcacctgttgcagccacactgcctcctagctgaaccctctcacaggcaggctttcaccttagagcctttgcacttctgaacccttgctggaacccttttctccagagtaccatagctgactccctcacctcctttcctcacataatggatgactccctcacctttaagtttttgctaaaatatcaccttctctatgagactgacccacttaaaattgcaacccgctctgcttacccccatcctgctctacttatattttcccaaagtacttatcgctatacaaggtaataaataatcaatagctcacaatgtttacccttcattctgtgtcttctctgctaccatataagccctggagggcagccgtctttgatttattcatttttttcttaagcacctagagcagtgtcaggtatattaatgacctgcaataaataggttggatctttcttagaagtccaggatataacatcaataaaagaagggctgctacaactgaagggatttgtgagctcaaaatccctcctgctatctctctacgagcaagtgcaaaaactgctgacatttgttcttgtgtgtgaaaccagttttgaagttacaaattgctacttgatgtcaggtccaagggcctacacaatagcttgcacatagcaggtgcctagtggtacagattataaggggaagggaagtaacatttgttgagcagctaccaaatgataggcagtgtctgtgcctagtgaactatagaagtgatttcatgaaactgtcaacccttctaccattgtctctccaggacctcataccaagcctggcatgtattaagtactcagtaaatgcctgcttatttccctaacaaccctctgaggcaagtaccattatccccatcttggaagggcccaagattcagatttagatagcttgcttaatgtcatacagctcgtgatcagagccaggatttaaattcttctcagacaagctgcagcctctctgatcctttgagagaatgtacattagcatccctccgagcttccctgaagcagagctgtctcccagcgacaccggagatgaggggaggggtctctttctccacctggactcacttcctccctttgtgcatttggctcacctggaggggtcccctgctaccttttgattaatgggtctgcccttcccatccccccggccgaatgaccccagagttagctgcagttcatcttgaatcataaatcaagttctcaaagacattgcagctttgtgctcaaaatctcactagaattcacattctttgtgaaaggcatttgcttatgagtagaatgatggattcatcaagtctctccttttaagaaaaatctggatggtatctgctggtttctccctgctccctccaagaaaaaaacagccctagttactcaatttcatgtagttagaattcccccaaggacctcatactcagcttccaccctggccatactaaagaagagccccaatcatgttgccattttacatagatagaaatcatttgcaacttgcacatttgttgtgctttccatatacccacgattagctcggattttattttttagccattgctgaagtgtcacgcgtcagctatttacactgtatggggacaaaacaacctaatgtatgtcccagacctattttatagaagccgagaggcagcctctgagtctccggttcccagaactctagccctgggagaaagcatatccataaatctcccaatgctttatgccaggttagaatttctcttgggaattttggagtttgtataagagttgcctctaaaggcaattgatgaactatagatgtcaggcgggttttcattttctgtgtgctttttatttcatctagaaccaacagtggcctttagaattggattcttttcagagactctctctataggtttcatgttcaaaggctccaggttggaggagctcgaggttcagctgagtgtcagaaatgaccaattctggctggacgcagtggctcatgcctgtaatcccagcactatgggaggccgagggaggcggatcagttgaggtcaggagtttgagaccagcctggccaacatggtgaaaccctgtctctactaaaaatacaaaaaaaaattatctgggcatggtggcacatgcctgtaatcccagctactcaggagactgaggcaggagaatcccttgaacctgggaggcagaggttgtagtgagctgaggtcacgccattgcactccagcctgggcgacagagtgagattccgtctcaaaaaaaaaaaaaaaaaaatgaccaatttcaccagtactgctctattagaaaaagggtgggggtagttcttcggttttgtgactatcctgtgtactggaggacatttgtacttgcagcctcatccagaaaatgccaggagcattccccgaggcactctaacagtcagaggtgtctgtgggcaatactccaagcacccccggttgaaaacaccaacaaggctatctctgaaagacggtgaactggggcagcaccactaagtttcaccatcagtgaggcgtcagtctagatgggcactttctttccactgtaagctgcttcctattcttgttgcctttgatgatctttgtttgccttcaagtcgggtttgttacatttgttttcatctccaattcctgccatataaaaatgagggcagtgagaaagagaaaggaaatactgaaattttccctcggactatagcctcccaagaagggtcgtgttctctggaatgacttttaactctttatccagttaatgatcgggaaagtttactagatgtaggttcccaagcccagcaagcagagtatgtgataagagatagaaacagggacagaaaaaaatggatccatcaggacccagacattggggtgcaaccagtgggtcttctccagctccacagcgcatcagttctgactcgcttgtagattcctgagtactgctcatctgccctacaaggcatagtgggttttctctgatttctagaaatgtcagcattctctgcaaggtgaacggccagagtcgggatcttctattcaggcagagattatataactccctgggccctggaagagcatgactgtctaccaggaaccatccagagaggctgtcagatgaatcagcatctgttcatgccctgccttgcttctcctgggcatgactgcctcacatgccaacacccaggcttacaggtcaactattccaaccctgcatcctgcccaccccacttgctggggagtgctctctacagctctcagtgcatcctgtttgttcagacccctttgtcttccactggcgcaaccgagagaggattcctccgagcccctttgcttttggctttgaaatcagatcctggcacacctgattatactcaatagctggaaatggtaaggatgtccgatggcagagagctcttgttttaagttctgcatgccaggaaggcagggggctgggtctccttctcagggctaggctggaggggcaggatgctctagcggaggaagcagtgttaacttgaagggaaacgcagttgaaaaggaactcgaagcacgggctgccaagcgcgtagaagtggtaactgacgacacactgtggggctcagaccccttcctctctgctcatatgcccctagatgggaaacattcagttcctgctcaagggaaccaggagaatcaaacctgtctgtcctgctttttctgtagaagtgtcagctctgaggccttgactaggtggaataaatagtgacttacctcttaaccacagtgaaaaacccatcaagcatttggatattaagggctgcccctgtgttctcaagggaccctcagcctcagacactgcctcctttcaagcaaagatgctgccctaacacgcaagtccagtggctttaagagtcattatgaaaatttcacacaaaaaggcacaaagagcatccatgtaccgaaacccagcttaagaaatgaaatgttactgatgcaattaaagccgcctttgtccttttggtcccatccttccatcctgccttcccccagcagtaaccactcagtcattgacaaacagtgtgtcaaacatgcacaaacggtgatgtgtccatccctctttggaattacttaacctttttgaacctcagtgtattcatcggtaaaagggggctactgacaggatgaaggaaaatgatttatgacaaatatttggctgttgttcctataaaaaggaaaaagtcaccggaaaaaatgggtcaaatgtaagaccctttccagcctggccccaacttgccccggcagcctcctctcctcttgtagccatattccctcctctcctctctgcagcagtgttccccagatatgccacctgtgtccatgcctctgggccaatgtggatgctgtgcttacttgcctgtaatgctggtctcctgtcaccatcttcctttaacactggggtccactgtccccacctctgacagggcccagatgcagtgactccttggtgctcccatggcctgatacctctgtctgagcacttgccgtatggctgtgatgttcctggtatgtctgcctggctttttcactgagctgcttatgcagcaaggcagggatggggtcttctccatccagtggcctggcctattgccttctggcgcatggcaggaccatatgcagtgaatgaatgaattccattaagaacattcgtgattcataggaggaggtcaaaatatcaacattaacaggagcttggaagaagctgatttccaccctcatgaatgacttcaagggttcaggtgcatgagtaaatgacagttccatcaacagactacaactttctgccctagttaacacagggcatctccatgtccccagttctccctatgggcatttttctctttgaaattccaaatcttttctgttctagaagcacgaaactacaagttctctctcaactcttcaaatgaggttggaacaaacagaatgggggcatgaacttttttccccataacttcaataaacaacagttttagcctcagtaggctttatgcaagccttcaacatctttttctaggtatcttgacactcatgttctttttcttcttgcagcctatggaaattcctagagacagataaatgtgcaaacctgttcatcttgccaagaaaaatccgcttttctgccacagaaacaaaatattgggaaagagtcttgtggtgaaacacccatcgttctctgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacaatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatagtgtctgtcttctttcactagtatgttttcaagtctcctccatggtgtagcgtgcatcagtacttcattctttttatggctgaataatattgcattgtcaggatatactgcattttgttcattcattcatccgtcagtggtcatttgggctggttccacccttcaactattgtgaatattgtactgctatgaacttgcatacacatgtatttatttgaaacctattttcaattttttaaggtatgtacctaggagtggatttacttgacatatggtgattctatgtttaactttttgaagaactgcaatactattctccacatggctgaatcattttgtatttccatcagcaatgtatgagcacaggtcagattttttgggagtcacattttaaagtggcacaagacccttctagagggctctgttccatgcacacaaaactcatagtctccacgtgaagacacaaatttttcacaaacatgcaggcagagaaaggagagaaagtggaccctcagcagacaagttgaaagatggttcagagaagcagtggacttcacccatcatcttgctgtgctctccatagctaagcaaggggcagactggagattccactggctactttgtcttattttcacttctttccagttagtccccactactctaccctttccacaggactgtagggttacggtgactttcctacccctagccaggttccagtggtgggggactctgtgaatataggatctagtgttcagagctcccagatttgtgcagactgaactctacacatgctacttgtcaacatctgtgagccagaaataggaggaacacctttaaaaagaaacctacaaacacaaagttattcatagatgctcttgaagggcaaagcagggccaccaccagagccccatgcaattagactcatcagagggaaagggcataacactggcttttttcttaaaaccacctggaaggagctgagacgtatactaaatgtatatagaagtattatttgattggaagaaacaaaaaatgcattgtattataatctgtcttcccttgccgtctggtagcttaactgtcagcaattttggaggaaagcccttcccagcaggggactgggaacccctgggcaatgtctttcctatgacacatggatctctatggttgaataaggggctgaaggaggaaatagacaacaggggtcagagagcaaggctagaggaggcctttgagaaaagagagttgtgcccccttttcagtgagtgtggggcctctggaggttggcaagaagaggagaaggtgaagggtttcagcactgagagaatgatgtttctggtggggctttgccagaagggggctcatcacatgtgagtttttgcactcgtaagcctaaggggcacaatgggttttgaaatcccaacatatccaactaagaacaggaagccctgggactcagcacagacttgagtcccccattggatgcaatgtttcttactaagcggaaagaacttgttttcactccctgccaatgagtaaagaatgaagagctagatttttctttgaaggtggtggatcatgacccctccttgagactaagcaaagaagcactgatgttaccatggagaggagtgagcccctcacccaccccaggtgagaggtcttatcctgactttttagtcataatccaatgtgatattttgcagggttagtggatgcagtaggttaaatggtggctcccaaaaagatacgtccatgtccttacccccagaacgtgtaaatatggcctgatttgtataaacggtctttgcagaggtaattaaggatgttgagatgagatcatcctgaactacccaggtgggccctaaatctaatgacaagcatcctgataagagacacagaggaggacagtcacaaagaggaggaggcagtgtgactacggaggcagagactggagttaagcagccccaagccaaggaacacctggagccaccggaatctggaagaggcgaggaagaggtctccccaagagccttcagagggagcctggccctgcagacaccttgatgtggggcttctggctgccaggactatagagaatacatttctgtggttttaggccactctgtttgtgacactttgttgctgcagccctagaaaactaatgcagtcaggttgcccagagagatgaaatgactggagagagagagaatctggtcgtctagaaaactgagttcagcccctggacttgctgctggggtctgaggtgaactttcctaaacgttgtgctgtggagtctcttccctcttgcgttcctcatacattaacttctcatggcagagatcggagctcatggttcacctgaggacactactaaggaccaaggaagttcaatcagatcctcacatctatttgaaatagtggtagtaataatgaccacactctatagaatgtttaacatgtgctaagtatgtcacatacattatcccatttaatcctcgaaacaatcctacatggttgctattctcatccccatcttacagatgaggaaactgaggctctgggaggtaatggaatctgctcaaggtcatttggcaaatgctggtggagccagaccttggccccaggtttgcctgtgcttaagccacagtattacagaaggctcaagacccacagagatggtcgggccagcagcccgtagcacccagctgtcagatgagaaaggatttatttattgatgtatgtattttactagcagcactggcattagagtttctttgtcagtgagggttggagtgatgggttgattgaaatgaaggttgctgagatgacctggtgggtcctgctaacagcagatggatgtcaaaacatttgcattcagggggagataaagtcaaaactgggacaaatcaactttctctcagctccagggctctaaggtcctttcttcgctctcagccttgttgggaaaagagaagaaccccctgccacatggtctctctggtgtgagaagctgacagtccactgctgagctttccctgctttgccacaaatagaggcacctccccacacaactccctctcctgctggaatgggaagagaggacactggctgttaagaagagctctggggatctcctgtcctggggcaaactcagtttctggagtcccctcttatagggctaaacccaggtgggctctgactgtttggggtccctgtgcctctcacagtcatgttttcagagttttgggagatctgggctggtttccctcttgccatggttcatgctggggtgtggccaacatggcagcatctcccctgccctcccagatttcaggttggagggagttcggcttcagagagacaatccacaggcctgcagatttcctcccatgcagacctcagtgcaagataaagtcaggcaaggctgtgccacagcacaacagcataataaatccccctctggcctcctcccagacttattgttctattgcagttgttttgaatatgatcaaaaggaaggaagagactatgctatcagactgaggaagaaggatgctctcctgaccgctcctgttgcccttggccaccttattttaaatatgaggaaaccaaagggcaacgtgcagcctaaccccatccacatcatgaggagtgatgagctgcagccaaggccccatggagctttggtgaggcagcaacccctgtgcaaactcgctgacagctaccttagatgtccagccctgtccttttacacaccatggggggctggaaggcccaagcacagggtcagcagcactttgaggctggagccggaagtaggccctggagcagctgaggtagctgatgttaaccccttggactgagaactaaggctgtaaggccacaaccgttggaaataatgggccagaacaggaactgcccaagctcagctggcccggtgcccacttctcaagatagtgaatggctcaagttctttggaaatgttgtcaatgtcagggctttggccttgcctatgtgcagcccaggttcaggcacaggcatggggtgggctgtgacatcggccaccactgctggattcctgcaaggaactagagcagaaagcagcgacttgccttagccttcaaaggtagaaagggcggagccgagtgttcctcttcacagacttgcaggctcacacagtcctctgccctgcccaatgcccagatgctgattcgccaggtgcctggctgccacagcccggtcacctttatctgggctggaaggccacgtctgagccatcaaaggagcctcaatgggaggggacgtcaatgtgcttcctcaaccagaaaggtggtttgagtttggccaaagcagcccaaccaaataagtaaaagcctgtcaatggaaagatgggggctgctgggagatcacacgacaacagaatgagaaccattatcagtctcatcccagcctgaaggagggagagcctttgaagccacagacaggctgaacagaactttccacctgagagacgctggagatgggaggtcaggctgcactcagcccctacgaaaactgatcaaagcctgctgcagaagggaggggggcgcacagctgcagttccgactccccccacgggccgcccgggactttctgaaggcaacagggctgcctttgcagggccctgtgggaaaacccaacacagatgcacattgcagccaaacccccaagcactgctgggagagggaaaaataaacccctcaatagtcctgaaaagaaaagggagggaatcaaagcacacaaaaaatgcaaagaccacccacctgatgagtgcctacctttcggaaacaaataactcctggcttccaaggcgcacttctaaaagaacagacggactgaacactgcctcaaagctgcatgcaccaggggatttgtgggaagctgtggccccttctaagcatcggaagcttaatttaaagtgtgttggcctctgcggtgcctattcaagggctcccttgcatccgctgtcctccctgggaacctgggagacaagaatcctcatttagaaaaggacaggatcctgtgtggactcctttatcgtggttctctcagacaggacagccatatctgccagggaacattctagggggcatctttcaggctagatccagggtgatgtgggcccctgcgagggcatcttggaaggctgtgttggttctgcctggactggtccctctgggacagcctcagcctaccctgcctggcctcacccctcctccctctgacctgaagctcctttggaggactgacacttcatggagcctgcagtttgatcttttctgaagtggagacaacaaagcaaagccacttccactgtgtgctctctcaaaagaataggaaagctcttctctcctccttgggaatggatttggagggagggtggagggcgtaatgatggggaggccttggaggtattttggtggaggagggtgtgtgtggaggaaatgagccgcccaggagcatgggagaaattgacatgagaacatttcagaagcactggtttaaccggctgacattctttccaaaatggatggacaagcctttaggagtagacagagggcctcagggaggagaaacagctgaggaggaggcatctcccttccccctcctccagaggctgatgctacagagaaggcggcaaggcctcactgagcgcctacccaccactcactagatttctatctttttattaccttaccctgggagatgaatggggttatctccattttccaggtgacaaacagagattcagagaggtgacgagaggctctccaaggacccatatggaagtgtcagctggaattcaaccctcaggcagcctggctccaaagttcacaacctttcctacttgtttcagccctgccctgcctttcagggctaagaagatgttagtagatgttccataaatatttattaaattgaactgaactcagcagctgaacacacgcaggcctcttccaccctgaccaagaggaatcctttgagggtctgcagtatggaaagaaattctctgaggcgctaaataaaatcctgctctgaggtgcaaggaggacttttttgaaattaatagctaacaaagtttatgcagaccccaaaaggaaaaacagaaaggaattggaatcattttaaaaacagagtcggtagataataaaacttcacggtggtggtgttgtctttcatcaagaagcacgaagtgctcacaggctttaattacatcttcatccctacggccccttctgaagtcggtagatgcacgttaatagtacctttcgttttaggcatggacacattccggtaccagaagctttagcaattctccccaaggcaagcagagtacagagctggatcggggcgcaatgactctccaggccagcatcccatgctacctccagttgtatttcctgactccgcagctgaaaccaaggacttcattgacatatttaggggtagggggatctgaaggtctaggaaagaaggtgggcaaaaccaaggaatcaggcctccactttggcctgcacaccatataaatcccctctttgttcacccatatgcacattctttaatttaggcatggtttccatttgtgtacatcaatgagtttgctcagtcacaagggtgccgaagcctgagctggaccactcactttaggtaatgccacagcagacaatcagtgcctctgatcatgaagactggagaaatgtgtctgggctgggcccatgcatgatgcttgggagggaaactctcccagtggactctgcgactgggatgtggaagctcagacagctagagatgggaaaggaaacttaaattgcaaaggagtaatcctttttttttctttctttttttttttttttttttttttttgctagttcattttcaatcattcatttcctggcttaaaaaataattaatagtaataatcgcatatggctttttaatggctctccattgccaaatactatttaagcacaaatttcttcactagacactggagcccaatctacacacttgatggtgtggctccatctgggaccccagtctcatttcttgttcttaatttctgtacagttattcctaatttgtgaactgcagacctgcaagaggccagggcgtttcagcaaggggtccataactcttagtgccacaccaaacatgggcagcagctgaaatccatagtatgtaaaactcaggcgaatttgaaaggccgttaaattcctagcagctctttgtcattacgtgttttcttgggtacgaagtttgacaattgttacaagaaggggcctgcattgtgataacagttttcaacctgggatccaaggaaccccacggagattccctgaagtatagatggagggagcacgaggatggagcaggagcagatggggacaccccatgcccgcacacacacagctaattcatccctgtaaccagagagactgttttgatcagttttgtacactgggctttctagtaagattttatttgaagaaaggactctgccacagaggtgagtggggtagtttgcaagcaatggctgcagacaaagtacatgtatttctagccagtcccttgccacagttcagtggggcacagtgagaaatctgtcagctgcccgctctgtccagatccacacagtaagaactctgggtttgttagtgtcttagatgcattaagtcccatctggctcttagaaataacaaatgaacttgtagattagccaatcttttttttttttttttttttttgagacggagtctcgctccgttgcccaggctggagggcagtggcatgatctcggctcactgcaacctctacctctctggttcaagcaattcccctgcctcagcctcccgagtagctgggattacaggcatgcaccaccatgcctggccaacttttttgtatttttaatagagatggggtttcaccatgttggccagactggtctcgaactcccaacctcaggaaatccgcccgcctcggcctcccaaagtgttgggattacaggcgtgagcgaccgcgcccagccagattagccaatcttattgtcagtgcaaagacagtatccactttgcatatgtactgctgagggaatcattagaacattcactgctgctgagggtcaggtggggaattctttatataccagcttttcttgtgggccaaaatccctagagggatagtggccacttggggtccatttttatctccttcagtttctacccaaatgtgtctttgcttatgtggctggggcctgccactcaggctttcaggacacagtgtgcccccaggcagcctgggcctagaacagttgtagtaataagaggtgacaaagcaggaccttgagacagaacttccagaaattctttagctgagcctccgtcctcccagccaggtttcagacaggatgacacataaagaaatctctgaacaatccagagcagtgcacattagcgagtgaagctcaggcaggaaatgggaaggaatgcctttgtctctgctttccaccctgccacccatagctcattctcaaaagccacctccccaacactcaggctcggggtaaatgctacaaaacgtggtggaaacctctcacgacctcctctctgttgcatgaacgcctgttagaggcgaaggaaaacaatggcaaacagacccaggcctgtcacagctgtactggggccagctggaatgtggctgtgcgtgcgcgtgcatgtgtgcgtgcacgccggtgcacacgtgggaatataaacatccttggctccccagctcctgtgtgctggatcgtgctgagtgggcgcaaagttctgcatgtgtccgaggcagggaggggcagcaccagcacacctaggcgctctcatttatacattgaaaggcgggtgggggggacaaaggagaaggtttgggaatggctggctgtgtgcccgtgtatgtatgggcacatctcattgttgatatgtcttgggggaaattgagggaaattttgtgcttgggtatgtgtgcacacatggtaggcgcccacactcaagtgtgcagagggggaagctgaaagaaagtttcgagattctgtgaacattctcagttagaaaaaaatctggcaactccccataccacaggtgggtacacattcaatgcttgtgaagttcatttcctgtactagttaccagcccttgtttatacaggacacaagatgtgcttggtagcaaaagctctaggtctccggggtgagttgagggagagtgtgtatgtggagggggtggggagggagtgtgggcatcaccgcacaggtgctcttgaagtacacatgaaatcaattttcaatattaatccataattccactcatatatgttcagaggggagagaaagtagagctctaattttagaatgaccccctccttcattgctccagtgctgttttagcacccaatctgctcgggccagtggcagctcgggtgtcctcgtgtgtgtttatgggtttgaaacgcatctggcttgttcttctttgagctttactttgtgagcccagccccaggaagtgtttatgagctttttcactttgctttattctggctcagctttgtttggtagcacagaagggtagagtttgacataaatactctgttctttgtgtgagggcttcagattgcagagggtcctaggactggcattccataggaaagttgaggagtttgacccaaccccatgatcacacacctgtaagcgaacattctgcacacctcaatatgagaagaaactgcactctctaaacaaactcctgggcacgtgacctcctcagagtctacttgccagtttgttcatccagatggtgaccagctcacaatagacactcagtgactgctaattaaccatggaatattccattccactgcattaccaaagtgccagcatcactcctcagcatagctcaggaccttgtccaatcagctgtcttgaacacccactttgatccacggttcacgttcatgttatagtcatgagcccctgctcctccgccagtctagactcaaggaagcagtggcacaaatctcctggctgttgggttccatggagcagagagcctgaacccacccggaaaccaagtctagacaaaacagagctttgaggtttacacccacaacctttgtaccgtcggaagcagagggtgccaggggatccactacacgctccctgggaagcagaagccagaggtgtcgtgctatttctccatctggccaagggtttaaccctgctgaagactatttctgaggggagtctccatgatgaggggacccaaagatgctgatggggtcatttcccaggctctgttctggtccagtgcagggctccagttgttgatggtgatggaagtttgctttatacttggtccctgcttggttggagtcctctgccaccctctggcaattcacaacatctagtcacttggagacctctgaacaatagcaggactctaaagactgggacccatggctcctcagtgaattctgaaactgctttgaggtgctgcctaaagttcaaggagaagcttaccaaggaacggggacctggggacagcaatggaaatagagacagtgaggtacaggccactcgctatcctttgtaggaactttcagctcctgttagctagagaccgttgcagagtcaacattctacgcaagccagcgtggcaccctgcttgtctatgattctattcaaggcccagacataaccagccttcatgggcttccagaccactgagattgcagcctggggtgacctcctaccctgtctggaagggtctccaccccaggcctggtcctgcaggaaatggttcccgtggggagaactcctactgctccaaggcagcagcttccttggtgtcatcagtttacctgccagtctcatctctgagagggtaccagtttctttggcttccccgcctgtccccagaatgattccaacacttttttagcccctgaaagccttggaagggtgcccacttgcatttctagtgaatagcatttccactggaggcccttcacccagggttccctacaaaggggtttgcttttagggaagggcaaggtgaccctgctttgtcctcctgaagcaccacttgtggctctccatcactgtgcctgccatgcaatcataatcctcccctttctgtctctgccccgctagcctagaagtgcctgaaggcaagagctgtcttagaggcacactgggaaaatagggggccctgggtcctgattgagtgagggcccagctagggccagagggcctgggctcaccagccactgggcctggataaaggtggttttcaaggggtgagtgtagtctggcctgtctgattctcatccccactctctgatagtgctatgtttttcaccttgaaaatgaagacatactaccctgagcccttcactgggttgtcaagtggtcgtgtggcacacgtaagggagcattgccatgttaaagctccccagctcccttcattatggccatcccatggacagaggaccatgctgtgactcagaggcccagctcttcctagctgtgctgttccctgagtgaacttcagtgagttgctttatctcagtgactctgtttcatctgtgaaatgggactgtcgggttgtcagggcaagtacttggaaccttcactgagtggtatggttgtgggcattccttcttattgtcattgcttaaataagcatgaagatactttcctgaagaatgatgtttggaaggaaggaacctagactttggtatggggtgggaatggagtaaatcctaaatccatcccttgttaacaggcttgtaagtggaattcttgcctagcgagatctaggatagttctctagctcaggagtcagcaaatgtttactgtaaaggggcagatagtgactatttttggccttgcaggccacagggtctctaccacaactgcaaggcagccatggacaatacataaacaaatggacatggccttgttccaggaggactttatttacatcgggctgcaggccggatttgaccagtcggccatggtttgcttacccctgctttagcttatggggggtgccccgcaagcacttgggaaattaatttgttgaagataggtgagtagaggcctctgatagtccagatcctcggttttagctctgtttacacaggaccaggttctgtgttcttgccactgagtcacagctgcaagaccctcacctccccctagccccactcccccagctttgagtgatcccaggctccttcaagcccactgctgagtggggagcagtttctgtgccttccaggatctgtctcccctactgccactccccatccagggctttttccctccatcctgagtttgtgggacacacaatttgtaatctccttaaaactgaagaagtgaggtctctgattcatgcagattaaaatcagctgcaacctattaatggcccagggcccaagacagattttaggaaacaaaaacactggaccaaattagactgagccggcctctgtctccagggaagggaggtagagtaggaggctgggggcgggggagtggccatgtggttttcattactttggattctcttcctgaagcgaagtcacccaacacaaagtgtatggagcgccaaggcagcggccagcctctggagcccggctctccctggtagaagccctgggtcctgttggggggctctggctggttgtgtgtctgtaattaacaggtttcaaagtggttattttggaaaagagaatttcagtggcgcgtcaaaatcctttcatcagccatcagctgccgtcccgaggccttcagcaaggcctgagccacttaaggcttctgagagctttaaattcccagggtcctgtttgagaatgtggaggcttttgccatgggttttattgggctgatggttgccatgattttcattatgttatttggttcctgggatcataaaaatgtttgcctcttcctatagtacctaggatcattgaaaagaaaagggataaaaaagcccctgcatttgtagctgctacatagcatacaaaccatggcttccttgagggaaaagggccagctctggctctgggctagggaaaatcatcaaactggaagggacaggacaagcagccacacccagtctccacctccctcccatccaaggacactgaggcccagagagatgctcatctaaagctggtctggaatcctggtcccactctcggtcaggtgctctttctctccctggtgacttgaggctgtgagtagagttgggaaaggtaaaggagtctgaattctgctgaactagtgctttgggacacctctaggagtggaagaaatggtcagatttacaggcagcataaagtgaaatgctgaagtggacagaggaatgatccgggccagcctgggcattctcatggcctacaggacagagcgcttctctgaggctggaagggttactgcagccttcacttggcacccacagccctgagacatggaaagaagggaaacaggtaccaaatcccacaagcctcagagatgatttctcactgctttgaatatgaaacctctgaaatctggtcaagctcccagaatcaccctagggggtgacaggaattttggttaagcccgtattatctgataagtggaacactaacctggctttacttcctattttgatgatggctaccttccagaaccttctttcatggaaaacatgaaaaatattctgggagaattgctattaaataacctctgctgtttaaaaacaaggccagaccagcagaccttgctctcagcaggacacatgtaagaactagtctacaataaagaagctattaaggcgtgttcagagaattagagagtgttggagctgagagggaaattggagttcagctaggccaggctttcattttacagatagggaaactgaggcctcagggcatatccaaagtgatctagggggcatagggagtccaggatttgcttgactatctcattcttcacaaggccactgttccccttttgggttgatattgtaattcattcattcattcattcattcattcagtttttactacctcctatgtgtcagatgcttctaggcactgctaattttgtttctttgaagtttctagaggtggaataaaacagacacatttctgtggactacattaaagaaggaaaggacttttccccccaaaatctaggtttggggaaagtctggtgacttttgtgagcctggggcatctttgggaaacgcctgccctcttgagtgtgcctttcagatgagtgcgaaatatcattgtcagataaaggggtgacttgcctaggctgcccccacttgcagtgacccccactcccaacagccacctggcagtgtggcccaaaggaatctggaagtgaacatcagcagagattctctggatccaaatttgagtgagggctggcgggaacccagactagctggaggctgcagattgcatgggtctctccgtctgtttctcatcattctcctcctacggtttgcttgtcagtcctttgctcttgtttacctctatgtggataattcctcgattataaatcagagaacttggcactgagttctggattatctgtgatctttaactttcccagggcaaaagaaattaaaccagcaaatctctttgtttctcatggttcagcatccaaatcatggaagtgcgggtctgtgtagagtgagacagcctaagcccacctctgccctggcccccacactctaggtgagcagtcatgcatgcatgcattcatttattcactcaacaaatattcagtgagcacccatgtggcagcctctcttctagaaactggagatacagggttaaaaaaaggacactgttccttcttaccctgtttgcatcttagtatggatgacagtaagcaaacaaaccaacaaacatacatactagtgataaatgccttgagaaaggaagcaggttaagagatggcagtgaggggtgcactattttacacacagtggggtcaggaagacctctctgaagaggtgacatttgagcagagattggatgaagagagagtaagcaatgttcaatccagaaagaacatttcaagcagaaggaatagcaagtgcaaaggcctggaataggaacaagtgtgatgtgtttggggaacagtaaggaagccagagactggagtagagtgaaaaaaggggacaactgtgatacattaggtcagagcagtgggcaggggccagccatggaagtggtgactttgggttttgttctgagcttcacaggatgtccttggaggttttggaggagagtgatgcagcaaagatgaacattcagaggctatagagaggctcatggaacaacaatgggccagcttgggttaaacactggcattcagacacatggcaatggtagctgcacctcatgggtggtgcttccagtgggaactgttgagagctacatgtttcgacagggtgaggctgggcctgggagctcactacctctaccaattagtgttaagcccagaaaaaggaaatgctgcagtttaaattgtagggttggaacctgtgagtcatataagccccagccaaatgggccatggtgggctctgggaagttactggtgcagggtctgaagcccccagctgggctgtttggccacccatgggggcttccagacacattcggaagaagcagactcaaatacagaccccacctttggggtctggctttatttttggctgactgtatactgtctggtcagtttccttcccagtgtcttttactttggaaaaggcaggccacctcacaggggagcagagagaaagggggaaacacatggatttggggctcaatcagccccacaacacaaccctcacctcatcacttcgctggcttttggaaaagctactgaacctcccagagctgccagccacatgtggctgttcacatttaaatcaatttaagtgaaataaaattttaaaattttgttcctcagtttcacttaccacatttcaagggctgaatagcaacatggggcttgtggctatctattggacgtgagatgtagaagatttcccttatggcaggaagctctgttgaacagtttcatttctttaaaaaggaagcaatccacgagaactgaacaagttaacacacacaaagcacaaggtgtttgcctgtctcactacaggtgctcagcaaacggtggtcactgtgattgatcatgtgaatctccatcctcgctctgctactgactagctatgtggcaagtcattcaacgtctctgagcctctgttttctgatatgtaaaatgggaataaaaattaccgcggagcacatttccacagcataacatgatcctttttttcttagttctctctggacccatgagaacttccttaccaaccctcagctgacctatctagaccagagcttggaaactccagtcttgcagcacttagcaggaagcaggacctactgtggcccaataatgcagtctggagattttggccattttgaagggtttgaccatggctagtggtatggagttccaatgaaacaagtggacaaatctgatcaagaaaaataatcatttgactcaaatcagatatttaccctgctctgacgctctgaaagacatcatgccttgggttccccagctccaggccccggcttccctggctaaaagttcctcctgtgggcgcggctctcagagaggggctcccaggcagcccttctagtatctcagcctcgaatcagtcttccattttccacttggggtttttgttgttgcttaaacgtttattaactgcaggcatttggcgggtggaagttgggatttgcctggggctggaaggaagttatttgccaggccaggataaggtgtggtttcagagttgaaactggaatccccttcacctgcttaatgcatttcaggggagatttgttttcaactcccaaattacctgctaggaattctagacctgagatcctatctcactggctgttttctttcatttccgataagaaatacaaagaaaaaagagtgaaaggctcaaacacgacattcttgcactctcttaaataaaattacatacagtgagtgattttcttccctgtcttctacaaagcaggtaatgggagggcctgacctagcccagaaaacctctgctcctggggaggtgtgcctgggagctgcagagagcaggtgatactaaagatatttcttatgtgcttgttggccatttgtgtatcttattggaatataatttattttcaaatattaattttatgtccagcaatcttactaacctttcctttagtttaataatttatttttaattttgggggtattttctatgtacaaatcatacaaaggttatggggagtgttaaaactcataagggagtctccagtaatctcaagttcagaagaaacagagctagaaggacctgtgtccaagcttgtggagggtaagtgagcaagaagttgcctaaatgatggtctaactatgagcaacgggacaaagatagacagcaaagacatttcagacatatggaccaataatttcttttcttcctttcttcttcttcttcttttttttttttttttttttagagagatagggtctccctctgtcatccaggctggagtgcagtggtgcaatcacaattcactgtagcctcaacctcctgggattaagtgatctttcagcctcagtctctcaagttgctaggactacaggtgtgcaccaccattcctggcttttttttttttcttttagagatggggtctcgctatgttgcccaggcttgttttaaactcctggcctcaaatgatcatctcacctcagcctcccaaagtgatgggattacaggtatgagccacccaggtgaaccaatttctttctttctttctttcttttcttttctttttttttttttttttgagacagagtctcactctgtcgcccaggctggagtgctggagtgcagtggcatgatctcggctcactgcaagctctgcctcccaggttcatgccattctcctgcctcagcctcccgagtagctgggaccacaggcacccaccaccatgcccgggtaattttttgtatttttagtagagacggggtttcaccatgttagccaggatggtctcgatctcctgaccttgtggtccgcccacctcggcctcccaaagtgctaggattacgggcgtgagccaccacgccctgcccggaagctggacccatttctttaggctggcaactcaagtgattattgttgttttaagccactaggttttaggatactttgctatacagcaatagataattaaataatttaccatattaaaaactaaaaccaaaaataatatttgttcatttaatatttattcattgttaatgaataaattaacatttagtaatttattaaaatgcatatattcattaatccatttaaacgttaaaaataacattttattataaaaataacttttttaaaaaatccaagtgagaagagtgacagtgttttacatttttgcaaatctcttgactgtccggcttaatagaagacagctggattctcatatcggcttctgcattcaatcagctgtgataatgttgttttggataaagtatgcgaaggaaacccagcctcacgtagttattttgttggaaaagggaggaatattttaatagtcttttcagataattgtgaatattcttctttgacattataccaaaactcaaccaatagtagattactaaggttagttgcaatgtggaatctgaaactatatcaatgaactttttgtgctcagttatgttaaaattcagttatctggcttgtactctgaatagatcttttgctcatgcatgattttgaaataatatgcatgggtcatttggaaaatattgcttcactaagtcatgcagatttttcaaatttgatatatttcttgatgaaaactaaaagttcttatttgttaatatcactgatctcatcaaaaacctctgtaagtgttgggaaggtgttaagttcactatggcagatacaggtttctaaaaattctaatttttgctttatacttctattttggcagaaaatactgttaattattgtctttcttgaagtgatgagctcagtttgttcatttttgagaaaatgcctgtcaaataaccaaatctgaataactatggttatttggtccttttgagtaaacattgtgttccatgaaagtgactagtgcagatcacaactcaggacactcacacaagtgcttttcctccagatgaccatcatacttcaggatgcaccagaaatgcttgatactttgtttccaagtcatcacacaaagaaaagaaagggaagggaagggaaggaaaggaaagggaaggggaaggggaagggaggcagagaggggagaggaggggaggagagaaaaagtaccttttgggcaaggttttataaaattaataatttttactgtctaatttaggacattctttggtgaaactggcatttattccccctgtaagtttgtagcagtgaagaatgccgtgactgccagcatagtctagcaccagcaattttacccagatgtcaacacagtgaagaaggcaaataacatcttggtattattatgaaatattatcaaaattatgaaaataattttgagcttgcagacaccctgatagggtctcagggatcccaggggactgcagacctcacttggagaatcagtgctttagggagatggctgtcattctgctacttgtagcatttacaggtaaatgtgctacatgctaagacgtatatgtaccaggtctttgtgcaaaattgtaatcaccaccatttattgcataaactagaaaacatatcattaggtatcagcttattcttgtagatggactagatatgagaaaggcgttttatttaagggagatatttttatgcttttatttgtcccacttgtcaaaggtatatggatattggtgaggaagctaggctctaagccatttctgaaactatcagtgttgaataaataaggtacataaggaagctaacacttgcaccccttcctttgtaactcttctaccgccttgatctagtgagccctgaaagctcagtgggctgaggaaaacatcctttttagagtagcagggtgccctcaactccagtctagaagtgggcaaagttctcacgttggcagtacctgcagtgtgggacaagagaagcagctggcccagaaggcagcgtttgttcaaatggtcatggcacctgtgagcattgtattgccgtggaagagctcaagtcattgcctctgctaaagtgcctctgaattcctacacagtgaacttagagcacaacagggcgggaacatggttgttttccattcttgttcagctaggcttacacatcctctcactcccaaaaggcagagtaggcttgcaccccacacctgactgggctcagctctttggcaagtgattgcgtagctgttctgcctgtgactgcaggccccggtctgcaggcgggaaacaacaggcagttgtgtcctgagccctgggaactggagatctttccacatctgttcgcctagtcggggggcgggaggaaatcaccagaaccttcaaacatggggccagagcagggagacaaaggggaagccttaagccgatggtgaccccaggtcatatgagccccccccccaggcctcccccatccactttcatcccctcaggtccccgacactcagccttttcatccttctccaggtcagcaggatcaggttaatgtgacttgaccagaaagcttatcaaatgaaggcagagacaggtgtttgaaaccccttccctgctgaaagctgggttgaacaaggttagcagcgtagctgaggccaacatcctacactaattgcattttctttcttggagctccttctcttccccttctttgttctctggcttggaacccctcaaggtctccgagagccagtaaccaaaacaaaccattcaaaaaacgaaggatttagggaaaaaaaattaggggatgtgacattctggaccaaacagtggcccttctatgccagagcctaggaaccagcatttggaggcatccggccacttccacccagtgggcatgctgaaatcagttactatgggcttatcagaactgattgcacaaaccttttcccaacttcacaatcatgatgtcatatttgtagcttgagttgaccaaggtgggaatatttataccacagaaatcagcaagctacaaaccaggcttttccacctccagagccagttgttaaacatttaccggcacaccagtgcctccactgtggctattgtcactcaaagtatgattctcagaccaattacataggaatttcctagagatcagaaatgaggtggggcaggagggttgttatttaacatgcagatttcctggccaacctgaattaactgaatcagattctctggaggtagagcctggggaaatgctttttagcaagtccctgaggttattaataaattcaataaagtttgagacttcagccttagggaataggagaaaagagtgggcgtgcatctgactcttggcatctggaaggaacagctggcttcagtcccagttggcctaagaatggacagctgttttctctcgagatagaaacttcatgacaggaaaagaggtgggaattttggggtctcagctacccactgacaacacgactggttctgccttggatctcaggatgaatccattttccaacttgagactttgacccaagacagcatgagcaaatgcccagatgtatgtagaacgtggagaaagtcaccgtcatttgcaccattggtgggaccagtggagcccagggaaagcccagagtcagttttctgtattagattgcccaggacagcatttttctttcagatttgtctagacattttcaggatctttcccaatcaggcatgattttgtaaagcaaagaccttgttgacttcatcccactgagctggaagagaaggtcttctaaggcagaaagaaaaagagaaaaaaaggagaagagagaacgtttctttgcctagatgtaaaacagaaagttcataaggagcttaactctgctttcgccttgttttgcacctgcctgagggagtggtttagacggggacaagtagtgtgaaaacagagctagttagtaaatgcaagagctggggtttggaccccaatttttacagccaaaacaaaacaaacaaacaaacaaacaaagaccaatgcactttcctcctaagcacaatgcagtattttttccacatgcagttggaacccagaggaatccttaatgggcaactggggtagtgacataggacatatatgctcaaagtactgtgaattcctaaaccatcagagcccccataccctggtgcaaattccaaaacataatccaaagccacatgtaaaacttatgggattataggcaagtaaattatgaactattagattactggctattagattatccactggaatggataactgagagtcaaccatattgatacatatcatttaggcactccccatattagacagttaagcttgtagctgtttgctaagttcatgatcatgtgatcatttcctatacatttgttctaactgttcagggctttaattaaacatataacttcatcaaataggaggaggaagaaaccaaatagctcctcaggaaaacaagatatgagctcatatgtattttttgccaggtttcatggcctttctttgtgcccagaaactcttcctcaccctaggacccatcttcactttaatactatccattcaacaaatacatagtgaggacctactgtgtgccagttagggtgtggggaagaacaggagacaaaccacctggtctcattctcatgaattttacagtctattgggaaacaggtattacacaagtcaatatgaaaataagtaagtgattatacattgtcctaagggctgtgaaagaaaagtacaaggtacaaagagaaacgtcaatagtcctgaaaggttgactgcatcaagaacatgtccatggagaccaggctgatggagtttttgtttggattgttttgggtggcagggggtaggggtaagggcacatggagcgttttgtttgaggtacttgaaagggagatgtcaagtaggcaactgaatatccaaatcaagagagtctgtagtggagtggtgactcaagcccgcacctggatgaggtcatagggatggaatgtctgaggagaggcaacagctggggcctgctctctgggccacccatatgcagagctcacgaaggaggcactcccagagaggagggagtcccagaagccatttacaaagggtattttatgagtgggcaacgtgaaagtaccaacatcagaaaagcacctcaggacctccaggtcctgactccccactcctcccttctcatgagccaggcaggctgtctgcaggccagccagtgaattgaactggggctctcagagtctgaacagctggccatgtcttggacagtgcttcatgactctaagttattactttctgttcctttcctagtccctaactcagacccaagctctttgctccctggagtttctaagtgtgtaggtattaggaagagagcaaataaaccagttcacacagatgtatgaataatgtttaaccagccagttctctttgagatatattgttgtaaagaagcaaaactaaatgtctaatctgtggaatttcaggcaaccttatacgtttcaggtggtgcccttgagagggaagaccttttgagctggggctgccaccctgttcccttctagcttccctgcactgttcctgcagcagcttcttttcttcctccatttctgaatccccagagtcttgaaaacctccagaattttcagagtggttcctttggcaccagtggccatgcatctgacaattacagtagctaacatttatatgtaattgttagcccctcatattaaacctacattaaccctatgttaaatgaagttaaccataacatagggttgctgtgacttcacagcaaacttcagccctatgttaactgacttcacagcaacgctataaggttgggtcggttactcttctctgggtgaggctgtggctggatgagagatgtttgttagctgcctgtggacacacagctggcaggctgaaatttgaagcagcgtcttgctcccagtccacactcagggccgtgtgagtgggatgtgagcctgagtctgccctcccttgggtttgctgtcctgagagaacaaaagcaaatccgtgttctggttctctgagatagctcttactagacctggctcagtttgacccctttctgctgctggaaaggaggacagtgcaggtcaaagccctggttgctgattacagacaagatgggagtcatgtggggtgtcagcttctgtctcctgagagagaaaaccgaaaaatgctacctgaatttccaggatgaggttgaaggcacaatcttttcaggccaaatctcttgggcagaattgaagagactgcaaaaaaaatatggaagttaccctcaccgtttctgggatgtctgaattcctccctctctggaatggagccgctggaaggctccataatcctccctctcctggctcagaggcccagctacactttctaaaacaacccagagccatctgatttcaagcatgtaccggctcgtgtgtggaagacagtaattacctccattccagttaggaaagctgaaacctgcctttttcatgcctcaaacaattatcgaagtgccttttgaagctctggatagaagagaaaagcaaaacaaaccaaagagccaattagagcctgggatttgagggtggcttagttttgtgcagtgggacttgggaggaactgtgggagagggtcagaggtcaccccaaacctccagctgccaaccaactttgcctgtgccaaaagaacattattttgcattgaaaatcaaggctcctctccctgactcaggaacaatttgcaggaacaacctctgcatcagctgtgaagagggctccctgattaaataaggcctggaatgcatttgatgttgaacaaaacagttctctgacagcttttcttacttgccattagaatgcttccccttcagctgaaacttggtaagataaagtgaatccccggggacccttttgttttggtgtacatatttgaggaatttttgtggcctgtgttccatttggagttaaggttcttggtccctgaagttcttccaggcttggtggtagaagctggcaattcagaggcaggctgtgatgagagtagaaagcggataccaggcatgagggcagaggagagcaagtggccctgccctgggatgggaagcctgagggcttttttacagtccccaaggagagttccctgacattcaacactgccacaaggcgcagagtggaaagtggagttggggcatggtggggttgaagctggattagaatggacttggccaagatctgttcgtgatgtctggggtggccttttggattaacaggatttgattcactgtgaaggcaacgtagcactgtctgggaggttcccttttgagtttgggtgagaatcaggaagacagccagcaccaaagagccctgagagaacccactatgccttatttacatccctaacccaaactggatagaggagctttctcttggccctggcataagtgcccggctttccatctgcctatcatttaccccctcaacagtgggctttgatgtctaccctccactacaagaaaaagcatttgtaggaatgcctcttggtgtatgtgggggactgccccttagtatagggaaagttgtcctccatacacaaaggttttgtatcctgcaagtgctgtattttctatctgtgtttggttgaaaaaacaaaaacctacatataagtagacccaggcagttcaagtccatgttgttcaagggtcaaatgtattcctataaagcaaaacaaagaagcatattgcttaggaatgtgtctgtcgtgctcaaaatggagtgaatatcaatggtctggtggcatcaaaatggccagttctgtgacagtaaaagaggtttgtgtcttatttaatcttttgataataataacagctatggtgtatcacagctttaccaagtaccagacactgttctaagggctttgcatggttcactcactccttacgtcatccctcggtggcaggtgctgtaattatccttatattgcagacaaggacattgagacagaggtcaagccaccttcccaagggcacacatggcatctgcactgctcctgaccgaccgacagagagagctgctgtcacgatcctcaaatgagctatgcatgtcaaaagtttaaaaataaaaaagataaaaacatgcacaaaatttaaaaagtaaaccatttcaggctggacagactgaaactgagagatggccagagaagagtatgaaagataaatctatggacagagtaaaccctgactggcttgaaattagggcccttactcctccacactcctgacgggttggttcaagaccaagaaatagaagcacattgtgagttctacgctgctgccctgggaaacacacaggctaaacacacccacaggctcgagctggctttgaagttgtgcctaacagatccgagatgcatgatgaaggaatgttctggatgcgttcttctgagattttagaactgagttaactcacgttctcctacaaactgtcccttgtagtcgctgttcagaaggattccaggctgcctgtgtcaatgatttgaccccacaggatggttcttttttaggttctgacagggagcagaaatgagttttttgactcaagaagatggacgtagctgtagttctttaaaaaccatttatgtgatttccagtgttttctctgaggcaggtctccaacgatttctctccagcatgtggcagagaccaccagctgcttagcaggccctcaactgggccaagaatgttcgtgataggggtttccaccctttccatctgtggcctgtgataggcagagtaatggcctcccaaagacgtccaagtcctgatcctttgaacctgtgcatatgttacatggtgagggagaattaaggaagcaaaaaaggtgctaatcagttggctttgggatagaaagcttgtccttggccaagcataatcacaagggtcccagtatgtggaagagagaggcagaaaactcaatgtcagtaaagcgatgtaagaaagactcaatgggccattatcagctttggagatggaaggggccataagccgaggactgagggccacctctagaagctggaaaaggcaagcaaatggatgttcctctagagcctctagaaaggaacatcgccttccagatgtcttaattttagcccagtgagacccatgtcagacttttggcctccagaattataagataaattttccttgctttaagccattccattagtggtaacttttacaacagcaataagaaagtaattcaaagttatctgggttttcaaccctcaggtcataggacctggaggacattgtcccatgagctgggaagtgaaaatcatggtggtcaccttagcatccttcccactgaccatctgggaattctcatggttctcctggctaagccccacctgcatatgagcacttcagccatcagagtttccctgcaatggggtctcttcttgacgagtgatgttccatttcttagcagtgttgccagggcctctccttagtgtggtccagacatcctatagcattacaacaagctgcttttcacacccacactcgccccaaatgccaaacacttccagccagcacagggtctgggggatttttctccccttccagatagccagccacaacttcaatgagctccggcatatggaattagcatgatagaaccatgacatgccaagtgccgggagccaacctgagccattcttgggtttgagaagttatcaactgggaaatacttgtgatttacaattttcttctgtcctccaccattccatcacatgaacatccaagtcaaactcctgagctgggttaagaaattggaattcctgaggctctggttcaggttcttactacctctgtgacattgggaaagttggttaccatcatagcgcctcagttttcttatctgtaaaatggggaaaatacatgagttaatatatgtcaagtgcttagtgaactgtctgggtcatgttcagtgctataaaaatgttcattgttgttgttgctgttgtttctatcgttgttattattaaatgggtcccaaatcttgaggcaagtcatttggaaaaccagcttgttcgtgctttgccacatatagtcatgtgccacataacaatgttttggtcaacaactgaccacatacaggactatatagcctaggtgtgtagtagactataccatctaggttgtgtaagtatactggacgatgtttccacagcaacaaacccacctaatgatatatttctcagaacgtgtcgttaagcgacatgtgaccgtattatacgtccagcaattgagatgaattaccgttgcacacagtgctgaagctcaggtgtggacaccctcttttaaaatatttttcccatgaacatgtcctccaggaagcaggctccagtgtgtcacagccagatgagtgattgttagggaagacaaagcctgtgtttagagttatgcaagtatagtggggagagggcatcttattgctgactcacgcccactggcaacccagcctgattcatctagactgctgcagaccactctgcatggaagacctctgctcagaggatctcagcccactgcatggcccaccaagagcctctgacattcaggccgcttggttcttctggattcagttcttaggtccccgaaagtggtaaaggagagaggagaaaactagttcattttcagccaggagtggcccctggcacacgggacactgcttgctttggacagaggccactcacaacaggcttccccttctgggtgtggtggccagcctgccctgacaacagtgcggcctgaatctgtgactcttagcggctgcttgggactgctgcaagactctttggtctgtgacttgcccaagagagaagtttctgggcagaacggggagctcaggaaagaagaaagttacatccgcacaaagtttcaattataaagcccaataataacgatgaccaaaacaaaacaaaaaacgaaacaaaatgaaaaagcctacatgctctttggtattgttgggactgaaaacaatggaactgagtttcttgactttttcttaaccttatccccatgaaagaggtttgaattacagtatttttcaaagtaaaagccatctgaacagctgcctgaactaacctgggagcctagacagtttagcttcttgacctctgggatgtgggggaaggggacaaaaggaaagagagagtaggggaggagcgagctccttctgttttctgggctggccatttgaggcccatgaaccaactgagctgatgtcagactctggcactcccacttccaggagtcacaacaaagtggcagggatcaggggcacccctgggtctcagagaagtagcacattgtaggagaaagagaatatgctgtgcagacacacccagatttgtgttttgctgctcctttcactccatgtgatttagacaaattacataacctctctgcaaataggaaaacttccttgtgcctgttggtcttggaaggactgggactacataatgcaccaatagaatgtctggagcacatcagatgtacaatatatgagcagtagctatttttattattaaacacaacaaccacttgggccaaaggccacctaatttgtagaatcattgagccagaaagaactgcaacaagtcagctcataaagtatgcatagaaagaagcctggaaggaagtttactaaatattaacaatgattatttctgagcagtggaattgtaaggatatttgtgttttcttctttatactctttcaaattttccaaattttctttagtaaatgtgtatttttttatactgaaaaactttaaaacattattttttttaaaagtcttccatctcagtttgtgggctccagtcagattgcactaagccatctaaaaccacagtcgtccaacctgttgctaaagccatgagaaaaggctggcaccaaccagtaaagaattccctccagtcttccgtaccatacatcctgaatggagcataatccctgcatggtttctagcccatcataaccttgctacactgtttcatagaaaaacttcagccattgagaatgatgtcattcatcatatttcctctttctttgccttttgctgccaggaagccttaaacaaatttaatactcaattacagtaataattaactcagattttgggcataattattttcccttcttcctctatggtttaattttccctttattattcaaccaacttattgcatatgtgactttcattgtaaactacctcaagtacactttaaaagttggacataaatcataaagtataaataaattaagttttatctgatctcttgtaaaaacccatgatcagcctgttaaaattcatattactaaacatcttgaccagtaaatgtcaggagggtggcatgaagagcaagaaagagaaagctctgagtcaaggtccatatttagtgggaaaaaaaatcctggcaaatatagatttgttcagaactaattatttacctttttttttttttttttgagacggagtctcgctctgtcgcccaggccggactgcggactgcagaattatttaccttttaaaatgggttacttaatacttattctagtatgtcctgtgagcatctgttgggtgtcaggcacagttttaaatgttatttcattaattttgtgaggtaggtattatcatttctagctgaagaataagaaaactaagaatcaaacaagttagataacttgctcccagtctctcagttagtaagtgataagtctgcagaagaaaccctggtccgtccaactccaaggaattcacaaccctattctgtttcatcaaatacaggttttctttctctaggtgggttatgttgaaatggtgaaccaggctgaagccacaggttgactgagttctaaatccagaagcacagctagaggctcctgtggaatgagagggactaaaattgcttcaagtgcagtggattactggggttagactcacttctaaaaatgaaacactgaagtggggctttctttttttctttgtttttgagacaggatctcactctgtcacccaggctggagtgcagtggcacaatcttggctcactgcaacttcctcctcctaggttcaggcaattctcccacatcagcctccccagcagctgggactacaggcgcgtgccaccacgccaggctaatttttgtattttttggtacagacagggtttcgccatgttggccaggctggtcttgaactcttgacctcaggtcatctgtaaggtggagcttactaggaaagaacgttgaaaaacagctgctgatgatatatctgagactatttcttataggaaactgtaggtctatggaggcaggagaaataatcacagcccagcaaccagaagctaggatgctttcactactaagggagagatcactaacaccatagctgggaaagatcttaaatcatcacttgattctgaaccagagacctctacaaaatctctaggatagaagaaaatgaggagaaagaagaaagaagaccttactctctaaattagtatccaagcaaaaatattcaacactaagaaaaccagtcaacaaaatcaacatttgttatctaatcttgtccaaaagaaattaaaataatggaacaatctgactaaaactttaaactaaatttgcctaaatactcaaagagaaataacatctactttaaaaaggatattgtgaaataaagcaggcagaaataagaattggcaaatatgaaaaagaatgaattaaaaagataaaatacacagataggataaattctagacatgaaatagatgaagataaaattagtgaataggaagatagtatttaagaagccaccaaaacgtagtgcaagtcagagttaagggcatgaagatatactgagaagctccaatttttatacatacatatgagatagtaaacctatctacctcaaggataaaaatgatagtattaaaagttgtggctgggcacagtggctcacacttgtaacctcagcactttgggaggcagaggcaggaggatctcttgagcccaggagttcaagactagcctgggcaatgtggcgagaccccatctctacaaaaaatttaaaaaaaaaatgccagtcataatggcatgcacctatagtcccagcttcttcgagggctgatatgggaggattgctggagcccagaaggtcaaggctacagtgagccatgattgtgctactacactccagcctgggcaacagagaaagaccctgtctcaaaaaaaaaaaaaaaaaaaaaaagagataaagaaagaaaaaaacaaagttaccagggagaaaagagagttatttataaaggaatgatagctgcattgataatagacatcttactaacaatagattccagcagacagtggagtagtatcttcaaatatctgaaaggggaaaaaaatcacttgtaaagccagagttttatacctagctaaactagctttcaagagccgatttaaaagaaagacagttttaggatttttttaaaatgaagtttatatcagtcttgagtcttcactgaaagaaccattaaaatatgtattatatcaagaaaaactcagtttcaaggcaggacatagaaatcaagaaactatagtggacacagaaataaataagttaaaatagacttacttcaactgactataaaataactaaatctagagtttaaaataaaagttaaataaaaaagtaatatgttgagataatatgttagtagaaagagtatttactgggtaaagtgtgctaagagtcttgccttgttcagggaggaggataagatattgaaaatttcagactttgaaacatatataattaaatgtgtatggtaaaactttaaggtaattatgaatagaaaagaacatcaatctataggttctaaaccaacaaaggagaaagcagaatatagaaaatctcaccaacctaagagaagacaggaaagacaaaaaaaaaatgaaagaagacaggaaagaagaaaaaaacctaagagaagataagaaagaaagaaaataaatagaaaactaaataaaatggaagaagtaagtcaaatatgatggtaactacaataaatgtaagctgattaaatgtgtctattaaaaattggagaatatcagattagaatttttaaagtattcagttataagctattttcaaaagacccacttaggccaaaccacacaaataaagagatgacaaaagacataccacaaaatgctaaccaaaagaaaggtgggtggtgtcacagtaaggcaaatggaatcttgggaaatatatgttaatagggatagagagatatataatgatataagaaaagataatattcatgaacctatatgcccctaaaaacataaccttgaaattcaaaacatgtaaagcaaaaactaagaaaatgtaaaaatgtaaaattgtgttaaatttaaatttatttttacagaaatttattaaaaacataaaagatataaccacaaactgatatatcctttactcaaaatccaacaataggccaggcatggtggctcacacttataatcctagcactttgggaggccgaggcaggagaatcacttgagttcaggagtttgagaccagcctagacgagataggaagaccctgtcactacgaaaaataatttagaaattagccagatgtggtgactattctggaggctgaggagggagaattgcttgagcctgggaggttgaagctgcagtaagacaaggtgacatgccactgccctccaacctgggtgacagagagagaccctatctcaaaaacaaataaaaaccaaagtccaacaatagagaatatatgttcttttttgaaaatatgttgaacatttacataaattgacataacaggccacacaaaggaaggtctcaacaaatttgtaagaattgttaacttatagagatattttctgaccacagtggaatctgatttttaaaactcaataaaagatgtgtttaaatctagaagcaaggagaacaatagattaagcctaaaaaaagcagagcaaaataaaactatcagaaattaatggaaaagaaacaacaacaaaagaatgaacaaatccagaagttgattattcaaaattactagtaaaatagataaaaccctagcagggctgctccagaaaaaaagaaaatgcaataaataatattaagaattataaagagaacataatttataatgatagatacaattggaatgaaaaaatcataaaaaatagaatgagcaaatctatgaacaacttaatactagtagaggaagttaatgatttttttagaaaagtaaattttgaaagttgaatcaagaataattaattagaaaatccaaatcaaccaataacccatgtaggaaatgacttgctaccacaaatcagagccttctacccaaaaaacattgggcataggtggatttctgggatgtttggccaacctatcaagaacagctaacccttatgttacacaaactgtttgagagtgtagaagaaaagggaaagtgactcatcttattaggcacttgataccaaacctaagaatacaagaacagactaatccattataaacatagatgaaatttttctaaataaaatattaacaatattaacagagatgacatgtcttaatatagatgcagaaaaaaattattttctagaattcaaagtccctttattacataaactcttagcaaagtaagaataggcaggaacttccttaacttgataaagaacatataaccaatacctttatagacaacacactcaatgataaaacttcagaagaaagatgatacctactatcacccttattactcaatatcattctggaagtcctaccagtgcaatgagaaaagaaagagaaatgaggtataagaattgaaaaaaaaacagacaaacctatctttctttaaagataatatgattatttacacagaaaatccattgaatccactgtataggaaaattattataaataataagagatttcattgagtttgctgaatacaacatccatatacaaaagtcaacagcattttctaggcactaggtaaaactaattggaagggagacagagactgagattgtagctggaggggaatgtatcaaagtaggatttttaaagatgggagattcctgagcactttgtttgctgttgagaataatccagtagagtgaaagaagttgattgtgcagaaaatagaggtggatgacttaggaataagtcctggagacatcaagagaggatgggatgcaaagcacaagtagaggtgtttgcctttaagagaaacagagctacttcttccattgtaatgagaaggaagacaattcctatgccagtagttgtacagatgtcacagtggagggatgagggagtttctgtctgattatttctgttttctcagtaagacataaactgagatcatcagttgagaggggatgatcattggaggtctgaggggagaagagataaatagtgacctcagaaaagttaaaataaactttactatggaaaaaaaaatgtagcctttctgagcaatgttgagtactcatttgaggactgcagtcatagatttaaagtgtaatcagtcaactcagtggaattactttctccattaatcttaaattgcttcaggactgtttcagcctaagccagtagctgggtttaaccaaatttgaagatttttctaggagagtttggcacgaggagagaggggcaaaggcgtgtaaggcagtgtttataacagtggcccatggaattgatcatgggtaaagagaaaacaaggacatgcgaggaggtgataaatagaacaaaacaaagcaaaacaaaacaaacaataaaaacagacaagcaagtgagcttaactgagtggtcaaaaaattattggagtagaaatactacagaaggttggctggaaggatgaaaatggtggtcggcgtataacaattgaaatctagacttgaaaggtggtgatgacaaggctaggctatggccattttaatgtagctgaagaaagtggaagaatagatcactggaagtgagaaggtcaggaactcagagaccaaggatgttaaagtcaccaagaacgatgacaaaaataggggtgaaaggaaggagttgtatgctcaagtgtttaataaatgaataataggttattgatgacagcaattcagtgggagaagggttatataatgtgaaggaatgagcatccaaatagctgtggtttttaaaggataaaggaggagaaagggtttggaagtagcagtggaaagcaaggaagcccatttccctatctacaggctctgggatatgggacagtgagataaaaaacaaccacacttttgggtgctatggggaaaaaccacatcctcagggccaatcaggttttggtgaaggcgcgaagatgaacagaatgttcaaagaagaagataaagatttagaggatttccagaaagctgagtggagtgggtggatattgggtcagatattaatagcagtaccaacataccttatcatctgtcctcccgctcccaccccccctagattgtaaattccacaagggtagagatctttgcctattttgttcattgatctgtcccaagaactaaaacagtgcctggaacattgtggatgctcaatacatatttgttgattgattgattaatagtagctaatatttattgagcactaatgtgccaagggtactagtaagtgctttatatatattattattgttattattattattattactctccccattttatagatgagaacattgaggcacagaaaggttaagtagcttgcctaagttcatgggactagcaagttgtagagccaaagttcaaacacactctagctctggtttggttctggagcctctgtattcttaaattccaaattacctcaccttttcatggttggtggatgtacagaacaatctcaaagtagaagcccaggtaatggtaaaagaccaaggaggctagacctctagtggagactgaggttaaaagttaaacaataaatatgaacactgatttcaaaagttagtctaaaagctagcctagggcatttgctgcctctaatgtcctatactcttgttcatctcctattgtgattgtgatcaaggcaccttctactgtcagttcccagatctttttatttcccacccccacccctcaccccccacatattgcccttcttcattatttttagtttctgcatattcccattccgacacctggcaaacctgccactcttttccactgacttctcttaagggcagtcaggtgcattgggacctaatttctaagcatgtgaatagtgacacgtcgagcttacagcaggccttaggatcaccaggctgactcactgtcatacagattccaactacaaaaatcatctgggagcgccctccgaagtgctaggattctgctggctgttttatgaacagctcatactatgaagtggaaaagtaaaggaacattccaacatttcaggaaaaccaaggaaaaaaatgagtatgtgtaactggatggaggaagcctgggatagtaccactatttctgtgtgaagcctctcctaactctcagtgagatacatgctcactagggtcaggcacatgaaaggtctctaggagcacttggaggtttggaccagagatcaggacccacagtgcactggtattgttgtgtgtgctgaggttctttgggtgcatgcaacagaaatgcttctggctaatgtaagccagagtttaaaagaaggatatagaggtcccacaggattgagggaaggctgaagaagcagtcttagaaatgggtaagaagcaggcaaattccagaaactaggaagcaggaaacacaaggctcacaagagtcccacaggtctggtcaggacactccacttggatgggatgaaactcctgacatctccattctttttgtccctctgttcaaaattcaccttccattgaagggagcatctgattggcccaacttgggtcaaaaacctcctaattgccagcaatatccacagactgtatcctactgggaaaagataatccgccaaaaggaaattagattgttattaggaaagggagatgagtgctaggtgctctggcagccaccattcccaacccctccctggatgtttaagaatatataaaacatttcaacttgagaaagcagattgaatttttttagaaaagaatatgtaaaactgtatttcttctccagctgtactttccgagccctacattggtctaaatggaaggatacctttcagtaccagcccagtcatgcttttgcatgattacctctatcaaactctatttctttggaaggaactcttaaatttactgtcacataaatgtttcctggtagctcaggttatcctttgtaaaattctgtctacctctacagcttgaagttaattttccttaagtcttcaaaaataaaagttcagtcttgttattgatttagatccttgtggaaattttttagtatttccttactcttttaaatagtctttttccccccttttgctgcttttcctattggttttctttcattaaaaattgagacccagccagtcgcagtggctcatgcctgtaatcccagcactttgggaggccgaggcgggcggatcccttgagcccaggagtttaggaccagcctggaaacagagatgctgtctctacaaaaaaaaattgaaaaaattagctgggtgtggtggtgagcatctatagttcctgctactcgggaggctgaggtgggaggatcacttgagcatgggaggtagaagctgcagtgagccatgcagtgagccatgactgcaccactgcactccagcctgggtgacagagtgaggtcctgtctcaaaaaaaaaaaaaaaaaaggcacccaaaatttttagaatgactgtcacaataatagcacatgtccctgaatagagatcctaccttaatgttggttaaagggggttgctcttaaaaaggaaccatggccagtcgcagtggctcacgcctgtaatcccagcattttgggaggccgaggcgggcggatcacgaggccaggagattgagaccatcctggctaacacggtgaaaccccgtctctactaaaaatacaaaaaaattagctggtcgtggtggcgggcgcctgtagtcccagctactcgggaggctgaggcaggagagtggcatgaacccaggaggtggagcttgcagtgagccgagatcgcgccactgtactccagcctgggcgacagagcaagatttcgtctcaaaaaaaaaaaaggagccatgaatcactgaaacagattttatttttgtttttgttttatttacctctgcaatatccttttaagatcagtgtgataggagacccatcctaagggattgttggaaaagaggaaaaacccttaatgaaaagtactatcattttagttcttctagatttagcccatatcttgagattaaaaagacaattaatgggatattttgagtgagaccttcacatatatgctccctttgataaaatttgtgtctatggcagtttttttttcttaatcgaccttttcatttctttatttattagtttaaaatatttccatgtgtaatctcattttagttttcaaacgaattggttagaagaggtattttgtccccattttaattatgtagaaactggttcacgaaaagatgatgatttacccaaggtcatgtagctaagtggtcaaaaaactaggctgagcatcaagatgtcttcatttctgggtgtttatttaagtcagcgatctcaaactggggccagtaacacacttaggtcttgctaggaggggaccctgacttggaacccacgcttcaaagagcctaactctggctctttccagtcccatgggccaaagagccaagacacctcacattctgggtcccaggttcccagagtcctgtcaaatgtcaccaagtccatttgagtctgtcctcctaagggcattctgcacctttgatgtgagcaacattaagccagagggacagccaaggggaggctgtttgaggaatcaggggatagacagagcttgactcccacaggtgtgcaggctggagctggggtgagaaggggagggccgggggccaggagccagctcttctctgctgccctgtatctgtgtgcaactccaagatgtcccaggactctgaattctcacacctggctgccaggtctttaggaaggcatattttttcattgtaggcaaacagaatatattttgtttaacagttagtgagcttgatttatacttttaaatatttagacatatgatatggggcctccatttgtactcttgctccaggccctgcaaatgttaggggtgggcttgcagaacgccaacatagtttgtttggctagcacaccgctttttttttttttcttttttaacatcttgaattagtttctaacactaacaattgggagattttgaataagaatagagatttctgatttctcttttttaaaattacagaaaatcatgggccttcctacttgtatggcgaaaaagagctggggctgagcaggatcagcctgccctgggtggggctgggccagtgtttcctgattggccacagttcccacctgtttcccttctctcatttcggtaacctctgatctctctggccactgagggcatttgagtttgtcacccttgatttacatccttctttagatatgtcctttctgtataaagccaccatgccatcacatttaacacattgtttttgcctcttttctacaacttccctcaaagaaagtttttttctccattagctaagtgtaaatccctacattttagtatggataaatgcctataattttgccatcttattccctaacttctgaatcttgggaaatcattaaaacaacagctaggaacttcaagagagcagttgctctccacagggatcccccctttctccatgccatgcgaactggaaacccagtgcaatggattttctcactttgaccccagtgagggagggagatttttgataactgacaaagagcttttgttcaggtttgcaacaggatggatcagccagccccacctcatggccccatgcttcttccaggttcatcttccccttctgccccagaaaagcccccagccacagcctccttgcctccaagtcgccagcactccgccccctcctccgcctgcctctcagtctggaaaacagctttgcacgttaacctccaggggcattcactgggtttccagaggggtccccagccccacaggctgccaaaataggctctttacactccatagatgggagagaaaaatctgcttgttcggttgcaactgtcaagcaaaggacatgctgagctcagatagaaatagcagcagggtcagggcagggcaaggccccagcatttcattagctcggcccagctaagggtgattgaatgcacacagtggcccatgaatggggccatggagggcagccacacagtgcagcacagaaaaatcattctttggccgctgtcagctggctcaatgggacttaattattgggataatgagaactgattttcattgttttaattttggggaaggggtgagaaaggagggacttttcttcctcatctgggtgaaaggatgctaaactgtggcctctaacggtcccgtatcctccaggctgctgttggctcctgtgtttgctgttctttatcagtgctgtaagagagtgttaggatggtcatctgtgtcagtgtctcctttagggcctataaacctggcaggatgtgtcctcagaagagcatttctgtgctggcatccacggtgagcagctgtaccaaagcaatagagggacagagagaagccactggacagagctgcccatgctcagccccttccaaatgcctccaggacatgagggaatcctaccctgctcctttttttttttttttttttttttttaaatacaggatctagagaattcaaatgatctgctcgaggcaaacataggatcgtctgagttccttgcaccctgttcaaggttcaagagcctaggactctactgcagaccacaccacaacactgttggatcatcagacctcttctagctacgaatccttgacaattgagataaggtccacttacatgaaccctgaaagtcattacatatgacttattcagccctcccttattcaatttgattcacttgccaccttcccaagatcttactcttcatgtggaaatgagagacttatttattgctcagcttgttccctcatttctctaggtaacatgtactactagtgggatcatcaaacaataagtatttgcaaaactgggcttagcgtggttctaggtgctgtgcaagtatataatgacaccccccaacccaaagaaagtcacctggggagacctgaaacaattagagaaacacacaaggggaccctaattgaatgtgaatctctctagccaaccaaaagaaagagagggtgggtttaagggtagtgagggacactttgtgaagaaatgacagcttgtgaggactccaaggttgagtagaatttcaacaaagagcaaagaatggaattggatggtgtgttcgagagaaggaaacagacattattggaataaagattccatgtagggaagaaggttgagttgaagagtagggccagatgatgtgaagtttggaaagagaggcagggcatgctttcttcacccacaactataatacatctttgaccataaaaagtggttgttattgctatcatttgtttttgttttcactttgccccttcaagttcttgaaaaagatagtcataaaagaagagggtatgccctcattcatggagcacagagaaggaagccctctgtgatgtttccagatgtgtaggtttaggctctagaccagtgctggtgccttcctgggactgcccaagccaatcaccagggagaggctgcagatcctttctctgctcagctccgttcgggctcctcttttcttgaagatttgacagatattggttaagttcttcaaatctgacaactgggttctttgtggcaaagaataggtggctaaggagaactggctctaacaggctaatagcctacctggcccctttccagcaggagaaatgccatagtccttcccagaagcacatcttatatgcacagtcctcacagagtgtgtctgtgcatcagaatcaattaatcatgcctgtcaggagggggaatggcccctctggctgaaacagtggaaggagccctcgtgattgaagaccactttgccttggaaactcatgcaggtcagaggggaaagttgagtctagatggcatgcggtattccttgggtatgttttctcatccctgaaatttgcccatgtcacccaactaactgcttgtagcaaagctgtattgtcagtgcaatcctttggggccttgtttgggcctgaagaagccattcatttcttaaagaagaaaaagctggcaaagtggaatttgtagtaacagctgttagtatttaaaacttttgtttcaagatcttcaggcacttaaaaatgactttaaatggccactctgcaagagtctatcttttacaaggcagcctgtgagatctttctcaaaacaagcctcatctcatctcctcttttattgagatccccattggtcctctattttgtatagaagtggttcccaaacttttttgatttaacaccccatcagtaaacaattttgaataggtactctcaatatacatatatttctttttatattatacacatgtattactttcctaatatattatgtacattataaaacatatacaaaagtaatttttttaaaggctgagataaagatgaagtaagcaatagtttaaaatgtcttgtcaattatgatggcttcatactgtcattagctaatatgtcaaaagcacaataaatatgtcaggggagttccatttatatcatttgaatgatataaatccttatatctagtagttttcatggaaatttctaactgttttggcttgacttcttgttacatgcaaatatttggtcattgtcttcactttgtaatatggccgaagaaaacttgttctaagggcagtgtcaatgctattattcttattatttgcttgtgcttatactactaatattatctttgatccattgtttccatgcaggaatattttaatccacttgtccattttgtgtgtgttagattaaatttgataatatccataatccaatgagtcaggaatgtgcaaattgtagtgattcatatgtcattgaaagccccaggggagtgaggactgaggacaccatttgccgcctctgcaatgtgcaggtcctaatcttgccacaagatatctcatgaacaattcatgacacataacaatggctgtgaggagcccgttgtcaatatttatatcaaatgttgtaagtccatgttttttatttcctagaaaaaaataagttcaaattctagtactttctgacttctaaattctaatggatcatcttgtgtatctctggggcatgcatcctatttcgagaccagatgtctacaggatggatttcaaacccattagccttgacttacagggtccttctctgtccaaactcagcccatctttccagcctcatctcccattgttccctgtcttataccaaggagacatcccattgctttttaaacatgaaatattctttaataactccattcttttgtgcttactcttccagccaactggaatgcctttctcccattctctaacccaagttaaatcttcgtaagatgtctgattcccttagagcagaggtcagcaacctttctgtaaaaggccagtcgtaaatatttcaagctttgcaagccatattgtctctgccaactactcaattttatcattgtagtgcaaaaacagccataggcaatatgtaaacaaataagcatggttgtgttctaaaaaaaatttctttacaaaaataggtagtgggctggatttggtccttgggctgtagtttgccaacccctgccttagagaacctgtcactcttctactactgccatcctagctttttctccatgattatctgtttacaagcacattttgccaaaatactaaattctttgaagtcaacacttttattcctattccctaaaagctagaaatctggaaatagaaatgattcaataaagacatattattgaatatcaagaattatcattatgttgctggtggaaaaaagtggagaaaaattcttcggttgggtacaagattaaatggcttacttctaagatttatctaaaataaaagattatataaaaatacaaattaatgagatggaaggatttgtcttgagttggaactaggtcttctaaaagggcagtcagtgtcctgctcatctgatcacccatgttcatattcctgccacattgttttggcccacagcttcgatgagacctagagaatcacttccttttcaaccatacagccaccgctggggccaaccactccctacgtttgtataatgctgtatggttttcaaagcaagtagcacaattcctatttggtagataaggcaattgaggcatattaaatgacttgccctatgaatgatataactgggacttctgattcctaatctaggactctttttgttacaccagacagcctctcaggaaattagaacaaaaaaatgacatattgcaaaattaagtcaaagaataaattaaccccatttgaaagtccaaggagaccttcagacaaatgtgtatcagaatttcaatggtatttggcagagttggcctaatggaagtgtggacaccctgccaactttgcataagatacataaatctcaaaatcaatttaactaactttcatttatcttggaaacacaaaaatttagactagaacttggcaggaataaagagatttacaccaagcctgcatccccactactcttgtaaactgtttcatgaaccccagtgttgaagacctcactgttttgtttgactctgaaggccgcctacgcatacttgctgctggaggaaggttaatactgactcagaagcaagaggaccactgactgaatcaccaccacttactacagtcctctgctctgtattccttggaaatctcttgcctcagcttgggcttaacccaacccacttagaaggagagaacaattttacagccccgcatggagtgactccaagccaatcgtatctgtttccaagtgatctgacgcagcaagcagattgtatttcctttggaggcttggctgagaattgttgggttggcaacactgaaccagagtgaataaaataagactgtcaagaaaaatctgaaatggcccctaaagagataggactaatgaaatgctcaggtcaggggtggggtgctttctgggcagactgaaaaaagaaaggaggaccaggtgaccatgtgtgaaattcaagagtcaacaatgatctaggtaagccaggcagattggcacatgcccagtacttttctgagagcaggcatcaagcctaaaaaaatgcacaaaatctacctcttatttttattcttacctttaatcagattttttattgaagttttttcatggttggttacctatccaccttcctcccatcctgccaaagaaggcagggactccaaatgcatttgccaaaaaccaacagacccctgtgttcaattattgtgggcttagggaatagtaattaaggagttccagggatgggatgtgggagcagcaaaggagttaggtttcacttaaggtccttgggaataaataaatattctgtcactaggatgaatggggttggttcttcacagatcatgtaaagggacaggcttagccctagaaccaactcatgatctagatgagtttctgttcagatggataagggcatatctttgagcaccaggttccatgggcacatatctggttcattattctttgctttgcttgtgcaaaattattttcaaaggcaaagacacggggacaaagttgggctctttgaggctgttccttgagcaaagaggtgtatgcctctggctgcccacttggcagtggatatcttcatgcttcttttttccacccaaatattatggccactggagtatttgtaggaaacagtctaaaaaaagacaacactcacttccccttgcttcaggctcttcacagtcaactccactggcatgtttcaggcacctgctgtgtgccaggcattttttttcagaatggaacaatattgcccttgtctttaatgccttaactgtctagcaggaaagacattattatgagtacctggggcagaaacagtgtgagaaacattttggagacccaaaggaaggggccattgtaaagaagttccaccagagtagaggtaagaacggggacagggcatgcctatagacacctatccatcattcgcttgtccacacattgatttccctaaatatttattatctgcttgttatctgccaagagtgaagggcttgggattcacagatgaataggacatggaatatagagtagggggttgggcagaagaagggagtggtgggagagggagttgaaaaatagattgggccgcattagtaagacttttgcttgccaatttgggtctgaactttgttctgtaggtaatgaggagcctctgaaggtctttctacaaggggtggcacagatacctgccccaccccattatttcctaccctgcaacttagaagtattttattcatgtatctgttttttagcttgcttcttgtttgatttccctaactgggatgtgagttccacgaggacagggaccctactgtatccaccactgtattcccagttctgggcacaaagtctggcacacagtgggtcaccagcaaatattttacttactgaataatcagatctgtgtttagacagttgtctccagttgataccatggagggacatccaaggttgggagatcctggaggaaggactggtagcagcagagaggtgctgagagcctaatccggggctatggtggcatagaagggaaggggagagatttagaggactcatcagagttaacatcatcagaccttggtgagggagagggagggtccagaggtttccatgtggatgtctgagtagctggtgatatcgttgactgagagagaggagacagggtaggaaccttcaggtgaagaggggcttgttatgggaagtaagggagcatagatagtgagatcagtcttggacatgtatgatttgagacaaccatagaatgttccactagagatgtccagtagacagttggaaatatacgtgggcaattctggaagatggctggagctgaggtcacaggcttttggtgataaacgaagccaacaaagagtaaagtcactcaaggagagcagacagagttgaaagaaaaaatagaagccccaaaactggaggaataccactggagggtgggaaagaggagctggggggaggagacaggtgtgctctgagaggcgggaggagaagagaagaggacttctggctactatgggatagcatgggccctacctaggacagggcagaggtcagtgggaatgggagctgttatcttgggcgaccaactccactcagttcttaccatgttaatgttaatggcaaactcttggcaattctgggcaagtgagaagagcagaaacacctctgtgcagtttatcaggactttctccttctagcacaccctgagggtgaggccagaattagtcatgtgctgaatggtctgcctatttcatgatgttctcagcttggaaacattttttttgtgcaactccaactcaagcaccagcaaatccagcctctcctcacctcctattacaaatggctgtcatggactagaccggtgcctaacaaacagcccacacttcgggatctgagttcaggttccggcacgattagtgcaggtggcttctggctctaaatctctcagaggagacatcttcttctgggggctgattcacacgtgagtgctgatcatgaccttgtgtcgggattaacctcctttctcagcatctcctgctacattccatctgtttctaaagacacctcattctgccttccttccggccatccactgttacctttcacttcctgtcggcacgtacaggccagggactttactcaagtcactgaacattttggggaaatgaaatgaaaacataaagagaaggccagtccacaaaacagctcaaaatggagatgctctggctgaaggaaggagtgttggggtccaggagccccgctcactcctcagcacccgggagcatcacggaatctaaggtgaacctccggggcaggagacacagcactggccttagagtccacaagcccgggttccttggccctgtctctttccctctctctgttgtctgtagctccctcctagctctgaaactccaagtacaagtgagcaggtcatgagtcaccaagcctcttttcctgggcgtttttccttccggggagagaacagccaggcttggacaaaaagtgttgggacaccctgaagcagaacacactccctgtcattcctggcctcactctcctccagaacgaaagcacccagacctgcaggccttttttaggaatgaagtcactggtctgtgtaggttgacagagtgtccttggaaaaggctgcttgggaaggaaactcacaaggcatgggtatccccactggaagaatccagagcaaaacccttctggaaatcccccaccccacatatacacaaggaaactccatggaaggcatcctgtcttggaggcctcagtgggttcctcctggagagtttaaggggagggaggcagaggaggaaggagagaaacctaaagtcagcaggatattctcatgttctctctctgttaattgcctcctctctttttctaagaaggctgagataccgaggcttcctcacccaccaccccttcctctacctccccttagtgctgggtgagttcatccatcaggacccctgcctgggactgtcctcactctcccgctgtggctcacttgcccccagggcccatcccagcccagcccagccctgcccagcccagcctgctgcatgcttctaccccggctcccactcaggctcgtgcgtcactgctattcatcttgtttagtgcttggcttggctgcagatgctgtaaatatggtaattttagactccctgattggaaaggattgcagagcgggttgtgggggaggacggcagtttgatttactccgcaggagctggttccgagatggctctccaccctctgtgcacgcctcttctccaagctgtgccccatcaggccctactcttagtgttgagtcctgacttcttggggtcttgggagaaatgagagggacagagtggatgtctgtgcgttctgggcctgaagaattgctggttagcacagagcatcacatgcaaggaggccggaagtgtagtcagtgatgcgcagggtgggcgtcctgacactgctaagacaatgcccaaggctgatgacccaggattatccccccacccagggcacactggggatgaagtgggggctgcccgaggcctctgaccccttctgagctctctcccttttctgttctcctttctttcctgacctccctccatggggggccatcagtccccagggccttctgccaggcactcacagggttgtcagcaaatccctcctcccacccctttgttgaataaagacctaatttgcatttgattacaggacccctgagtgggtaggggtgtattcagatccccagggagtgactgtgaggctggcatttcaggccctgggagtcagagtgggagctgagggttttgagccccaggagtaggtcaggttcttcaaaagccaccagatagtctcccagctgtctgtcttatctcctcaggacaaccctaactccaaggctggtgactgagtcagacttggaacatccccgtttttgagccacagtctatagtcacagaatgttccagggggagggatggggggagaaaaggagggcacaactcacatttctttgagccccaaacttcatttgaccagtgaggagtggcttgcaccaaatcattggtgcagctaaccacaagaatgttagctcttatctagtgcttcatccatgccctggacacattttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgccctggacacatttttatagaaagatccagatgaagggaaaaagaagtctgataggtatttctttttactaagtcatgtgggaagctacagcggaatcctgccactctctgctgactgatggtgagcttatgtttggtgacaggaaacttgccatctacaaggcagcctcttaaaacttcggtcagctctgaccgttgtctaataattcttcattgctgcaagttttccagctgtcccccacatctgttttagtggtggtggaggattgggggactcagaaggagggcgtagattgtcctgctacagaaaaagaactagcaggactcctctgagggagcaacatggagagactttctcacccctctgcaggcaggctctgccccctttcactcactggagtgctcacttcctgtgcacacgctgcgccgtgctccctcctggcccatgaggtgccagtcaccacacacttggatttgtttacttttcctcctggaaatgtggacatgagggcattatactcacttttcaaagcaaaggattctttcctggaggggttaatagtccttaggtgtaagtacccctccagtggttgtatagcagttgtctgttgggggaccttaagtgattattcatggaatctttcatgctaaagatgcattgcagcgaaacgtcattggtttggaccaaatccggttatggtctgaagaacctcaggtatgggacatccccagcaaagcagtcttattactctttatcctgcagagtcacagcttacagaatcttccctagaagaggtgtgcctggtgtacttttaaaaatagatgcgcctcttgtgtaaacagcattttgcctgttggaatgtaaatgaatgttgttggagtgcttggagacagtttgttcttttagtggattagcaatttcccctgcaaatgttgtttcatggtatttgctaagcacatccttccttcatatgcaatatggaattccctatcagccagcctagatgggcgaaaactctggaagttctgctgtacccagtccatcaataaccctagcagtgatctgtgttctagaaaggcaggggtgggggatgagtccaggttttctaaagacattgggaaataatagcaaattttccagagaaggagttgcttccaaaaatttaaaaaatagttaaagagaggcatttataaccatgaagagtagtcaacagagaaaacaaacatgccagtgaatgaacatcctagcagagggtggagagagcaagccagaatagtgtggagggggtacaaaagtttcaaattatcttccctatataaaattcccatgatcccccaggcagtcagttttaactgcttaccccagcactcccaaattccattcttccggaggcctggcaaagcacctcctcagcactcactacccagtcccaggcctcaggcgtgctctccccacacggctgctgtccccatcttcacttccacatcatccttggatcctagatcactgtccctacagctcacttccttgtttccactccctgtccacacattaaatatccatgctctggcctggcagtcagcagtcccatgacctggctccagggccccttcagccccaagtcgcgtccctcgcaggtttgatgcccaagcagcagatttctccccaacagaggcctcagagagtgcctggctgtgataagcatgtgttgctgtgattttgtcatctgtctccttgcttttgcttaggctgttcccctgccttcctctctgcctggcaggattccccccttcccaagaagtgcctgcttctgatctccagtaagtatctgacgtcagtcatattcttaaatctgaccagctcacagtatttacatccaggatttctctctttttctagaatgaaaacacctccaggtcaagggctttctctcacacttatttacacctcagcacctagcacagagtgctgtacacagtagatgcttattttagactgtgatatccttaataataataataatagctctgcattattaatcattttccatgtgcaggcactggggtctctccccagatgcatcttcagcacaaaccaaagagtgttaccatcagttacattttatggaacttgccaagagcgtaggtaataaatgacagagctgcgatttgaacccttatttgtcccctctaggacttgcatttgaagtcataagggtgctgttctattactctcatgaagacagggaccacgtctttacctaaggcagtgttgcaagtggagactaaagaccaaatctgccccatagatatgttttgtttggcccattctgtgcgtgtttgtttgtttctttaatcaggaaattttacatccacatctagatttctggctttgctgggaagcccaggagatacagtaaccctggatttaagcgtagtgatgctggccagtgctcgaaaccgctgtccccacttcactacagcctctgcttgcctggcctgagggtaggggagcattagagtttgcgtcttccgcactgtactgtctggttccatgtttcacctcccaggcattgggattggggtgggtccgttcttggttatataggactgccccatatattgcagggtgtgtagcaacactggccctcacccgctaaatcaacagcacctttccttcagtcatgttgacaatcaaaaactcccccaaacatttgcaaagcccctagtgagggatgctgccccattcccttttgagacacaatggcagataaccccttgtctcaccagtggtggcacacagtagggcctccattaaatagatttaaaagacctaaaatgcaacatccattaccaaatagttcccatgttaaaagttcccatgaaaggagaagcagaaaaatgcaataatcatagtatttttttaaaaataaattatctggagcaaatttagtgcattcccttaaacacctgtcccatgatggaaaaaaaaagttagtaataacacgtttctgtggaggcatttccattctccacgcctcagttcccactgtaatgttaattggttatggttttctttgcttctagtccttacatgtgcagctgtcaaccaggcaccaccccaggaaatgctgcacttaaagggataagtaagaggaactgaatcacatgcagcttttctaaggagaaatgatattgttaatatttttgcttgttgttctaattataaaaatactatgtgcttatagtagaaatttcagagtaaagtactaagaataagtaaaaatccctcatactctcatcatcagaagataatcactgtttctatttttgtatatttccttccagtctttcttcctctatcgcacatatttgtgtttgttgttgctgatttcattttgcttctaagaaaattgggattgtactattgataaagccctccttgccactgcatggctgtaccatgatcagtttaaccagtccccttttgttgaacatatggtagcttcccagtttatgctgtgatcaacaggacagcaatcaccttctttatccataaatcttttgggatcacttggattatttctatagaaagagtaatatggtaagcagtgtagaaagaaaccatcctctccacaagagagatgttattggctctggccctagaagagatgggcagagccaagggtagactgagttctggttaaggaatttccaggcaggaagaagttcatatttttgagctggcttctctagtgcagctgaagacgagccatctactgcgagcaaagagaggcgaggtggggctggggacttggggagggtggagttggtttggagctcccagtgcaggaagcaaacaagggcttaaccaaaggatgaaaattgtttggcagcattgagcacctaggtcacactgtgtgatttaggaatagaggccattagcacagatgtgcagctctctccagtgaggcagagacaaaagcagaggtggggtggaggtgggtggggggagggtggggatagtaggatcatctcaggtttgggaaatggcctgacagatccagccaaaggtcagaggggctggtgagagcctcatgaaatcttttcccacccaaaataataagattgctataacacataagtaaaaatcgtctctgcaacctagcaaacagagctaagaaatgagctttgtctactaaaatggctttacagacccaacatgagctggacatagaccctgagttacttttagggtataataataacaacaatgaaaactttctacagcagatcacagttacagagtgctttatacaatacataagtccaatctcatagggtattactaagtgggtcccccattttcaaaggagaaaactgaggcttagaaagggtgatgatatgtgtaagtgtaaataggtagttgactgtagagtcaggctccagaccagctccaaggacagatttgtgataattaatctattaatgtgaccatctcttctgtccttgcaagatgacttttgttggaaaacaaaagtctcaaaacaaaagtcacacctgtgaccttgacctcctaagcaagacaattaaccaaacgagctaacaggaaaagccagttcttcctgggtgtaaagagtggtctcagtgtcctacctaccaggctggtctccttgctgttctctgaacagacctcacacagtcctcctgccggaggtttcccttggtgagtggtttctacacctggactcctctcccccacatgccgacacagctgattctctaacctcttcaagtctttgcttcaatgtcaccttcccagtggtgccttccctggctcctctaccttaatggcaacccccgccccactgcaaactccctccaccagcacttcttgtcttcctttcctgctctttattttcttccatagcatttatcaccttctaatatactagtatttcattcattttcttgtttctttttgttttctctaccataatgtcagtgtgacagtgcagaatttttgtctgttttgttccctgctgtttccccatgcctagaagatgtccagaatatggtaggtacttaaaaagtaattgttgaatgaatagcagccgaggtattaggaaaaattaaaaagttttttttttttttttgagactctcactctgttgcccaggctggagtgcagtggcataatctcagctcactgcaacctccacctccagggttcaagtgagtctcctgcctcagctccctgagtagctagaactataggcacctgccaccacacccgactatttttatatttttagtagagacaaagtttcactatgttggccaggctagtctccaactcctgacctcgtgatccgcccgcctcagcctcccaaagtgctgggattacaggcatgagctaccgtgcccggccaaaaaaatattcttaagaagaacactagcacagtgactcactcataataggacatccgtatgtgctggttccttctctcttaccccttgttctgtgttaaatgttatgtgctcagcacatccatctttggaattaaagtatttctgggaaagataacacattaagccttaacatccagtccatgaagctgatatcacaggggaagaaacccacactggctcttaaggaagtgggtgagtcgtacatgaaacgcgccagagtgtccctgtctgtctaacggggtgggacacatgatcttggagggtatttccagtgctgcctatgattccacccagctatgaatcagggtgggcagaaactggaaacaggcatgtgggacccaggtggatcacagtctcccctcttccacctgctggcattcctgcctttggggacagcagggcgggtgaatcctgggctgtttgctcactgacagccatggggttgcaaaggatcccttctcttcagccggggcactgctgagttacttactcacccatcccaacattcatttattcagtagaaacatattagatgtccccagtgtgctcagtgctgagctgaataaaacagacaagaccctgattgacagctgggtgaaatcatagacagcactggaaataccctccgcatcccacccctcaccattagacacacagggagaccctggcttgtcctgtgtacaactcactcacttccttgagagccagtatgggttttttccctgtgatacctgcttcatggactggatgttaaggctcaatatgtgctatcttttctgaaaagaattctaaaggtggatgtgctgagcacaaaacatttgacatagaagggaagagaagaagggaatcggcacagtgagttcctattatgagccaagtcactgtactagtgttcttcttaagaatactttttatttcttctaatacctcagctgctattcactcaatggttacttttttaagtacctactatattctggacatcttctaggcatggggaaacagcagggaacaacacatggccccacagtcaggcaacggggacagacctcaaacgtgaaaacccacccagaccagagccatccttgggcaccctgatgcctgttggactttcctatcctactttgggactcttccttcccagggccttgctcaggcccctacctggaaccaacagcctccagctgctctccttgtctgaagcgtcctcagcatgcccttcctccctgcagatcgctcccagatggctcctaaagccatcaggtggagttcagcccaggctacccagaggacaagtgaggggacccctgggggatggggagagagcggcctgagaagaggaggtggctagaaagaggaagggaggaagaacaagactgaggagtcttttaagagcgtgaaacctgaggagcaaatgtcccagaaggtttgaggaaaggttcactgggaaatgcactgcaggaaacccctgcatggcctctcaggaaaccctaccatggagatcacattaggcctgaaaatatttgcagttacatatgtttctttgaatgcaagaccaagtggaggccatcttccagggagggctggtcacaccaactgcaagcacaattttaatctgtcatccacaaagcatcctagaggatggcgcctgcatacccttcctgccttgtttcctaccaccccaccccaccttctccacacaccctgagtttctcagtgttccctgaataagcttcctcacacctcattccatggcatcctcaggagtccccggcattggggcactgccatttctccttcctgtgttccccagccctacctagccttcaagcctcagctcagagccttcacctcttccaagaagctttggctggccacctggaagcatcttcggctcctttctacactttcaggagaacactttttataaactcccttgtatggggtcattattttatgtacatgggttagctgttgcaccaactacagatgaatctccactcataataagtttaagttccaataaacccatcgaaagttgaaaatattgtgagttgaaaatgcatttaattcacccaacttaccaaacctctgtagcttagcctcgcctaccgtacacatgctcagagcacttacattaacctacaatgggcaaaatcatctaacacaaagcctactttataataaagtagggaatatctcatgtttattgaatactgtacattgtgttaaaattggaagtttcacaccatcataaagtcaaggaatcatttagttgaatcattataagtctaggactgtctgtagatgtaaatttgttaagaattaggactcaagagtagaattcctttaatccacatagacttacaatggtgctgtgcacatggagcccctaaatcattgctgactgagtagatttcccagggtaagcccaagaagttactcctagaaggggctggtaggggaaagagccaacatcccacatgcctgcccactttgggtctggtcccaagaaacaaactccagtggcctcgaaaatttaatattgctgtcagaagggcctccccttcaaaggaacaggtcctgatagctcttgttatatgcaaagtggaaaggtaacgtgactgttctctgcatttcctgcctttcaattgagtgaagacagacagatgatttattgggcatttcctagcctccccttcaccataggaaaccagactgaaaaaaaggtgcaaattttaaaaagatgtgtgagtatcttgagggggctgggggagaattcctgtgtaccactaaagcaaaaaaagaaaactctctaacagcaggacctctgatctggaggcatattgaccataaatttacgccaccccatgagagctcaaaggctgtgctgttctcgtcctctctcagtccccatttccaggtgatcaagcttgggcttagggtagtggcagtgtggctttagctgtcagccatcaccatggaagagcaggaggtttaggggccttcataacctttcaagtgttggtttccgttggaagtagttgaatatctccaccccacccatgcccctgagagaaagccgggaagaggggccaccatcgggggctcagcacctgcaagcccaatgctgacatgaaggcttcgcttcattccattcggccacgagagctatactcgcttcctagggctcccctagccacgcgggtactttactgagtgtctgaaaacaacagaaattgattgcatcgttgttctggaggctagaggtgtgatatcaaggtttcggcagggccatgttcctcctaaaggctgtggggaagggtccttccttgcctcttctcagcttctggtggtggccggcactcctccacattccttggcttgtagctgccccactcccgtcactgctgtcatcttcacgtggcccttccctatgcatctgtgtcttcacatggtggtctccttgtggatgacagtgtctgtctctgttcctctcccctcttcttataaggacaccagccgtattggattgagggcccaccctactccagaataatctcatctccacctacatcataattacatctgcaaatatatttttatttcaaaaataaggtcatattcacaggtaccagggttaggacttcagtgtatcttttgagggtgacacaattcagtccaccatgggagacacatgctttttgtccatggccttatagggaatccttgggtgactccgtatctgtgtgtaagtatatgcctgtgatttgtattcatatagtgtcatatacacacaaatacctatatatttacatgtatatatatataaatatgtatatgacatttactaatacatatctctaataggtatttgtaatatatataaaaatacctgtgatttgtattgatatagtgttatatatatgtgtgcatatatatatatacacacaaaaaaacctgtccatatatatgtgtctatagagacaaatacctataaaatagtaggtaattacctatctatacttataatagatatttttaataaatatacaaatatctgtacaaacacctgtaatttgtactcatgtagtgtcatacatgtaatataaatacatctaaatataatctgtcatacatatgacacgatatgaatttgtaagtcattaacctgtgattaatacacatcccaggggcattttttttttttttgagatggagtcttgctctgtcacctaggctggagtgcagtggcgtgatcttggctcactgcaacctctgcctcccaggttcaagtgaccctcctgcctcagcctcccaagcagctggaattacaggtgccctccaccacacccggctaatttttgcctttttggtagagaagagtgtcaccatgttggccaggctggtctcgaactcctgacctcatgtgatccacctgcctcagcctcccaaaatactgggttacatgcgtgggtcactgcgcccccaggagcaattctgagtaatgccctgatttcattaatcaaaggaagactgcagaggtgtttgtagtcctttttctgcaattttcccactaaagcaatggcaggaaaggtctgtcgtcttgaccacagacacacacgcttgccaggactgcaccccgaggaggactccagcatgtggaatgggcagaaggcagaagccctatgtctgccctggggtccccagtgctgaaggcagcagctctgctggctgcgcggctcttccctaccttgttttggatgagaagacccagacccagagtcctgaagtggcttgtccaagtccacatggacacaaacagttctagaagtcacactgccacatacccagcagagctacttctcttctctgcctcctccttgccccattttcccaactaataatcagatttttcctcggagtgacttctgacgagcatactcagatgttacaggtagtcacaaaaatagcacccttttcccatcaaatgggctgagaaacgatttttcacggaggtcttgccacattcaaaggttaaagtactttgtgttctgttgttttggagctgttggagaggcggaaaaaaaattctttttcaatttcataaaggatttttgttttcattttctcagactccagactgactcaccaaaaggttcatctcatattcggcatacagtggcccacctgggaggtcttttattaatgagtctggggacttgggggctgctgctcccctaaatctacttgaaagtgaccttcagagctgggcgcggtggctcacgcctgtaatcccagcactttgggaggctgaggtgggcggatcacctgaggtcaggagttcgagactagcctggccaacatggtgaaaccccatctctactaaaaatacaaaaattagccgggcatggtggtgagcgcctgtaatcccagctactcgggagagtgaggcaggagaatcagttgaacccgggaggcggaggttgcagtgagccgagattgcgccactgcactccaggctgggtgacaaaagtgagactccatctcaaaaacaaaaagtgaccttcagaagcactgacctggcctccccccgccccacacacacttctgccccaggatgtccccctctctccatctccaccctgctctctccacactacaaggctacttgacttcgcttctggaagccctagggcctgattctctctccctcatgctcactgggatcatccggcagggaacagaagggatactgcttccgggcagaaaatgggccagattcaggaacgcctgaaatggggctctggaagccttttgcttggaactttcttggagcatgtttttgccagggccatcacccatctaggagttccaaatggtttggcagaaatattgccctgcctcctacaccttcctctgccactcctgacttcctttcaccccagcctccccagctgagaactcccatgctggctcccaaatacacaacaagctcttcgcatggtgcccgcttccacaacgtctggtgatcaacgtatcctaattcattggaaagcctaaattgtggacctcaaatttaaggatcatttagggggcttattaaaaatatcggtttctaaccccaccactcaaagtcttattgaggtctgtggcagagcctgggaatctgcattcttagcgcaccccaggggattctgaggttgggcatctagagggcccccttggagaaatacagcttaattctacagcaggcatgctcacctggggcctctgctctgcagagcaccgctggggacacttaggcgaggtgactaggaagaagaaaagaatagcagtgtgaggattcaggctgaggtataaatataaaccaggtaggtcaaggcctgggcctgggaggagggcagaggaaggcaagttccccgtgtggcttctcagggaccagcagcgtgagggttccacgtggcaacgctgctggagagatgtttacatctgggcactggcagagccttctggacaggccatcaagccagagggagcaggccctcgagctaaatggcatcattctgagacgggagctccttcagctttgtcctcaaaggcactgcagcttggtgaatgaacataccggctttagagtcacactggtggcccgacttgtctggtctctgtagtttcctctgctggaaaaggaggacaacagtcttccatgcagagggcgagtgggaggatgaaatgaggtcatgtgtgcaaagttctcagcatggtccttgtggcagcaatgtacacgagctattgtctttgtcctcagagctgctcctgtctgcctcacagcacgtctctgaagctgtctttgcagaattagaccacatgaataatttggagagtccataactgtcctagaaagcttttggtttgtcctttttctccctgtgaaagccctcgtcaccctggaaatgccagttctgaagaggcaacgcttacaacgcatcaaattttctctccaagtgaccctgcctcaccagacatttgcagcccttccagtgatactgaaagaaccactcaacaggtgggggccagatctttgcaacggaaaatgccacttttgaacgccaaacctctgcctgacgaaggctgtgtgatctacagggtgagacagggagtttaaggtgggaaccaaaggctcttgagcaaatgcagaaaggaaatggacttatgcagaggcccatacagcccccagtcaaccctgcctttgccatgtcagctgtgggggattttgtgctggtctcagcctctgagcgctctctgcctcagtttccctctgcagggtggagccagcacccacagccatgttttggcacgtggcaaactaactccttttgtgtactgtgcagtcttaggagtaatgaggcagcaatattattgttagttctctgttctaatgatcagctgtgaggacctaagcaaatgagagttgctatagtgttatgaagaaaagaccctgacttgttagagtggccatttgtttccccacagctattcatccccctggtgccctcatcaccagggcatatctaaaagatgccatgctagatacccatccagggtatggtacagacatcacaaggtaagtattccaaggccagagaagtgaaaatgttcacagcagctctggaagagaggaactcagaaacctctgggcaccttctggatggagcccattgcctccacatccaaacatggaccatgtattgctacaaaggaagcaatagtgtgctccacggaaggcccgggctgctgccggtccctccagagttcacggctgggcatgatgagaccaacctctctcaccctggccgcttctctagccagtgggagggcagaggctggcagaaaagcctccgtctgccttgttgactctgccgggttcagagagggcttcacatttgacttggcgaaggagagaagttctttatttccctcagcctcaggtctgccaagcccaaggctgaggtgagcagttttctcctccgtctctcattgccacatcattacctgcagagttcaatgaaaagccccatccagaatgggccaagccgagcctgcaatgggcttgttctctcctcggggcgtgctccttcttcccctccagctcagcctgccaggccttcccagtgatactgcgagctgggtttttctttcttcccgccccccaagtccagagcccagttatttacccaaagaaaacagggaagtgacaaggtaacagagtacacatgttgtgaaaatatgcaggctggggctgaagaaaagaaaacattcttccataagtagctgccttgttaattcatttttttctccagattagaaccagccatttcttgtgtgccttcaagcaccttctgtggtttcctgacagctgcctgcaaggggtgagatttggcttgaaaaatgggccatcggtcatgcttcgggggaagggcagaaaccaaaattcccagattgctcaaattcactgctccttttctaaatgggaacgaaagagggagaggtggtggggagaggactgtataaactctgaggcgtaacctgattttccgtaagaaacgacagctcggtaatgagcagtccttggaacgtgcttttttacctcctcttgaagttggtttccgatccctggcaagcctgtgctctgcagccttgagtaacggccacaggccgattctcggcaattaaaaataatattggccctgatagagaactcttgggtgctcccccacacatacacacccttttcattatgtgccaaagatcactttcccaaacctgtttcggaacagctggccgcactagagggcctgcatgggctgggggaggctggggttattaatagcatttgctctgcccggtgtttggggcaggaaaggggtgatttgcgtctttttggaaggctaggccctcatcagtttgggcctgatttttctgcgctggatcctttaaacctcagggcctaccaagaatggttgagaaagcctgaagagaggctctctgcggccaatatcccttcggtacaaatcttcgtgcttctcattatttccctcgtcaacagtctccgtctcctttgcagcctgtgggtattggcctgcagcttggctggtctccttttgggagaggtcatgccgcacaggcctagccggcccctgttagcattgctgtggtgctttctgttaacgagaggccactgaagctgggcgatgcctcccagcaggggacgggcttgtgagaaggagctgcttgttgttgcccttccccagagaggaagccgagtgcaggcctgagcgggcagctggggttggagaagcttcacgatcccttacttatggccacagagttcatcagcttcccacgaccagcacccatagccttaaccccggggtgggtggaaactctgctatctcctcacagggctccccaccaccacaagggcaccttcccaagagcccaggagagggctggctttcaggcctggtgtggtgttgataatcaggtcgggttgagctgaaatggaaaaccttgagagtgaggtggatggtgggctccaggctggcatctcccactgaaagagccgggtcgcagagacacactcaacaagtgccagtggcctggctggctgaggggacctcagagcaccagtgtttgggaccggggctgggaaggccctgccatccaccctagtgacatccgtcatgtggccaccaggttcccactgggtgaacacagcctctcccctcactgagccagattccagcctccggccataggtgaaagacaatttccgattattgttttcaaacattctacatccagcgcataaaaacacaatagtgacaggaaaaatacacacacacacatacacacacacacaccccacatgcacacaacacaaaggtttaagcgctcactataagaaggtcaggggacccttttctcattccagtccttgatgtggatccaagggaagcagtgcctttgaagtcagcagcaaccgcagcaggctcagctgtgagggtgtggacagggaggcagacaggatgtgctgccttatcagggcccaatctaaggccctcctgtaaggaccaagcttcctccagcaaaaggtgacttagaggtgtttgttcaataatgcgaggagactcattacaaccctggggcacttgggatctggctctctcagagccaagcctttctgtttggagttttgcacagccctttaagaggagacttcagagtgagactctgtctcaaaaaaaaaagaagttctttcttacattgaggtggaatctgccactccatgactttgattcattgacccagttttgcaataattctcaagagctgggaagaagtatagccagatttcaataccagggagagcaggcagagaaagagagctaatctcctttaccccatccttgctgctgtctctgtctcatggttgattattaatatattgattacattttgaacagactgacacttgctttcaccctaatgtattttcatgaaatacttaacatcttcatgtcaatattatcttataaaacactgctgaaaaggtgcatgttggagaatggtgtctcactccatccagttctcccagtgcaactggggagggtatctggatcttttccctggaggtgtctggccactctcatccccgccgggctccaatgtggccacaagccactcttgctgaaggaagtgtgtctgcttttataccttgggtatgttggggtagaaagctttaggaccattcttctagaataaggtaaacttgctccctcttcttggtgccaagccacctcacttcgctgggccttgtcactcttcaccctctctcctgatttctccaggttaagcagctccaggactcatctttctctgtacctgctgagaaactaactttacatagctttttactagaatgtttgctctgtgaggtcggggagtgtgtctgttttctttactgctctgtcctcagagtctacaagtatttgctgaatgactgctgactggtttcccaggtgtagctgacaaaaccctatcttcagctcttacactctgtgaggaaactctggagaattaataagaaggtgaacctggtctatttcccatagaattgtctgattcatcccctttgttagtaattagaagaacaacgtcaaggccaaatttcaaacagcaagtcagcagcaaatccaggcaaacccctcaaacttgagcactgcttgtcttgtatgccctgttatgccagcttcattcaaatggtgaccttgatccaactgaggaagctcatactcaggaagcactataggatctcattaccactgccagattgaccactgtcttctacagctctgttcatggacagtccagggctcacagcatacacctaccaagctgggagaaacccccccggtgcctcagtgactgggggcatgcttggattgcttttctctctgaagtctcatcaaatcccactttcatgatgtcacttctcagccctagaagctacaagacttccttgtgttctccaacaccaaatcccaatttctctgcttggctttcaagattcttcattatctggccccaacttgcctatcaaaccttctttcttattactcttcaatgcattctctcttctaccagcaatggccaggccatgggtttattgctttccctgtgtattttgcttacttctttttcaatatgcttgttttgttaatatcccaaataggctcataccttcttttttaaaaattcaactttactggccggcacggtggctcacgcctataatcccagcactttggaaggccgaggcgggtggatcacgaggtcaggagttccagaccagcctggctgagatgatgaaaccctgtctctactaaaaatacaaaaaattagctgggcgcagtggcaggcgcctgtaatcctagctactcgggaggctgaggcaggagaatcgcttgaacttggacagcagaggttgcagtgagccaagatcgcggccactgcactccagcctgggtgacagagtaagactctgtctcagaaagaaaaaaaaaaattcaactttattttttagagtggttttaggttcatagcaaaatacagcagaaagcacagagagttctcatatacccctgtcccccaacatgtacagccttttcctctctcaacatcccacaccagagtggtacatttgttacaactgatgaacctacactgacatcattgtcatccaaagtccatggtttacattagggttcacacttggtattgtatattctatgggtttgttaccacatgtttatatggtaacaccatgtatccaccactacagtatcatacagagtagtttttcactgccctaaaaatcctctgtgctctgtgtatacctactttttatcatctgttttctaccccagtcatcacggacaatgcaagttctaccttcctcacgaagtctttcccagtgactgtaatctgcatagatctccctcttcccaggatccttgctgtacccacaagaagaacacccttggctgtgccattattgtctcctcctttcatattagccccatctctgtaagtagattttaagctcctggtacttggattctaccatagtgcctggcctgtggcaggagttccatatgcagggctgacatattgcatagttccaggggtcccgttcacatgatatgaatggggcccctggagttacacaagttatagccctgtccataagtccttggtgattgaataaaactcattccaggacctgaaaaagaaacaattattgtgatcatggttcagttcaaatcttcaggtgattattgaacagctactatgtactaaccaccaatgatacaaaaaatgaataaaatggctgttcctaccctctgagaaactatagtcttgcgacacagaaaggtaagcaaacagatcaccataatacaatgtgaaaagtgctaagatagaaacatgggtaaaggagatggcacttgatgtgtagcctgaaggattcataggaatttgccaggtaggtgagtgggtggagaatattccagcaaaaagggacatcattggcaaagtgaaaatacatggtacatttcagagagctgcaagtggtacagcttattttctgatgataaaaccagaagcccagtggttaaattgcctgtggtccccaagcaaacctgtaccagaccattggcatgataggattgtgtgtatcacctgcacttactgcttctggaatcaaaaagaaagaatagagccctatctttcctggccatcccttgctcttccaagggctgggtggagttaagacacagaacttccttgtatttttttcatatacactaccctgtgttgctctgtgcacaatagggtgtaccattcaagcagtggaattggatccctctagaaccctcactgggcaacctcaggaacgggcagccattttcaacaagctttccttcaaagcttgcactgtttttggcctacctcataagttcttcttcttcctcgtcctccctttcttcttcctctgccctctctttgccttctttctcatcttttttgatattttggatgcaagaagtctggttaattgataaaacccagtgtgggcaaaaatagagttgtttcttccccctgcatggcttcctctccccaacccagttgctaagtggtcattggccaccatattggaatttagatgtggctgggcttccacaatgcatggtccaatctcagagtgtgttgaagggctttggggtctggttggataaaacagctgaggcccaatgttgtggttcttggcacctctcatttcccctttctgtatttcccttcggcatcatcagcaggattttgtttaaggcttctggagcttgtctttgtttcacccgggaaagtccctgcagggagagctaagatctccccggaggaatgggccagagccctgacctctgtcacccaaattgtttaggagaagcagcccccataggggttaggagggtgatcaattggcaacttaaggagtaaaggcctctctctccctcttctccctctgcttattgtgctcagaagggcaacagggtcagcagcagcaaactgaggggccaactcaccacgccttgaaagaggctcgttttgtgtttcagtaatgagcgctctttctccccttggatgcactcaaatttcacaagttacagggaacctgtcaactgctgttttcattgtatggggctcacagggaacttggatatagggcaagcttgtttcaaagaaagcaggggaaagaaaagtcctgaatagctgcaatgtgctgtcatatgcagatcacagccccagttgctatgggacacctctgcccgcagagagggcaagatgccgaacgtcccttattgatgtgattgcctccttggagatgggaatgcccctctaaaagggccaggctaggagccgacagcaccacgggctctcgggtttgccatggaaccgggcctgaagcagcctgcatcccagcagcctctgccttcccactggctgttcagtagggagccccccaacccaggggctgagggaacaggccaagctaaccctggaaaagtgaggagaggcaggtgggaagggtccctttttgcggggcacaagcctttgctcatagaagggctactggagggcatggttgtgaaccaggcctgatgttaaagacaggtttcaccttctttgtttgtcttgccctctgagaacacttggcaataacattcctttcctgacaggctcattttgtagctgacggacattgttttctttcccctgtttacctaatgtggcccagagtaacagaacaggctgtgccagcgagagaggagagtgagcctccccagtggctcctgggtccccatacccaggtccctctgccctgagctccttgtcttgcatctgtttgccccacctgtgggaacagggactacccagagggctgtcctgcctggaatcaagcactggcaggacctgggtcaggggagcctgcgattaggagagggcccagaattatgactctctccccggggtcatttgactgcaaggttagaaggcctgagatcaaacaaggctatgagaaaccagccttgtcactttgcataggatagaccagtgggagccaagattggaggcatctgaaggtcactgtaggaccttaaaaataccaggggagggtactgtgagaaacagattcccatcaactgtttactaaacactctatgctatttaaagggacaaaggcatggccaggtcctatcatcagggagtctaaatctggggtctgcagctgagccaggaggggggtccagtgcccttggcagcctgctgtaaccttctgaccctctgtgtccagcccccatccccatttttacctccagccaagcttccccctatgggggttaacagggtaaatactgtccaggcccttccctcaaagaagctgcaaatctagtaagagaataatatgtgcgtatatgaaactataatttaagacactgtgatcaataacctaaagggaaaggctctgaggacatccaggggtcttgggctcaaaggctggagcgccacacacacacacacacacacacatgcacacacacacacatgcacacacacacacatcaaatcacatattagctcgtgtcttcatgagctttccagtttgcaaaccgctcacacatacagcatttcctttaaacttcacatcagccagtgaaggggctttgtaagcctgacatgtaagatctaacaaccctcccagaatgatagaattggcagaggggggaggcagagactgtcaagcaatggcaagttttctgattggctggaacacagggcaggtgaccccgtgagctaaggtgaaacaaccaggctgaaggccttgcatgctgcagtgctgggtacaaccatgtcagttcaaaccagattcaatttggttggttaatgtgcccatttcccattgctgccatacaaacttagtagcttcaacagtacaaatcaattacctgtataatcctggaggtcagaagtccaaaatggatctcactgagctaaaatcagtgtcgtcagggcagtgttcccttctggaggctgcagaaaagaaagtgttgtcttgttttttccagcttctagaggccgcccacattccttgactcatggccccctttctctgtcttcagagccagcaacatcacagctctccgaccaatcattcttccattgccacttctccctctgacttggattcctcttctgcctccctcttcttcttttaggacccttgtgattacgttgggccaggacaatgtgcctgttttaaggttagctaactaacagccttaattccctttttcctgtcagggaacatgtttataggcttcaggaaataggccgtggacacctttgaggggccgttattctccctaccacatatagttagttggttgattgttagttgttcagttattggttgtttggtgttggatggctgttttttgtttgtttgtttgtttgttttttgagaatctccttggctcaggtcctcacctgagagccagataatcacgtttgttaaaagaagagaaaaaatgagagtgagcagccgctaaggggaagaaggagctacaagaggcggcacagaaagtggacatcgattttatttcgttgtccatcattatcaatctataaagcacaatccccaaaactacagcacatgccattctggggaaatttgttagctcacggacccccacagaccccagtgtgtggctgtttcatacgtcatgcaaacaggcccttggactctgtctcatgtcctctggcttagaagcagggatgtttgtaatctacaaacaaaaggtcgtctggccaaccttttgagatgtaatctcgaatccagatatactagtgggttccgctaagtgtctattggtcccctagtgtctctcaaacccacggtgggcttcagtctctcccaggcatcagccctaaccctgtggcatgggccctgcccagctgcctcccagacgtcacaccttgcaggctggactgtgtcagcagctgccttgctttccttgctggaaacctaaacctgctttttaaggagcccctcaaaactcttgaaataagatgtgggcattgctcacttgccctgagctgccccttgcagctggggggctgcttggtttgctctcttggcaaagccccttgtttttactctgctggggcccaactccttccttctctgtttccttgcctggggcttctgattccagtaagccaccccaataactcctgcggtgcccccacggctcacctgccaaagccactcccacctgatcccagactatccactcatccctggcctgtgacttgtcccgacctcccagtgggtcctggcttctatcactgaccttctaggtggtgacttcaatcttgatatgctcttcccctgctgaccttgacttcccatctccaaattgccagtgtcatatcaatagcatcacagcataatggctaatgcttctgagctcttactacacctcaggtactgtacatgttttcgctcatttaatcctcatcacaaccctagacagaaccctatgaagaatgggtagtagcccatcttacgcgtgaggagacaaaagcacagagagatgaaacagcctaccaagggtgccacaggtcatatgtgatggagtcggggaatcaaacccaggccagggagtgtcatcatccctcacatctggatttctgctacagtcacctcatactactctatcttatttccagtcaactcccagcagccagggtgaactgtatgtacaatggatcatgtcctccactgctcagagccttccagcagttctcacctcactcacagccttccagcagctctcacctcactcataaaagccagaggctcatgtggcccacaggcccacgtggtcgagccctgctccttctctaccccacctcctgctgtgccccctcgcactctcctccactcggctgcactggactccttactgtttctcagagaaaccaagcacatccctgcctcggtgtccctgtacttgctattccttccacctggattgctccctgcctcctcactgcccatacttggcccattcctttcttaaggagagctttgctgatgttctgcatttaagaaacttaagacctacctttgccgacatccctacccaaagtcttcctatcccccttacctggctttatttttctccatatatttgtcaccaaataacacatgagagctacctgtgttgtttattatctgtctctcccacggggaataaagcttcaggagggcagcacccttgaccactgctacgtatccagcactgtgtagggcgcctagcaggtctttgttaaatgagtggatgaagtctcaggactcccctcaggagcctaaggttctgggaggctccagaccaccatccaacctatatctgttcctgggccaccaagggggcaggccttccattcagcccgcagatgaagactttagcttcactttggtgctcagttccctctacagagcccggcaaacaagagcatgcagcacatgagtatgggctgagcttgagcttttgttctcattgactgctgtgtgtgtgggggtgtgggtgtgggtgtcagtgtgtgtatgtgtgtgtgtgtgtgtgtgtgtgtgctcactcacatgttgaaggaactccattgctctcctctccacccccacccctactccagcaagctgagggtgagaaatagctactttttgtttgtttgtttgtttgtttttgttttgtttgagacagggtctcgctctgtcacccaggctggagtgcagtggcacaaccttggctcgctgcagcttcaaactcccagcctcaagcaatactgccgcctcagcctcctcagtagctggaactactactggcttttattggctgcacgcaccagcatctcactgtgttgcccaggctggtctcgaactcctaggctcaagcgatccacccgccttggcctcccaaagtgctaggattacaggtgtgagccactgcacccggccacagctacttccttcactatcagcaccacagaacacataggtcttaattctcagcccttaaaacccagtccagcccaccagacattatttaaaaataatccaactgagacatctttgtggatctctaccaaaaagatagctttgtcctcccacccattgctttagcagcctgtataggggcacccagagggccagcccaccacacctggggcctccactttgaatccaccaggcccactctaatgggacagggaccttgggccagcgaagcagaaatgtattactgcaacagccccgtggtttcagatccttgcagtagcaggttctgggcatgtgtccccatcacccttctccaacagaaaatagtttatttttattttttcatggctggcagcaaggcagcacctgtggtaacctcgttagtcaattccaagagctcctcagagaagggggaaagcctgccaatttagcaaggatttttggtctccagtagctatgaagtgtgggggggattggggaaataagcccaggagcaagagaggttggggatgagcagtcttctcatccaaatccactctgaggttagagaagaggaaagcacgccattgactggttttctgattgccttcatacatccaagtatgttctccacaatgactttttctctagtgggaagccatggagatggacttagataataccaagtaccatttcctgcatgccttttgcaggccaggcattgtgccaagcccttcagatggtgctcctcagtgggagcttctcagccagggttttctgtcaaagatactgactcgacaatcctagaggatatggagtttatttattcccaactggaaagtgagggactcgagtctctgaggggttaggtgactttcccaagttctcatagcttctaaatggtagggccagaaatcaaatgctgtctgatgccaaggcttacatgacaagctccctccctgctccctgctccccctgcccctcatttctctggcagtcaccagattttattttccccaggatgagaatctgtaaaggtttggggtctggctgatttggactgaaatgggctctgtggcctcttccctgggtcttaggccccatttgaaaaattgaaatggaccgttgaatcccagagccttgcggcatggtagattgtgaaataattccatctcctcccctctccctccccaacgccacacacccatggtgaatggggattctcccaatgaggaaggctcagcaactcccagggcccctgacctgttcattctagaagcttcaggagcagcagtccctgcacccaggctcatgccccagttggcagccaagttcatcctctggacaccaacatagcttcaaaagagtcagtgtcagaaagcctcatacttaccttaccgtttagggtagtttttattttgaaatacatatagaaagatatattaatcagggtcccagcaagaaacagagttcttttcaaaaggatttgactaagaagaatgtagtgaaggcacaacttatagatggacgggcagggttcagggcagcaacaggaatgttgaggcacccaggaactagcaatagtgggaagatgataccagccctcagccaaaggagcaaagaaaggaaatagtgtgactggggcctggtgagtcttggcagcatagaggtggccacctggtgagagcagtggtcccaagggccacagtccctgccatagccaagcaccagagcaaagagggagcaggggaagagacaccctcctgacctccagcctcctgcctgtacctcacatttgccggacacaaaaggaagctagaggcaaaggaagctggtgattcagctcctagcactcagccccaggggtcacagagcagggcaccaaagggaagagaatgaacatgaagggagaaggcaaatggagaaaaataagcacaggggacaccttcctccttttcgtgattaggattgttaccattgcagacctgcctgccacccccaacccagaggaccttgaggctttggggaatgagaagtaaagcccccactagaaggttgaggatgcataaagcttaaaacccttgttctagggaaagtgtctttgcagcctttccatggcacttagtgaggaatgagtcttgtttccagatggagatgctaaagcatccaggcatgccagccctggggaatgcagggaaacagtcttagggatggacccaggccttggtactttagagcttctagggtatgagtcatctttgcctcttaacaatcagatcagtggtacccttctgacctctgtcatttggctgcactggaggcaagaaatggtttggactcacgcaggggcatgatgttagtaaggaaggggtcagaggtgaacctagcttgggtgctccacctcttgactcagagtctgtgctctttgatgaactttctgttaccttgggatcttctacagcaggtcctggtgtgcaagtatttcaagatcaagataaaatatttcattgtgttttatttaggaaaaaaatggtagatgaaagcggaaccaacaggggcattccgtttgtggtttgctgagattccctggaaagcaagcttgggaggccagggtctgtcagaacacaagaccaatgtcttctccaaaacttggatgaacagaaggtgcttacaagctgacagggagttatggggaaggaagcagaatttccagtttggttccaagtcttttctggtcttgacctttagcctaaaaacagagggcccagttgttctccattattactgtaactcaaaaggagacacatgggtccgggagagagttgggaggcaatactaggtttgcacgttctgagttcatggacacccaaggaactgcccctccctaggataactagagccaagccactggacccttctcatcctgtggccttgtctacaattttaatcattttgaagatgaaggttttgaagatgaaggcccagcctcaaaaaggaataaccaagaacaaccctctctccctcctttagtttagatgcttccacagtcaaatgtaaaattattcatgtgcttttactcattattcatctgattttatgtaaaaaaaaaaaaaatggaatcctaggctggtcactgcatggtgttctcaatcacaagccatgagccagggttcaacatgctcccttcacttcagaccttcctcacaactgagcctggatcccactctggacctcatgatccgcctaccacggcctcccagcgcgcccagcccctgctttatttttctatatagcacttattgttaccagatacatttgtgtttatcacctctctcatcacacacacacacacacacagttaaaggcagggacttggtctattttctcaaagttgtgtccccggcacttagaatcctacctgccgtggtgtacatgctcaataagtacttattaagtgaatgaatggagtcagacatgtcctcaagggtaggttcaaatcagggagaatggtgggtgtccttactgctttataggatttcatgctggccccagacttgagtcatttccatcaggcaaattcctgaaatacttactggtcttcctgattctgtggtatgtgcttgtcaacagcacattgtcgaacacgttgctgcctatgcaacactatgtggcaatggctgttgaaactcgttgctaacagaagtgaaagcaaagaaaagcaaagataaagaacgtaatggctgggcgcggtggctcatgcctgtaatatcagcactttgggaggctgaggtgggcagatcacttgaggtcaggagttcgagaccaacctggctaacatggtgaaaccccttttctattggctgggcgtggtggcatgcacctgtaatcccagctactcgggaggctgaggcaagagaatcgcttgaacccgggaggtggaggttgtagtgaacggagattgcaccattgcactccagcttgggcaacaagagggaaactccatctcaaaaaaacaaaaacaaaaaaaggagaaagaaagtaatttccccgccatggatgatatgacatggcagctttcatggaggtttcagaatctgccggcccacctcacacatgacttcctatgcaattagtataaagcaaagagacaacagacaacacttcacacctgagccccaggtcctgaatgtctttggatagcctctctccttgaaggatatattgactcacaggcaaagggcccttataatgatataaaggagaccaagttggaaggaatagatcacaggaaggtgaagcccaaaatccagaagggaatttcagggaaagtggtctggactcaggtaccctgcccagatccatgtgccttccaacacgtggcagacagagaggtgacaagacaaaggaggaaagcatgctcaagggatagctaatgggtgtgtcattcgaccttcccaagacctagctctctggaaatatcaagggttcagggggctgggtcataggcttgctttccttctagctcactgtgtggacctggataagttgcttggccttacccatccacccttagtagcctcttctctggccccttccatggttctgtgcagagtaaagaggtaggacacacagtagggcccagaagggtctcctggcagtcactgatgccagattcagctctcttgactctccatgttggtgacgacaccaccaattttcctttgcacacatggcctcaccttgaaaattcaagagtctacagtcaagtcacttctgcttctaggggcctcccagaagcacctagtattctgtttcaagtcctttgtccagctgctttcaaatcaccaaactcctctctccctcccctccattactacccatggagatccagaggagggacttcttaacttctcagacagtgaattgagggagctcagagatttcttttattcctggagcacagaatgtaacgtaggtgcaccagatcaaaggcatagcagcagcctgagcttctctttgaccaagtcctgggaggcaggctgggtgtttgtgtttgaggatagagtgccagatgttgcaaataaacatagaaaacactcatttaaatttaaatttaagatgaacaatgaatactttttttagtataagtgtgttttataaaatatttgagccatatgtataccgaaaaatgattccttgcttgtctgaaatccagattgtgttgggtggtctatattttacctggcagcccatttgcatgtttcctaaacacaccggcagctcccaaatcagcctggagagagctgagcctggtgcgtggggcataccttacaaccccagtttctgttccccacccatgttctttccaaggaggctggctgccccactgtcagagtgtccaggaaagaaaatagaagagagaaaatggtcatggggttcacgggcattgtgcccccaccgtcggctgcagcagagactcagtgtggcagatgcctccacgtctccagcccaggcccagtcaagcaagggccctaagatctgcccagaaggagaaggtgtgggagggggcggtgcccgcaagtggaggtgggggacaggaaagggaagggcccgcaatgccagcatggagcttcgaaggggactttgaaaggtgctgcctatgaagcactgctttcctccagagcagccatcctacctgcctgccctgagacccccgctggctaccattatcccaggacaaaacagggcccgggctcccggttccccctcatttcctctttcagtgtattttctctcctccatgttctggaagtttctctcagtgtaagccttgtcagggaggcctgccactctgccccacctcttcgcctcctgcttgccctgcggccagctgtggtttggcctgatctcagagcttagcacacagcaggtctcccagggttggaggtccatcctacctttgagtagctgtgtgaccttggaggaggcctgtcctacctttgagtagctgtgtgaccttggactacttagtgctcggcacctctgcttcctcatctgcaaatgggcactctgggcaagatgaagtgagtcactgagtgggaagtgtttgggacagtgacccgcgtggaagagacattgttatacacgtgggctttattccacccctgctgctccactcagctgttcctcagtcacctccactgattttgttcttagctgtagcccttcttgaacccctgccgtcctaggtgcacacgcctgccccacacctcccactgtcccctccctgggtgcccatgactctcttcttccctttcagttattttcctctctcagacccatccaaccagccccatttccccaaggttctgttctaacctctctttaatcctttttcccttggagatctcaaggaacagatgggagcctcagcacagtatagccttgtatgtgcacaggccatttccacacggggcggggacgtggcagctgtgctttggcggtcatctctggagaagggcggctggggctcaggaggctgagggagctcctgcttttcactttcttccctcctgtgagattcagtttttttcataagcattaattacttttattaatatagtagaattgcaactgtaatgtaggatttttttttaggagaagggatagattacctttgaccaggctctcagggtttctttattaagtaatctgcctttaagatgggatagggggagggcattcaaagtaaagatggtcccctagttgtgatttttcgactttatgatggtgcaaaagtgataggcggtcagtagaaagtggcaccacattctcccatgatgctgggtggtggtgtgagccatgtctcccggtcagccagctggttgggagggtaaagggccaatgccgtacagtgtgctgtgctgctaggtgatgttgcccagctctgggctgtggaagcgttctgagtacactgaaggtgggctaggctcagctgtgatgctcaggaggttaggtggatccagtgcattttcactggtatttccagctcaccctgcatttatctggatgtaatctcatcataagtcaaggagcatctgtacaacaagcagtctgagggaaggcacagaggagaggctttggcacctggaaagaaatgtcgggcctcatactgcccatagtaatttgtagattcaatgctatccccatccagctaccattgactttcttcacaaaattagaaaaaaactactttaaatttcatatggaaccaaaaaagagcccgtgcagccaagacaatcctaagcaaaaagaacaaacctggaggcatcacgctacctgacttcaaactatactacaagcttacggtaaccaaaacagcatggtactagtaccaaaacagatacatagacaaatggaacagaacagaggcctcagaaataacactacgcatctacaaccatctgatctttgacaaacctgacaaaagcaggcaatggggaaaggattccctatttaataaatggtgttgggaaaactggctagccatatgcagaaaactgaaattggaccccttccttacaccttatacaaaaattaactcaagatggattaaagacttaaatgtaacatctaaaaccataaaaaccctagaagaaaacctaggcaataccattcaggacataagcatgggcaaagacttcatgactaaaacaccaaaagcaatggcaacaaaagtcaaaattgacaaatgggatctaattaagctaaagagcttctgcacagcaaaagaaactatcataagagtgaacaggcaacctacagaatgggagaacatttttacaatctatccatctgacaaagggctaatatccagaatctacaaaaaacttaaactaatttacaagaaaaaaacaaccccatcaaaaagtggtcaaaggatatgaacagacacttctcaaaagaagacatttatgcggtcaacaaacatatggaaaaaagctcatcatcactgatcactagagaaatgcaaatcaaaaccacaatgagataccatctcatgccagtaagaatggcgatcattaaaaagtcaggaaacaacagatgctgtagaggacgggagaaataggaatgcttttacactgttgatgggagtataattcgtccaaccattgtggaagacagtgtggcaattcctcaaggatctagaaccagaaataccatttgacccagcaatcccattactgggtatatacccaaaggattataaatcattctgctataaagacacatgcacacgtatgtttattgtggcactgttcacaatagcaaagacttggaatcaacccaaacgcccatcaatgatagactggataaagaaaatgtagcacatatacaccatggaatactatgcagccataaaaaaggatgagttcatgtcctttgtagggacatggatgaagctggaaaccattattctcagcaaagtgacacaagaagagaaaaccaaacaccacatgttctcactcataagcgggagttgaacaataacacatggacacagggaggggaacgtcacacaccagggcctgtaaggggctagggggctaggggagggatagcattaggagaaaaacctaatgtagataacaggttgatgggtgcagcaaacaaccatggcatgtgtataccagtgtaacaaatctgcacgttctgcacatgtatcccagaacttaaagtataataaaaaataaaaaaaatttaaaaaagaaatgtcctgcctcagctggtggtggcaggtgctgtggctcactaaggcctcaggtccattggctttacctgacaggtttgtctacagcgcctgcagacctgccaggagggggtgacactctttggagacagggtgatcccctaatagtgatgtaagtgggaggagaagctgtaaaataagtttaggaaatagagactcccccacatacttttgggggtccaggtaagggtacaatgtagaccagctttcatatgtccaaatatttgaaagttacaaatcaagctaacaaactattacatagaatatgttctctcctcttgccttgacaaacgcaccttcctgatatggtgaaggccaaccttgaatttagaacccgtggacccctcagagttccacactggaatgtggtggccttgggggagcccgcctgggctggtttcagaccctggctccatttagcactaggaagggccttgagcacacatgtgtgggcactcagctcacatgtgcaagctccgcagtgccctcaagccacccctggtcaccacccgaggcctatgggtgtgcacaccagtaatgtgatccacccacaacttggccttgggcttaggctcagggaattgaccagggaactccaggatcagaatgcacaaggcactgtccaacgtccagcagcagggcatatgtgggtccttggggccatattcctttaacctgtggacacttcacccacggctggaggtgagccagagcagactccctaatgtgtgggccacagcaccggccactccagtcaccagatgaggacctggcgggggtgagcttagccaatgaaaaccggaggaaggagctttaaaggtttcctagaagagtcctccagatgcccaggcgcccccccaccccccatgctggggctggatttctgcccaacacctcgtgcctcagggtcattcaggtgtcaccgtctcatgctcctgacacagtgaagagcttgttttcctcctcacactccctgactctaatccccaccagcctgtgccacttggctggcctccttggcagaaaggtgacaaaaggacacgtctctggagagtcagatccctcagctgccggaatctaggacctccttggggccacataagccaatggctgagggtcctgatcttgttactgatctggtttccttcgacctcttatagccagggtgttggtgggagtcactcaagcaaattcattaatcttaaggaagcaggagctattacaatcgagcaagcctctttgcttctctctaacgctcatgctcccatagcattgccctcctgccctgatcagccttccctatagaaccttacctcccaatgtttcctcacctccagccagctcacctctgccactgcgcttcttgcctgctcccaacatctgctcatctgcacctacccagctgttcttatttctatccaaatcgctttcgtccttcaaggtgacttgagatttcacctccataaaaggttcccaacacttccatcgattcttcccctgctttatcacctgtattgtttaccacctggacccaacatttggcccatgaattatgttcatgttagtactttataacatatggcatttttattcttccatgttatgtagaaatcatagaactagaagagatcttaaagactacctagtcccatcctcattttctgaacatgaggaaaccgagagagaggaaggttgttgtaacttgccaggcagagccctcagggtttggcagagctgggcgttacactcaaattacactcaacactcttagcccaatccaggacttgccacaagctcttgatgcctctctacatagaagtctgcttcacccataggatgcggcggtcaggaaggtcagtctcagaatatactcaagtgggcaaatggggccttcccattttctggcaggacacagcccagagaggtgcattcccacctctgtgtactctattatttaagttatttgcattttaataaccagcaggcaaaaaaggcagtggtcacctagattttctcagaccagccttgattccctgctgtctccccatggggaatttcaggaactcccttttcttcagagggaataagcccaattcctgcttcaccatggcagggaggccggctccttttgctgccaatccccattatccctcgcatttccattgtggaagtgcagagaggttcttagcgagtctcccctcggactttcccaggggctcctgacgaggagccccaggcgggaggctgatgggctaaacaagcaaccaaggaatagccaaacaggctccaagtcagagcctatctttaacaaaggtgggataaagggagcaacaaactagaaggcagaagggtagggaggggctggggacaggatgacctgtcccaggtaaggcccctaaatgctaagtaaattccccaagtcaaaatcagctggaacagggcagagcaaacatttttttcctccccaccccgaccccgggtgtcctgctcactgcaaggaagaaaaacagaataatgagccacgttggagagtgtcactccagcagctccggaaagacgtgggcagacgcctggctgggcggctgactttctctgtttctggtagagattttataaatattcggggagtttgatctgaggctgttggtggggaggcaaggagagctgcagaggggggagacaactcagcccacgggggttcttggacctctctaaagcctgcttttcattagcgtcgccaaggcaacggctcatctgctgcagatctcatcaaggccctgcaaagcatccacggcacgttacgctttgcgtttcacagtgaatcggctgcaatcagtcttcctgcagccctcccttacccccatcacctcctagcctatggaagagaagatcattaaaggcgggtgaaaaactgcaatcagaactctccgaggctggcacggagaggcagagctgcgatagtcctgttccgaggacagtagattcgccctgaggactattcaaagctgggcagtgatgagcctcaagtaacccgatggacctgtagcaactccccagctcagtcttcttccatggtgcacactcagccttgattcttgtctcctccctgcctgacctaacctttcccctccacacacctttattttttaccaaggcgaacatttgcggtgcgcccaagaacctcaccggcccttgtgccgatcggttccagatgcccatggaaatgcaagctcatgtgtttctctggttttaacaaaggtgtccaatgagttctaagggtgatgtcaggggaggtgggggcagaccagggagtaaagggagacccatgttggcaaagcagtgtgagagcaggtgagtgggcccaaagagtagggccaggtgtcatgctcagcacagccaggtagggaatgtgcacagaacacattaattcggcttcacagacactcccattctcagcatgtaccccatggaaatccagtcaccccctttaaaagttggctccttccatggccgggtgcggtgtttcacccctgtaatcccagcactttgggaggctgaggtgggtggatcacctgaggtcaggagtttgagaccagcctggctaacatggtgaaaccccatctccactaaaaatacaaaaattagctgggtgtggtggcgtgtgcctgtaatcccagctacttgggaggctgaggcaggagaatcacttgaacctaggaggcagaggttgcagtgagtcgagatcacgccattgcagtgagccgagatcgcgccattgtactccagccaacaagagcaaaactctgtctcaaaaaaaaaaaaaattggctccttccagctttgagatcctgaggccagcagccagggatcctgctctctgctatatgtcagtgttccagcacagtgcctgcgcataagaggccctcagcagtgtcttcaaagaaggaacccctctgtccacacaaaagagggggagagtggtcagggcactgcagaggttggggttgggttttctggttgtctttctagcttgtctttgtgctggaaagcaaacctgagctccagcctctcccagcccctcctttctgtggaatgcagatcaccccagctctcctgaaagattggtactcagagcctttgagcaagccctgggaaaatgcagaatctcaggctgtaattacgagctggagaagatccctcccccagctataaatggagcagaaccaggaacccaagacagctgggctcacacaaaggcagccccttgctttcttgcttgctcctacttttcccactgagcttggccctggagaagcaaacccctaattcctctgctggtctgagcaggaaattcccgtcagcttgtgggagaggccatctgagagagatttcagcacatccatcccccccgagatccagaaccgtatcaagtcctaccccagtcccgcagagcagcttcttcctccacagcttctgagctgcaccgaagcaggcctccgccagcctttgctacccaaggctgatgttgggtttttaacactcagccaagtcatagggaagagtaagatttacaataattgggtacatagcatagctgactgggctgcacagtgtggcttttggtcagttctggcattctggtgggaaagctgcactgaagaggcagagaaatgccagcccagatggcagacatggtgcatttaaaaaggcagtgtggtatagatcctcgctcctataaacgcgggcctggaacctgcagcaggagcatcacctgggagcttgttacagaagcagaatctcaggccctactgaatcagagaatgggttttaacaagctggccagcggacacaggcacattcaagcttgaggcagagtggagcacaggaaagaacatatgggtgcgttcatcccagccttgtggattcctaatgccagctttgtcactcagtagtatgtgactttaagttaagctccctctctgagcttcagtttcctcccctttacagcagagatgatgtaacctattataaagggctgatgtgaggctcgacctggtaccagcaggctcctaccctagtcaatgttagcagcacagagatgattgctcagggaacatcaaaatcctttatttccccaaggcaactacctaggagatgcagcttcagtccgtcctcttgctatttcacttttttattttctggggagacttgtagtcccctgaccatgaatttcagagccaacagtggtaagcttttcattctagctacccccgtgtgaaattaagatccagagtgcccccagagggaccaagctttctcatgtagaatagatcgctatgggtgaaggaactgaatgaatgcggtctggcagggtcagttctggggacaggggcattccaggaagaggagatacaacatgtaactttcataatggataaatggctccttggcggttccccacaagtgagtagtatcgagtctggatttcatttctttcaccgtctgtgagtttccttgagagagagtaggattctcttgtcatggggattggagttttaacccacttttctttgtttggtgttggtgtgttctgtcattacagtcccctactgctttcccaagctaatgtaatggaacacagggatggacaagccacgagggtctgcagggacctcaatgtctccataaatgctgggctgattttgcaaagctgctttcccaacggggcttggctaaagctgcttttcaaattagttttgtagaggaaaggagggcaggtcagctcccaggtaccagttgggtgacctggggcgagtcccttaacctctctaagcctcagtttcctcctaggatgataatgctaatacgagaatctccttgaagacagccatgcatgtctccacccattctggggataacagaattactggcggattaagtaacgtgatacttacaaggaacatggtacagagagtggaatatggtcaataaatggtagctgccatttttgtagtcattagaagaggcgagccttgaacgactagcctctgttgaaaattacaaacaagagagtggcctacatttgcaaacagtgagcatagccacccattcctgttagggtcagcaactgaccctcccttcccccgccttcacttttttttctttagctgcaggagttgagacatgtggctcaccaggctacctcagtgagttaaagctttaaataaatacacactcaaaacggctatcacatcactgcccccatgactgccacaagcccctcccgacctgggaacgtctcttcctccctctccctttctctgctgctagaggccaggccttggctgagccctggagagggtatctcctttgcacgtatgctggtcccaggggccctgcacagggcagatgagggtagtcctgatcctgtacagactctcctcttcctgggtttgttagaagcctggccaggcccctagtcttatgacttcaacagatgtttctgcttaaggagccctggcatctttatggcctgttttttccattcttgcctctcttcctctgtcccagcagccctgaatgcaatttggactttattttctttctaatggttacagggatagaaagggctttttcccccccattttcagtttttggctttttcattagctcatcaagctgggtatgtctgtgttagctcacacagacatattcacacacgaacacacacattccatatgcattcagatctgtacccatggtgtgtatttcttaatgttgcactgacatttattgccacttcagacccagcccatttcaaagccttcctccctgcctccaccccacacttcacattcatcctctgcctagcctcacacaggtcaccctgagcagccgactggggtgtcacccagatgctgattccaaaaactagtgctggcctcggcctccagcaagatgtgtagagcctcagtaactcaccagtctgcctctgtgcttccaaggagtcttgggctgactgatggagtgagagctgagactgcatttgccatgcatctcttcaagctctgcctggccagccagtctacccaggctcagggggccaagttgacagctgttaaaaaaaagaaccagttttccatgagcaggcttgaaaccagtctggccaccccttggatctacacctgtaactgcccccagcttgccagcatggcagggtgttcccagtcacctcccccgcagcgttgggggttgcctgtcccatcagtctggttcccagagcaaaggaaacctggcgatgtcaggtcttcagcttttagtctatctatggcaaaggtgcctggggctgggacctctttattacctcctaagcctgaggactggaactgaacttctcactgcaggtataaataaatctacctggaatcttaaatgttgataccacctggctgccttacctgaagttagacccattacccacaagaggccatctaacctcaaattctctgtgtctctgcagcccttcttcctaggagggcaatgatgccgaatcacctgttatggcattttcataattcagctaaccattcactactctatctgcccatgatccacccaatgctgaccatgggtggcggggcagagtggcctctctagaatgtctcctctttaacaccctcaccatggaggggcctttatagatggccccatgaagttctcactaggcgactgctcctacctgagatgggccaggcagccatggacccctcccctcccctccggttcctgccctgcccaacctcattctgatggtttggccttgtgcatctcactagtgactcttttcttccctccttcctatttaaacaaattaaaactccagtttttcttcatttatgttttggtggctgaggtggagcatcttttccccagtgggttaagagaggctggttggagaagacagcaacaggagagtgagttgggtccccagtggcatagtgacatacacagggacagtgggaaatggaagctggaagaagtcccagaagtaggagcaagaagagtgactgtcctccatgctgggttctgccagggactctggatgcgctgaacaacagccatcctagagatttgaggacacctcttctgtttgctttactcatcacagattcatgaataaagacaaacaggggagccacctcattggcttttccatctctaaataaatcccttctgaatacacacccccaatgtggatgctatggatgcttctcaagaaacaaccatatgatgctatgataatcgatatccttccaatgactcaaatcaaatcaacttgaggagcctgatgggtctgatgctcttcttccctgggcctctgcacctttccagagccaggccccctgtgtgtgtgtggccggtggcgtgggggagttgcttcttttcatttttgtgagtgaaaatgaaagggttccccacaaccagctgcaacaaggatctctcaccctgttgctaaggagtggtggggtcctgctaccatgtggtgctctggcaggcctggggagatctttagggatctggagcagccactggatgtgcagtcctgagcccctgggatgtggaagtgattggccggccacctggatgggcctcacagtcctactgtcactcctcttctctcctttcacttctggatcctgctagagaaatggagcccggggaaactgtctcaccacctaggactgtgtggagctgggcacacactcaggaggcaggtgacttccaggtagtcaaagagaagctcacactccctgtcctctgatagtcctactccctgaaggatctggtcaagccattccttccagatggccgtgatactgtgtcccctcagtattaggagggggggaattgatgctttccatgaatgaaagctcctaaaccccctcccccgcagctagggctgatggggaatggctaaaccccagatgtcttcattgcaccataaatgtgagcagggaggtacaaaggggtaggcaatgatgtgtgtgtgtgtgtgtgtgtgtgtgtgtgtgtatgtgtgtgtatcaaagagaggagtctgtcacaggaaaaatactgagtggccccaaatgttgtaagcgtatgcaccccagttttacaataataacaatcataatactaataattttgctatcatttgttgagatctttttctgggccaggtacggtactttgcacatattatctcataattctcaaaatctctgtgaggtacaagtatcactatgcaacttttcaaatgagaaagcgagcatggaaaaaaagttggttcaattgccaaagatcatagatctgagaagtggcagggccaggattagaatgctagagctcaaagttcttctgccacgtatcatagaagcgaccactacatcgataatggtaactgccaaccctcactgttcactggccacatgccagacacatagattcacttaattcattcttacaaaactctggatgtattcttattgcctcattgtatagatgaggaaactgaggcacagagcattttggcattgattcccttcggcaaatgtgatttgaacagctcctatgtgtgtgcagggcaccgtgctcttggctctgcgtgggatatgggactgagtgatacgtcattcttatggtctgagatcaggaaggtccatggccatggccatcagaatgggctcagggtgggattccagaacttgaaatgagggaccttgcatcctagggtatgctagaaagtggaacataccaggtctctagagaaggaacctaggcacagaagcaagacagagtcctgttgtcagactgaggcaccaggtcagaactgggccagcagcaagggctggcggaactggaactgatttattcccgcctgcagcatggcctcgagggcagggctccagagctaggctgctaagttcagatcttccattctttagctgtgagaccgtgggcaagttaatgaacctctctgggtttcagtagcctcgtctagaaaacaggaatcataactgcccacctcatggaattgttctaaggactaaatgagttaatatgtgagaggctcttggaacagggccaggcccatgatgggctctctggtgggctctcaagctctcgccagccgatgatcattgggccctttgatgctgagtgggcagaagctgcaggtaggggacaagttgtcccagtggcaaacagaagaaaattgtagtaggaactgattagggcctgtctctgtaggtggtttgatggggagggagagatgaaatccaatgggacaagagggaattcacatcattagtataaaaggttggcaaatgggcatgggacccttccttcttagtctccagaggccaagatgcaggtgcctggcacctgggctggctgaaagtggggaatgtatcagggctggcatttatagtgatgccactattgtctaattatgggcacaaagagaggctcccactgtctgtgcagcccctcaaatcacccagggaagaaatattggtctattcccagcattccctctgtcaactccccaacctcagtctctggcttggaagaaagacggctgggaagggggatggaaggcagccatgctctgttgcagtaaatctttcctagaagaggagacagctgagctcatcagccagtgtcggatcagctcagaaagaatcctttccaactcccagaagacccctcagcggcttgggaaaggaatggctcactggggcactttgtttgtgtatgtgggcctgtcaggctgggcaggggtgtctgatgacacattaggacagctgaaaagagaggtgggacaaaaatgtttgcccaagggcagtcttgtgattcccccaccccccgtgctccccacccccacacgcctttgagagcttgttccaggacttttcatatgcatttgagaccacaatttcctctcccagaaaccccattaagctatgagtgagtgaggcggtgggggagagagagaggaaaaggaaaagagagacagagcaagagagagagtttgtgtgtgcacacacgaatacttcttccccacccgcattcttttgcacatgtctaccgttatgtacattcctatgccataccccttgaactctccatcaggtcttcctcaaccatcctcttcaggaagcctcagggcctcagagaaaggcaaaagggcctagactttgacttccttttttttctctctctcttagagacaacattttgctctgtcacccaagctgaactgaactgggctccagaaatcctcccacctcagcctcctgagcagctaggactacagatgtgccaccatacccagctaattttttaattttttgtagaggtggggtctcattatgttgcccaagctgatctcaaactcctggcttcaagagatccacccacctcagcctcccaaagcgctaggattacaagtatgagactttgccattccaatgagaattttgtccttagcaatctcatccaatggccactggagatgtgtgtagggccacaagaatgagaaagggggcaatggagtgacaggtgacctgctcaggtgcccctccccagaccaaatgtcccaggcacacagcccatgccctccaccatggagtacattttctccctggcttgctgctgagctaaaggaccagggacgtggaaacaggaggtgaactaaggcaccccgccacccactgtggcagcttgaatttcttgaggctgagacaaactaggatccagtagcctagattttgccccagtttctccactgagtatttactcagtgctcctgagccgatgccttcccctctgcctagatgaaccacagcattttggtaaatgcctcagcatgttaggagcgctggaacgtttattctcttccctcccaattatccactctaatggagcagaacacttacatggaaaatcctaaacatggaagatgatttaaaaatgattcaccctggaatacatgcttccagttgcttctacaggtttaccttgctaaaggcatttcgcttcctttgctgttacaataagcttgcctgccttgaagaaaagaagaccagggccaaagggaaatcagtcaagggagcctgttttgtctgaaataatgcatccatgaacaaatgaattgagtataactgtctttttacatcagtgtttctgtggaattaagagaacatccaaggccactcctagcttgagtagattaaatttgtccttgtgtttggagcaagggttgtgaagtctgtctggcccatcaaatgaccaatggcttttaaggaaggactaagtgacttatgaccagaacaagggagcagcctgagtcagtctccccaatgtctacattgtgttatttatactagcaaaaaaatagacacaactaaatgttcgaccatatggtattggttaaattaacatctatacgatggaatactagatggtcattaaaattatgtgtcagaagaaggcttaatctcatgggaaagtgttcacaccatattattaaagagaaaaaacagattataaagcaatatgcatacaatgtagtagttctgtaagaaaaaagtattatgtgcattttaactggaaaaatatgtataaaaatgttaacagtgcaatctctgggcaataagattatacttgacttttatttcttttttggaattgtcttttttttttttttttcaagtttcctcccattaacatgcatgttcccaaaatcaggggaaaaatacattaagaaaaaaagattatctgagagaccagcagatgtgtttcctgtttcttatcccatgtctattctccattttatattggagattcaaattcttcagccctttccacaacagacacttctggggcaagaggcacagaatatctgatatcctaaacaacaccaccagggtgaatttctcactgacagtaacagctttggaaaggttttgtttctacctggcgctgggaattaatcgtacccaaacttttttttttctaatcagtaatgagcatctccaagggggtcctagaagggttccaggggttcatggaggacaattataaaccttgacagctgctcggtgggttttcaaccatgggggtgattcatcccttctcgtaagccttttcatagcaccctacgctcagagttttgaaaatgtgacaaaaaagaaaggggctggggagaacaatggcccttctccttttatggaaggatgatgaagggaattgggaagagcaaaactaagggactaagacaattcagcttttttttgtctggctcataggaccgtgttccccatagagtaatgcccaatgagtggacgaagggagtaataaatgagttcatagaaggaaacagctgggctgctgtaaaagctcctgcaaaacagataggcctggcacacgccatttctgtcacaggttttaaagaacctatctagctttcagctactcctcatcaccatctcctacagaagcagagtcaagatcatgtctcttcccatcgtaaggaaacagcactgcgaatgttccagctgtcctgaagtcactaatcccgtcaggggcagacattggcaacacacccagaaggtggtggggagtgcagctgtcctcctggccgactgttccagccggtcacctctgctgctccaagggtgccacgttacctaattctggttcacggtgagatggcggcttttctcggccagcttgtccttagaaaattcgttcccttgttgtattggaaaattcctcttgtgcctgtcattgcacacatcaggagaccaaggtttccattttctcagaagaaattagccagctactgtcattgacatgaagcctgttcctggaattttttactcctcctcttaaaggcatattctggaagaggcaatctgagaatggggcccgtgctctcctacagcagagaaataaactgaggctaggccaggagctgtgcaccgtctgggggaaccatacccagtggggagtggccagatcagtcccaacactgaaattgtttactgtcatccactcctggttgttaggggacattgaggatgacaggatagagagtagggaaggaaggaccagccaaggaacattttccctataaaatgagactcccaccctactcctgcccttgttaagacttcatacactatggaatactatgcagccataaaaagaacaagatcgtgtctcttgtaggaacatggttggagctggaggccattatccttaagaaactaatgcaagaacagaaaaccaaataccacatgttcttacttgtaagtgggagttaaatggtaagaacttatgaacacaaagaaggaaacatcaaacactagggtctactcatgggtggagggagaagaggagggagaggagcagaaaagataactattgggtactgggcttaatacctgggtgatgaaatactctgttcagcaaacccctgtaacacaagtttacctatgtaacaaaccttcacatgtaccctccaaacctaaaatacaagttaaaaaaaaaaaaaaggacacagatgtaaattgaccctgatggagagaactctactctatccttgccaggtcacaagaaggtgagatatttacttttcaaatgattgatgctgaaatggaaaggactgtatctcgggggcacaaacccaacagagtaaatgaagatcctactgcttcagctcctgggatttgttaaagtggggaccagcttagaaaaatagacggccgtcctagagacccatggcagtctcggtctgattttaaatctaaattctcaagtacaagtagcttcccaagaagagaaagctacttctacataaagaggtggtatcagtaggaactccttaagccttacctttttattattgatgatgatgaagtgaagcttcctgttgatatcattgtcagaccaagcacagcacaccaactcaaacctcattcattcattcattcattcatgtgtccttttaacagacgtctactagacaccttgtgtgtccatgaaccaaataccatgcttaagaccaaggattcagaaatgtgttagctgtcattccccctccaggaactctcagccaggaggagatgtactcagggaaaaggagaaatcacagtataaccattgtaaaatcctttctgataaaatcgcagagtgtctaatactcctgttccacatacataaaaagaaactaaagtgtagagaagggaggaaagtcccgaatttagtgtgtagcagatccaggagtaaaacaagcattcctcggtctggggtaaatcccaccgggactgtgttgagacccaaattcctctgagtccacgggccccttcaagtcagatgaaattccaaacaagccagagcctagctgaacagttccacggtgccgggctccagtgtgttctggaaggttctcgtgggctgtgcctccagaagacggaggcggggaggagccccacaggcccagggcagtgtcaggttcccccttttctgtcagcaggcatggaagagcctttaagaaaatggagtattattattatttgtttgtttttacagtgactcagtctgtagtaactgggttaaagtccgctttgagaaaaggagaacaaaagacctcctgttagtgctggaagtttgcctcttaagatatcactgagaggaactgggaagaaaaaaaatccccagcagggcagaggaagctgcaggccttcaggaacacagcagcactttggaaaggaaaacacggccgactttcatctcctgcgccgtatctgagctggccgctccctttgccgctgctttatggcccactgcggtgctgaccgtcggacatcggccagtaccctattcccacactctttgaacacagggggctgccaggagtggtggtagtgtgggcatatctccatagccaaccaaccccaggctgaggaggagggaaaggatgttgccatacgaaacatactacgtgctggacgttattctaacattacatatcataactcatttcgtaaacaccaaggaggctagcatcctccttctccagccacagcagaagttgcgcaaggtggaaatctggccctgccctgtttaggaaactcattgcaagtagaggaaccgtggggtgagtaggctcccaaatgggtaggaccagattgctaggtggtctcttccaggttgcagactcaggccatctgactctaagacctaagaacttaatcctactctcttcaaatgaaaacagaaagtcagaggaagacaagaaagtttttcttctcacgacctcccatcagatccgccccatctacattaaacttgtacccgtgtccttcatcaatcagctcagtggaaatgttattctcacccttggccacccagatcaggaaatcggtctggaccatgagtgacatgctggtgttggccttcttcaccataactataagaagctggaatgttcccctccaaggctatgaaagaaggatggagacaagaaggaaaagacagaaattctgtgaaagtctcaggtccttcctcctttcggaaccacttcacataatcctcttcctccccaggggctcccgaaagattaggcttcacttgcaggtcccaggccctggtcctgcagagtggttgggcctttggggtctctcagagagcctaatcattctgttttctgaacaagtcatagttttgctgacttctgaccaaacccccatcgaaacccaagagtggaagtgtgattgtggtcatctataccctgtccccctacaggactccctgtcccacgggatgcagcaggcaggtgtgggaaagcctacctgatggccgagatcattaagcagcggccctctgattttctgtacagctactcagtgacttggaagggattctttgcactaacaagcagtgcctccacaaacaatgagttgaggggaaagactcaaaagaggccgatacaatgctgtttgggatgtttctccctttggctggcctcaggggactgggcccgtcatgtaatcactggagatttagggcctaattaaactctggcattgggccagcatgctggtggccccttgagtttcccatgtccacccatgtctagggtattaaactctagactgggagtgtgtactgcttaactgatcccacaggagccagccctcattatccaacaggctgggtattggcagcccacagggctcggcattggcaggtgcagtcctggggaggactgcatgcctttaggttaacggtccctacatcagcacccgctggggccacagtagagggctttgtggatcacctctgccattgggacccctggcatttccttcctttcatggcctgataaaacccaagctctgagagttagcaaactgataccctttaatcatgccttatatttataaaggcctttgtccagagaactccaagtgctcaaaaatgtcaattaattcactctcccagcctcctttagggaaaagctggtggcaggtgtcatcatcatcaccagaggtggccaaatcatcttcttagtgggctgtcctggatattctttgtgtttaaagagcattttgcttctgagcacatggttgggttttgcacagcctgaagcataagaattgaggtatttccttactttacagctctagagaattcttgtgtgtgggtacccgtgaaacacaaactgagtgcatgctttcttgagtttggaaattttgttattgtttggtctcagcatttgctggtagtaaataagtaagcagaagtaagctgcttaagttcccatgtagtccaagacagagcagacaaaagacctgatccccaagccccacacctggccccaagatccctctgggattatcttgcggccactctctgaagccttggaccctgtagttgatctcatagccacgtctcaccagtaactttttttttggtgggggggtgggtcctggcaagagatgggtgatgtaggaatggcctagctgcagaaggaggacagccaggtaggacatctgcctggctcacctccttcctggccacagactagctttgtgaccttggttggcagcgtcattttcatgtcggctatagtttccatgcctataaacagaatgatgatacctgccaccaacttttccctaaagggggctgggagagtgcattaattaatgtttttgagcacttggagttctttggagaaaggcctttataaatataaggcatgattaaaggatatcagtttgctaactctcagaggaagtacttaatgggatcaggcctgcatatgttgatgactgagtttcattcttcattcagatctgcacagggctcccatcactcagctctgccgccattcatgtagtattcttctgttctttcatttctatatactcatagtagggggcccacaaatgctgccctccacatgcaggcccactacctcccctccctcttgtcaaacccaatggcttttcctcactctgcattttccttgtcctttctggaacatgacactggtcactacccctcctcacccttgaaagtcttattctgtcattcccacaagcccaacaggtctaaactgaagtcatcattgaccccaaaccaattcccatcattactgccctatttctcttcaccattctcatgggcctggattccaggtcttcctctccactgccaccccctctgtgcaagccttattgtcccaacctgcttggtcctttgaaaagcccatccctgggcagaaatgggatgtgtatgtccctaaactgcccccaaagacctctctgcactgtatttgacctctggccctcctgttccctaactggccttggtctcctgctcccttccgtgggccgctccagctcttcccaccatgtgacctgccttcctgcttgtccaccttcctgtctggtccccagactcagtttctactctccctcccagcaagctgggacacacaaacatagacatatgttatgttcacacaaacatagacatatgttcacatacccctcccagcatcctgactggcccagctgacctccctcacccactctgaataaccagctctccctcctcctgcctttgtccagtcccatctctattactcagggctctccagagaaacagaaccaacagggttggatgcggatagatgggtgggtgggtggatggatgatggatggatggatagctagatagatagctagctagatagatagatagatagatagataatacatgataggttgatattagatgatagaaaagcaaatagagtttaagaaattggtttatgcaattgtggaggctggcaaatctgaaatctgacctcagtctcttctcttaaggcctttgactgattggacaaggcccacccacgttgcggaaggtaatttgattactcaaagtctactgatggaaatgttaatgtcatctaaagaataccttcacagcaacacctagcctaatatttgacgagatatccgggtactatgacctaggcaagtcaacacataacattacccatcatgcttttcatctggtcagcagtgctcgtataaatctcctgaaacattgctctcaccacaatgcttccctgctccaaaacctaaacacccatatgcctgacatgcaatagggacaggtacatatttgttgagtgaataaataatgaggagcctttgggatgggctacactctgctcaatgcagcaaaccattttgagggcctaatgtctggagctgaggatatgactatcaaagctgcccttacgtgttcctctcctctccctctagtgtctcaaggccagagtccgaacctcagacatctctaatcccccatagtacccaatggagtgccttatatggattaggccctcaatcacttgtgggttaattttattctctttattgatccctatatcaaatttacctgaaatattataggtttttagggcgtcacttatgaaatcataaactgtagtgccaaatctgcttccacttttgtttttaaggcacacatgcaaagagctatttccacaatcaggaagggtggaaatagctcagaacactgacagtggtctgtagggatgggtggcttctatgggattttttatacttttctgtgtcttccaaattgtcctctgtgaccacgtgttgcttttacaaccataaaacatgttatctgtttttttcatttatcttttcgatttgggggtctgttctcagctcttttttggggtccccatcatgcctcctggcttccttttgaaaataaggcaacccgagacttccttgtaaaagtctgtgaggtcataaaaggccaagttaactgcaaatggttgttctgttttaattctgttgaagtgtcaggtaacatggacttataataaaagcacttggggagttaatgattactgctgttgtcaagctgtcccaaagacagagagggagcctgcacacgccgcgtctcgccttgggccgctccttcagtgtatccagccctgcggccgcgctggccccctgtccgcatgctgtcaggctacctccgtgccagacgaccaacacccagccacagtggaaatgactgttccttcaactttcttcagcccctgcctgctggggtctccggagggaagcgttcactctagcccaaatgaaacagagctccagaaaaaccacagtggaggccacagcggcctcaggccctgaactttgtatttcttagcccgccaggattgctggctgctgggtgtcatgtaactcccaaaaatgtgaagggaaaaccaaagagcctgagaagcgcagacgtctcctggctggggagtccgtctagaaagtcgcctttcatggtgaggccaggtgcacgcgagagtggctggagaaggtggggtgagcccagaacagggaggcccggcccactcccaggctgaaactccgagaaactccccctgcacaaggccacgccaatgaagtccccttccttctggaaagggtcctacacaaattgctagggtttccagtgtgatatttgacaagtgcaaagggctggaaatattctagagatttttcagcttcgtacaattatcggtggccactgagcccatctcacctcctgtggtgtcccgccagtggctgcaccagccaggcggggctgccttttgtccctgatcctgtcagccctccagtaaagtgtgcttaaccaggtgccccaggagagcagggggccagctccatgtcctcatgggtgtgcagcccctcagcccttcctcggccctgcccattaacagctgtgaccgcagaaaatgccccagcggcagcgccatggtccccagggctgccctcctgcctccctctaagtcatcgaaggtcaaggttggagaaatcttagtgcccatgggccctcctcctcactgaggagcagagcactggctcaggctcactgaggacagggccacgctgctctggtctcatgtacttttgtattctgggagcctagcactcagggctccctgagtgagtgaatgaatgagtgagtgaactagctcctgtgttctcgtcttttcttcggagagtgacactttggacaggtcatgtttactccatcccctcagcttttcagtaaaacgagcccaccagtgttcatttccttcatataactgctggcatcaagccagcaaccttgtggctcctcagacgcccaccggtgtggcccaggcggtgctgcagcctccctcgctccagccctcaagggaggcctcactgacatcagcctctgcattagtttcttataaggctgacttggtcaagttttacttaaaataacagaaatgcactctttcacatttctggatccgagaagtccaaaatcaaggtgtcacagcagggcgggttccttctcgatgcactgagggagagcctgtgttatatgtaaaatatttgtttagaaacagaatgctcgttccctggtgctgcaaagaaatagcactcaaacataaatttaattctctcagcaaggccatttttactttctgcagaaagggtgctcatcgcagatggaacaatggtgagagtacactcgaacaaaggagggaatcaatttttattccttacacagtttgtccctgctactgtgtcttgtctccattggctggagccagacatgacaatctaaactaaaacccgactggctaacagtttaacaagaagggaaactttggagaggaacttttactttctacagcctgtcccaggcctcctctagcccctggtgtgcttgggcgtgcacctccatctgcacatgtgctctctctctcttctcataaggacagtagtcagattggacgaagggcctaccccactcctgtgtcttaactaattacatctacagcgaccctatttccaaataaggtcacgttctgaggctctggaaaggacatgaatttggggggacactatccaacacagtacagccttcctgcccccctgcaaagtttcgtcttgctctccacccgcccctaacctctgcaccctttctttagctgggggtgggcttctggaatgcagtctcattcgcccactagtctaagtgtggttggtaggtagagggtaggggacacgctgtctgtgccaccgtttcccgccagggacatagacactctcaggatccctgaactctgaagtctaaactgtcagtcagcgtccccagcggaagctgcacttgagaatcacccgggagcttttaaaacacagtgtgccctaaccacactcccaggaactctggtgcacttgggccgggtgggactctggcatgagtattgtttgaaagttcatcaggtgattctaaggtgcagcctaggaccggaacaactgtgtaagatgctgtgaaaacagctccatctcaccttcaccaggaatatgagcagctcactgcctagtgaggctcgaatacccattaggaagagccaagccaggcttcttagggtgggttccctggcaacacttcccaaactctcccaccaagctcccaggaggcaggagggagcaaacacatactctgcagaaccggaaacagatggcagcaagcaccacgtgtccttgaagttttctggttttgcttttaaaattggaatttttgcatcttcttctacaatatcaccatcttgttttacaacctaaaaaaagatttcattatgttgactttttttcctccaaaaatatctgagtgtagaaatgaggctctggaaaggtatgccatgtttaaactgtggttttgtatggtccttgacacaccattgggttccctggggttcctgactttgaaaaacccagccacaaagagttaaagagggtgggagccaatctgtttaacctttggaaggaatcgcatcttagacgaaaacctaggcacagagaagttaagcagctcattcaagatgacacagtttgttattaactgagtcggaactgtacctcaggacccacctttcccactgcattgatctggggcaactgctaatttgctgtgtgaccttgtctagttctctttacttctctgtgtcagttttcctacgcataagatgatgataacatctgatccacccaacttcttcagtagttgaggaggctcaggtgtgtagaggcatgttgaaattagggagtgtcacatgtaaactgtggcatgtcatgtgtaaattatggagtgtcatatgtaaattataaagtgtcacatgtaaaaacaaggcgccgtaatttaagtccagcctcacacttctaggtgaggcacagtgattgcagcaagagtgacttttccagggtcatgcgggcgggccactgagggaaacacagtgtagtgcacccagcccctctgagcccgtgcagaggcttaagggagctccagtgttccagttccagggaaggctgaggctgggagctcatgccagcacttctgtttgctctccattggtcccagcttttatctgcccagtaccagtttgaaaacaaccttcttgtcccaatcctgagagtatcctttcgaaagagtaagtcatggaaaaatgcgtggcaaacaacaacaatgccagcaccttctttctcctttcacaaggccacagagaccctcccccacagcccatctcttccagaggaagtctgcggccagccctgctccagacccctcccttgccagcccaggcccgtgaggctcctcagcccacgtccgcccttttctgtttacactgggagatgagcttctgccgagcttaagtgcagttctggcccttttgtttgtttttaagtcaagttacaactttgctcctggatttattgcaaattccatttatcttcttcttcccggggtctctgcacaaagcctttgtgtcttcctcttctgctgtggacagataccatggggcaccaggaaaggacggggagcacacagccccggggaggcgcactctaaggagggccaaagccattctgcggggtgctggggaggaagacaggggctggcaatgtaggaggaggggctgtcgattacccgggaggacaggcccggccctacatcgtgccccttctcacacaggcctccagaggaaagaagagccaggccgaaaggcaaagaaatcccagacctcaggggaaggaatcaagaaaagaaggttctggtttgagtggaaggagcccgtggcactttctagccaggggtggtatgaggccaaaggttctgagaggcctgagaaaggacacctaggtctgctgagggcggtaggcctgagggttgggcacagcgcgtgccatgagagaccaccccaggtgcagctgggcaccagcacagtctctcagcttccctgcccttctcttaggcctccccaaccctctccaaacaccacatttccagaaactgctgatgaagagcaaacaactccaaactgaagctcaccagggagagaaagagaatcaaactgagctgaacaaattgcgagtggggcgtccagctgtgctgttggcttgtctctctaagaggggaagtgctgagggcctgtcccccaccaccaccccgagtccttccctagtgagagttccctggcttgggagcacgcaggagatgctcggcttcagaggggccttgcttgagcgtggtgaggaagtcccggggctgtgaaagaggaaatgctggactctccctgcctaagggcctgacctagaatggggctttaacctccctggaggaggagagcagctgcaggtagctggcggctgcagagtactcctgggcaggctgtagggccatgggtcagtagctgaaggagccacctttcatgccctcccctcaccatcacagttcccgggcatgaaactcaggcatcagcacctcagcccaggccctcaaggagtggggttaagtgagcatgaacagagcaggccccctttgcctctgggagcctcctggcttcccaacaggtgctatcgctgaatgaagaggagggctgtccacagcagtttccccagccaaggctctgggctccagccctgctggtccctcttcctctgtcacccatcagctctgcagccggcccagatactcccttctccatgctgtggcccctcctccggggcccccacttctcaacctctgcactggtctatctgtcacttacctgcctggctccctcagacacctccagccatctaccctgagaccttggctgctgatgtccactctctggccgcagcttcctcccttcacctgttccttctcctgctgtcaccctggctcttgtgcccccgcctctccctctagaagcttccctgggctcccttgcccgcctgatctcaggcattcagcaccctcactctcaactttactcaggcctgccccgagggcccctcatggccatccactgcattcactccaaaccttcggctgccaggccccagaggaggtgcggctgcaggcccagcacaggctgagtctggctctcccctgaggccactgtcagtggccactgtcactctcctcagatgccccagatccccacctctaccttctacctgcagaatctctcagcacgccccttactgagcaggtccaggccttcccacagggcccctggagtctcctctcacccccctcagagctcactcactcacaccaccacccttccttccctcgagagcagaggatgtccccacctcctttgcaaaactaacttccatacctgggtgcaaatgcaacagctcctgtgtcttccacaccaagtggccgccgtcctcagcctggaccggaagctgtgtggcagcaggatctccagtgcttccagtgcacagccacaagcatggcgtcctcttccttgtcctaaaagggcttcccttagatggctttctctcagcacaccatctctgctcttgtcccccgtatcacacacttctcactgggtcctttcaccttcctcttctccagccctggccatcggctgctactgaaggccattctcagtggcccaggagccaaccccctagctgcctcctcagagtttctgggcttcccacccaccctttgcctcccctccatgggttctcctggtgacttcctgccaggcttccattttctctccatccccgtgctttttacctgctcctctgctggccgggcctcctctcccagcacatcgcttctgtctctctcctccgcgtccacatcttcagccagtgcttccatgagcccccgatttccagctccccagatccccacatttctaccggcctactctgctggccgtctctgcttagacaccctgcagaacttctcacgaaattgaactgatcttctcctccccaaacctctccttgaggctgtttgtctctttctgtatttctaccctccccactgcccaggctcaaaacccagcattctcttcatctctttcttctctgtctccctgcatgtctggtcagcctccggatgcctgaaggagcttctgctctatttttcagatccctcccactccggtgttgctatctgaattcaaaccctttccttctcctccctggaccttacctctcagcctttgggcctcgcttcccgtggtctccctgtccttggacacagagcccatcagagtggcctgtctccctttcagaaacccatatgagctccacatgcatgtggctcccctgccaggaacaggcctccctgtcctcccgtacaacctcactgccgccacttgtcactcagcagatgttgcctgagtccctgccatgtgatatgtacctgtgctcacaccatagccacctgctgctcactcccagaactgaccctctgcacctacccagtcttctggtccctctttttgttcgcctgttttatcttccagagacacctcctgttctttacatccatttccacccatcagcaccttattcaatcgtactcaaggcctacctcctccaaaggtgaaaccaatttctctcctgcctcattttcccttaaaatactgttcattccctattataaccacatctgaatgtatatgtgtgtgtgtgtgtgtgtgtgtgtgtgtgtgtgtgtgtgtgtcatctccctagttgtgtaaccctgcaggccatgaacagttattattcaatgttgtttcctacacatctttaataaaagtttgttgcatttaaatctgatcttattctctcatttcacagttgttagaactgtggccagagtcagccccaggtcagaatgctggtcagcagcagactcacatcccagccctaccttcctgatacctgatgtggtgctcagaaaaacaaggaatcccaggctgttacccagtgtctccatgtgccctccacagatgcactcaactgtcctctcttctgctcttcctcctacaaactgggcaactggaatcagaacagagactttggatgagcatccagtgtaacccagcctagtttttcaccacgacttccagatctacatttaacatccgacagcaactataattctactttctgaacctccagggaagttgcttccttgtccctttcagcaaaggatgtcatggttttacaatgtctccagtgaaaaagttcttcttctctacatcttcctcccactcctacaacccttgatccccacgtgagatctcatttcctccagctgggtcttctgcagagtgattagagcttctgccctccttgcagcatctctattgtaaaaggattgctgaagcttattaagccttgcagctcctaggaggaaaggtaccatatagaaataaaacaaatcaacaaattagtgtgttttgtagaagttgaataggactccacctatctgcatgagtgtgcacactgtgcagtcgcacaggcagtctcaaatgggaatttggaaaaagctaagctttttcacttgagaaaggtttacatattctttgcacctgggcacacacagcacaggctgttctcaggactcccaccagattaggcctgggacatgacagagcctgtcaggtccacgtttgctttccagtctccttgcttccagtctagctgtggcctgactccaagtccagtgtaagatttttttttttcagcaataaggaatcggttcattcacctgtacgaaaaccagtgggaggatcatgcataaggctcatatccttgctgtgaatttcaaaggactggctaagtaaataaaattatcatgccaacctgagctggtatagattgcattgattgctgctaatagccaaaatggacattttaaaagtgctctacactgcattctacacaacttgggacagaaaaatagctgttgctcttaaggagctgatggtctccttcaagggtaagctggaacaggctgacccaggaaaaggcactcccagttgaatgctttcacttgcgtgggaagtccagctgtctcaatggggcccaggagacagactgacgagggacgaattcctgtgtttgggactgggcttgaaaagtctcctgtttgtaacactcaacttgtagaagagcagaaagaatttccagctgtcgacaggatgaggggagccctcctgattctgtctggggatgtgtttgcactccagaatctgctatccttcctcttgctatccttcccggctaccacatgaaacacctggtcctatgggccagctctggaacaagatgactctttgccatcaaggaatacaagtggccaaaggacaaatattgtgtgattccacttacatgaggtacctagaggagtcaaattcacagagacagaaagtagagtggtgattaccagaggttggggtggagagaggggaacggggagttaatgttttatggatacaaagtttctgtttttcaagatgaagaagttgtggagatagataatggtgatggctggacatcagtgagaatgtacttaacacccctaaacagtacagttaaaaatggttacagtgataaattttatgttacgtatatttgaccataaaaaggaaggaaaaaaggaaagaaggaaggaagggagggaaggaaggagggagaggggaagggaggaagggggagggagagagggaggaaggaaatgcaagtgggaactcagccctggtcagagcactgctgggaaaagataggtgactctttatcttgctgtaaagagaggtgtgtttgtgtgtgtgtgtccctgcaggagtgaaaatggacccacaaaccacatggttaatgaggtgagcatactggaccaagctatttaacatctgggcctgccccatgactaatagtccaggtcattctgcataatgcagaccaatataagattgttagtggaggccaggcgtggtggctcacgcctgtaatcccagcactttgggaggccaaggtgggcagatcacctgaggtcaggagttcaagaccagcctgcccaacatggtgaaaccctgtctatactaataatacaaaacaattagccaggcatggtgactcacgcctgtaatcccagctacttgggaggctgagacaggagaattgcttgaacccaggaggtggaggttgcagtgagccaagatcacaccattgcactccagcctgggcaacaatagcaaaactctgtctcaaaaaaaaaaagattgttagtggaagttgttctttttttctttttttttttttgagatggagtctcactctgtcacccaggctggagtgcagtggcacgatctcagctcactgcaagttctgcctcccaggttcatgccattctcctgcctcagcttcctgagtagctgggactacaggagcccaccaccacacccggctagtttttttgtatttttagtagagatggggtttcaccgtgttagccaggatggtctcgatctcctgactttgtgatccacccgccttgacctcccaaagtgctgggattacaggcgtgagccaccctgcctggccagaagttgttccttaaatggctaagagccttcataatattcttgggagggcgagtggcagcccatttctccataacttgctcagaagcacattttagttgttttaagaatgactcgatttttggagtcagagaggttggggctagagtttagggcctgctgttgtgtggccattcagaacgcccaatttaaatctaaatgcgtaaaatcaaaagagtggtgaatgtgaacatgcttttttataaactgtaaagtgcctcactgtgatcctttattctttcaattcagcctatgagtgcaagttagcaatagactttaaagaactcatactgcaggaaagtaagcatagatactaaaatacaaaattcaacctctactgcctatgacacgatttttcaggcctcagaggcagcctggtagcaaccacagctaagaacaaaggtcctaagagctggactttttgaaaaaatagattctgtagcctttgtagggaggagttggtctgagttgaaccatattgctgagaagagtctctcattaagcctttatccattatcaacactggggcataaaatcatttataccaaatacttatttttttaattgagatataattgacataccataaaattcaccctcttaaagtgtacaattccatgatttttagtatattcacaaaattgtgcaattatcaccattatctagttccgaatattttcatcacccccaaaagagtctccatatgcattggcagtcactccccattcctccttcccctttcctctggcaaccactattctactatccatctctatggatttgcttattctggacatttcatataaatggaattatacaatatgtgaccttttgtgtttggcttctttcagtgagcatagtgttttcaaggttcatccatgttgtagcatgtattggaatgtcatttgttttcatagctgaataatattccatggtatggataaaccacattttgtttatctgttcatcagttgatgcacatttgagttgtttccactttctggctaaaatgaataatgctgctatgaacattcatatacagtgtgtgtggacatggattttcaatactcttgggtacatacctaggagtagaaatgctagtcatatgagcaattgacctagctttcttggagtgcactggcatgatctcagctcactgcaacctccgcctcctgggttcaagcgattctcctgcctcagcctcccaagtagctgggactacagctgcatgccaccaggcccagctaatttttgtatttttggtagagatgggatttcaccatgttggccaagatggtctcgatctcttgaccttgtgatccacccgccttggcctcccaaagtgctgggatcatctgtatccttactggtttactgatttttctgactatttgttttattaattcttgagagaggaatgatgaaatgtatatattcaaactatgactgtggttttgtctatttcctctttaacttttgtcagtttttgattcatatattatgaagttctgttagcaggtacagaaacatttagaattgttaaatcttcttaaatttttcttttttttttttgagacggagtctcgctctgtcgcccaggctggagtgcagtggcgtgatatctgctcactgcaagctctgcctcccgggttcacaccattctcctgcttcagcctcccgagtagctgggactacaggcgtccaccacaacgcccagctaattttttgtatttttattagagatggggtttcactgtgttagccaggatggtctcgatgtcctgacctcatgatctgcctgcctcagcctcccaaagtgctgggattacaggcgtgagccactgcacctggcttaaattttcctttttgtcactatgaaattgtctctctttatctctggtgctattccttgtcctaaagtcttctttttttattattaatatagctactccagctctcttgtgataagcattgcacagcatatcttttttcattcttttacttttaaactatttgtgtttttatatttaaaatgaatttcttgctttttaaatccagtctgatagtgcctgacctttaattggggtatttggaccatttgcatttaattacaagtacatgtaacatacatgtttggtttaggtatgtcatcttactatttgttttctactcattccatctgttctttgttaccttttgcatctttccttgccttcttttgaagtgagggttcttttttgttatttcattttatctagaccattgacttttagctacatgctcttgtcctttgtgctattgctgctataaattttatttctgcatatgttatgaactctacagtactttattatttttgctttaatattttaaagaaatttttaatgaaaaattttaatatttatcctcatgtttcccatttctggtgctcttcattcttttgtgtagatccaagtattattttccttctttgtaaaaaacttatgttaacatttctttagggtagatctgctgatggtgaattgtctaagctttcatttatctcaaaaagtcttcattatatcgctggatacagaatttgatttgtgtatcattcagtatatcaaagaaagtattccattgtcttctggcttgcattgttttgatcagaagtctgcagtatttcctatactctctatgacactataaaatacagcttttttcagactacttttaagattttctctttattactaattttagtaatttattatgatgtactttggtatgatggtgtgatttcccttgcttattttgattggggttcattgtgattcctggatctgtggtatttatagtttttaacaaatttggaaaattttcagccttgatttttgtcaaaaatttgttctccctcttttttctttttcaattatacatatgttagaccacttgatattgctcaaggattgatgggactttgttcatttctgggttttttgttttgttttgttttgtttttgaagtcttcttcctcttggtgcttcattttggatagttcctattgctgttttcagttttacttttctccttgtagcatctagtttgctttgaatttcagccactgacctttcatttcagatattgtcttttccaccacaagaagtgcattctttcctcattttatgtatgtttttcttaaaatcctggagtatattttgcctacttaaacagctgttttaacgtgcctgtctgttcattctgtcttttcaactctgtcattttcaggcatgtttctattaattgccttttttcctgatatgggtcacatttttctgctacctggtgagtctagtaatttttgcttagatgttggatattttaaaggttacattgttgaatgtttgtatatttttaaatcctcctttaaggagtattgagtttttatccagcaggcagttacttatggataagattattcctttagaggcttgtttttagctttgttagaatgaacctaacgtttcttttattctagggatagttcagtcttactatctgcatatgaacctcattggatctctactaaatgccccagctgatcaagctggttgatatttttacatctcagaatcccatgtgaactctgaaattttcagcttatagcttctggtcattctttgcccagacttacaaagcttcactctgggtatgaacatcttagtattaagcactcaacagggcacttgtgcagatttctggagctttttttacatggtcccctcttttctagaattctgccccacagtttccaactacagtctccttgaccttcatttctgtattttaacttaacaagactaccatactgtgcttgggatattgtttcccctgctgtaaagtccagaatgtgcctccaatcagaaactgtcatgatcatttaccacatgtattttctttatctcatgggtcatagttctgcactgtgtgttgtacaatatctgaagccgtcagtacatttattttgttgttttctagttttggtagagacagggtttcaccatgttggccaggccaacctctatatttttcatccaggcctgcggggtcatcctctttggcttcaaatcccaagggatacagggggagggtaaatctggatcctgttgctttgtcatggccagaagcaaaaatcttaagaacaggttttgataaagaaatgatgaatgatagcaggcaggcccagaaactagacctgataacctggctgggggttccaagatataaggaagcagcagaaaaactctagcatctgcaagccatgcaggaacaggtatggcaatggagacagaggcaaaaaattttggaaattactacaaacaaatctcatctgtgttcccaggtggctggctatcttacatttgctctccagattcactcgccaccctttggcctgtcaacctgtctagattgcatcaatggggcaccattgacctctagtttctagttgtgctcaggcaaaaagagacacaaacaggaaactacaagacagaaaggatgtttattcccctagatcctttcctgtcaaatcactgtgaattagttttgcccctctaccaaaagttgcactgtcaccatcctattgggaggccctctccttacaggtactctctgtggattctcctaactattccttcctcttgaccctttggatttagggagggtaatgcctcttcaatgtgattaagcttaaagtattgcaccttcctttgttagttcccctaaatcctgtccatagcttgataaataatcccttcattaaattctcctctttttccccaccagaattctaactgatactacagggttgttgatgctgcctctaaatgtaaaccatctactgcccagtaattgtaagaccataggcagatcactttactgactctagcctcagtttgcccttagcctagccctgacaacttgagcctagccctgactacttgagaaactcaaattcaggaggctgtaccataacagcagacctgaggaaagaagtgccccctccaccttccctacctttttttttcttttgtcccccattcttagaattcctagctcagctgctctgcttcacaggctaacccaagtcttttcctctaggtcttagccacagatatagcctggtcagtgctaagagaggaggaggccagataaagaccactcacgtagagacaactatcatttggggatcatgctcaaggtcaagttcacacaagcaactcagcttttaaccctagccagtagggcttaacacacaagggactcttttccctcctgacacatgctccctggagaagatttatttttttattttttaactagaaagacaaatcaatagaatgagtaaattaaaaagttaaaaggctgggcgtggtggctcacgcctgtaatcccagcactttgggaggctgaggtgggtggatcacgaggtccagagatcgagaccatcctcgctaacacggtgaaaccccatctctactaaaaatacaaaaaaattatccaggcgcctgtagtcccagctactcaggaggctgaggcaggagaatggcgtgaacctgggaggtggagcttgcagtgagtgagatcgcaccactgcattccagcctgggtgacagagtgagactccatctcaaaaaaaaaaagaaaaaaaaaagttaaaagatagagattttaaataaagaaggaaaagtcatgagttttaaaaggttagtcctaaggtcaaggaagcaagttagacagagtcatttactgcagcctcccccaggctgaagcacatttagaaatggaaaccaaaggtatggtggaaggaatccatgagcaggaggagtcaaagagttggtgacagtctactctgaaagacattaggccacaacgaacatataacctctcaggcaaacatccccagatccctgtcctaagaaagggaaaatgaaatggtctcccacctttctgtgaaaacccattaaacgtacttgccttcctgaggaggttattttctgcatagtgcaccttttctgtcttctccttaatcaaagggacacttaagtccccttttgaggcttctaatgtggcaagcctattcagtctccaaggttgatgtttttcctagactttcacttgatccttgccccaaatataatgtacctttcccctacccatgttgtgactcagtaccaaagcctccagggccactaccccggggttagcctctctctctctccctttccttccaggagtctttccaagatctgaggtaagattgatgcttctctgggaatcagacctccttacccttcctcttgcataggcttaaacatgatattgcatctttcttttagagaaaaagtctatattttcttgttatttattatcattaaaggcaatacaggcttacccaagaactaggcaggttattggactggatctacccaggagtccagagattcccaagtgagtcagcagacgcctgagatagtaggggcctaagaatagcaaccttccctacagcctctgcgtgaccccttctgacctgtccccaccatgggtagctgttgtaatctgactcactgtgtccctccagacagctctggtttctgataagaaccttccatgaaagaagagccttgctcacttctgcactagctgctcacattattggttcaaggcttagagagtatagtcctttgacccctaacccttgatcctggccccagtgaactattcctactgggcataggaagaaatgcctatacctgacattttttactgaagggagagcagagacaatctacccaatgatttgctattgttaattaataccccaaatccctaagtaggagtgactgaaaggcttaaggccctttaactcttcctattctcaagtgaatctaaagtttattttccctatatcctttaatcatgtttcaggtcctcacctgtctgtccacagcctgaatacaattggtctgggatgggatttggaaaaagcagacacaatgccttgtagttgatgagtggcagctcgggagtttctgtaaaggagaacctatggatggaatattggctgatacaggagccagggggttttcatcaggctgttttgtatagtaaacactctatttttccacttagattgcatgtttatttacttagaaagactttaggggaagccaatggagactggaggggacggggcaaggccctcccaaaccactccttggcaatccctgcctaagatggcttaacccctcattggattctctcacttctcacttatttttccttcctttatcattcattcaatcctgggaataccacgcttattgtttcattcatccatccacccacctgtccatgcatccatccatccattcatgatggcagctccttctcaatggaaagcaaaagccccttgccagagagaacctctatatttttcatccaggcctgtggggtcatcctctttggcttcaaatgccaagtgatgcccaagggtgctgatggtgtcactgcacttctccacagccacctttcttctcttgccattctctcccactcctttctcctctactcttaagttccttttttctctccttttcctttctccactgtctatgctttaggcctacccaagccactgtggatattttgtagccattcaaaactaaaaagggcagctgagcccaattccagaagagttgatagctcctggctcctggatcctccatgacttcagctacccgctgtttccctggggcagagctaagctggacttctccttactggcccccagggtctgggctaaggccacattggggccccaaggacatcaagtcttcaggctggagctttctcctacgggagaaaaaaataagctcccaaagcagaaaaagttgtcttttctcctgttgctattggaaacataacaacaaagccaagatgtagtggcttagcaagaataaaacaagctgtcagcagccagggcccagctgatctcctcagtggtgacgtgggttctgtgcacagtgacaatgagtgtaattgaacccagagctttggggtgcaggaggcaggccaagcagccccaacgccactcccctttcccatgtcactcatgcctctggttgggggtggcagatgggtcagcacaggcccacagagggttcctcttcatgtctttacttctctcctaaagagggataagcctggaacctgggcacctggaatgactgggcaagcatgcctctaacctggcctccattcctgagctccagttaccctgttaccatccagccccatctgttctagagtcactgcctttaggctggagggaccttggcaatcgtctggtcctggctgtctcaggagcagaatcctcacttgggattagacccttcacagacgccagatgctctaagtacaggggcatcatggaggaggagccattctgacttccagtatacttgatgaggaacaactgattcagtcaacccatatcatcttgggtcaggattggtgctgattcattttgattcctgcaggcatggtctctctcctcctgaagctgagtctagtggggaagacaaatatggatcaagtaattaaagcgggaggctgtttaccaaaagggagttcttaggaggtcacaagtctaggaagagggtggtcacggaaggcctttctgaggtgatggcatttaaattaaaggcaagagtgcatttctgtcactcacttcctcacccccagagcctaacacagggctggcacatggtagatactcagttgtttcatgaatgaatgaatgaatgggcaatgaacaaatatctctacatttcctgatagcccttggtgacttacaggatttgatgctgggtctattaatgtatccatttacaaaaaaaaaaaaaaaaaaaactggatgtcacgattcctcctgagggctatttgtgttatggacgtgctatgtgctgttcattcaattttagaggtgtttatgctgggtcacagctggggaaaacgatacccctgagatcccgcagggagtcttctagactcgccccctcctgacaccctcagactgcaccatggagaactctgtaaattaattcatcaaagtgaggaaggcaggccccttgacaggtgactggattcagatctgaaagcggagacaggttaatacttcctgtgcccagatgtcctaaccacagacccaagctcacgggaggcaaggggagaatagcaccacggacctaccttctttttctcataagagggtgaagggttcttggaaattcccctaaagcattcaaatgagcaaatccagggctgtttgctgtcaggtttctgggcaggattatgggcagactgaccagctgttccctcccccaggactgccttaatttccaagccctacttctcagtcccagggaaagttggcccagctataaaatgccctgaaactctcccagaactcaaaacatacccacagtacggtgtcactcttggggaacctgtccgtaatgaacagcaacaagcatcttctttcccttccctctccaacacgcacctttccaagaagagaaatgagagctagtgacattgagtataggcaaggccaccacatatagtttcacaggctgttcactgcaaaaggccaacatgcatagaaggcagatgggggctgaaattcagcctgcactcatcctgccaagctgtgccctggcatggctgtatccacaaagaggaaggggtgccttttctaacttgtacataggtgccatatgggctagtagtgaccctgggtggagagcccaaagagtgacatctggggaggaaaataagccaatcattcccttgctaccacctaaacattctagccaggtgttcctcaagtgatcagatatgctaataaggcagacttcttagaaggtaatagaatatgatggataaaccagtagggccggtaaggctttgtgttttatttttctatgtcttgaattcacatgacagtgaaaatcaaactactgagatgtactagggaaagatcaaatgtcttctttctgttaaactgcttttagggagagtaaagatttgcagtgagtataacccctctgggttggaaacaccaggagtctggaatgtagcccaaacactgggctctagctttgcttaccttgagccttttggtcaggaagggggcctctgaaagacgaggggaagtcggcattttctcaagagaacaacctcccctgtggaggtccaggcatctcaccagagaacacatctcatactcaggatgattagctcttggtttcgtctgaatggtggcataatatggatgtgttgcttagaaaagaatctgatttcagcacatgtttgatgggtgtagaaccaagggctgtggtcccctttgccgatcactttacattgtggggatatttggaaaaggcaactcatacttaggggcaagggcagtcaccccctctcagaaatacgtccccagcatgatatcctttgttatctgcccatatgcccagtctaaagggggctatggttctggggaagctaagagggaaggtgggcagggagtgaggcctgccaatcacagctctcctagcacttccgggccctcgatatgccagagcatgaagtggggtcaagggatggaactgaaatgcttcctgagactctgggatccccctaaccgcagttccctaccctcataattccaaatcctctgtggctcttggaccaggcaattacctgggaaccacctctggactggccagagggaagcccaagcttctcctaagtttcaggaagagaagcctaggttctcggtgctgttgaaactcagcgcatgcgtgggcagttcaggaaagtcagaccaatgtcatatgactcctgcgcgatcctctcaggaaacagggccccaggcaatttcgttcctaagtgagacttcttccctcatcatcccttttgttttttctaagcaaaagttacttggaccttgcagataatttcatatccagagccctcccatgcctcgtgggagtacataggataggagccggtggttccgaagcgcctgcaggtgccacacatggagctaaggggtcactttgccaggaggatcttatgaaatcctcagacaaccctgagatgaagaactgttactgttcttatttttactgataagatgctaaaggttcagagagtttaagtagcttgcacgaggtcacacagccaataagtggtggagctgggacctggactagtcccagccctagtgcccacactcataccaccttatagcatgggaattccaggtctttcacaaagttggaagactgggatataatgaggagggaaggccatagctcccctacacccatggtcagccaagctctgcccatgtcgtgagatgtgtatcggagctacaactcctccaggcattttacctgagagcagggactctgtctcccttgaacttttctgcatacgctgtgcctcaagccaggcctgattcacaaaataatgtttattggcagaatgaaggaccgcctcccaagctgccctcatcctgcttttctcctccctctctcctaagctctgagtagacactgggctcgccaggctttctatttttatttattttttatgaaacagggtctcactctgttgcccaggctgtagtgcagtggtgcaaacatagctcactgcagcctcgacctcccagacccaagccatcctccctctttggcctcccgagtagctgggcccacagaaggcagggttcctgcacaggcaccaggttctactcaagctgacctatgttcccacttctgaccctagcatgttaaacatccatgtccctagatgggcagatgggggaggtcttgaacatgtgtccttcctacaatgggttctcagctgctcctggtatctctatgaatgggttctgaaggttttctctcatccacacagttttagctcttctttgggtttccagggctgccccgcaagaagcaaatctaagcaggaggttagcaactgcgttcttggccctggtctccttcccctgagtggccacagtgtgggtgaggttcagactcccccatggtgtggctggctcctgggtgggcccaaatagcatgttcatcagttatcaaatgtcaaagatcagaagccaagccatataaacacctcaagatgctgttccagcagttatcccccgtatttatccactggaacagcttgacaaatctgtcagtgctaaggagggtaggaatcaaatcatataggtccctatcttcaaggtgtccaccatcgggctgaggaggcttatatacatggcacagttagtgagcagtgcaaggtttgtgtggtgcagtgtgccaggcacagctcagaaagcagggatggtgttggtgggatgcaggggcaaaaaatcctgataaataaagcctttcaaagtagctgagctatcaggaggtcctctcctatcttccataccccatctagcatttcattcctcttgaactacctactgctacacaacagacactctaaaacttagtgtctcaaaacaatgcatttttatctctcacatctctgttgactgggctcagctcactcaggatgtcttgcagttggaacggctagggctgaaatcatctgaaggttctactgagctggacatccaaggtcaccatcactcactcacatggctggcagtgatgctgaatgttggctgagagctcagctggggctcttgactgcagcaactatttctggcctcactctgtggcttggacttctcacaggatggtggctgatttctagagcaagtgtcccatattgaaggttctaagagatccaggcagatattgcaaagcttcttacaaccaagccttggaagttccagaatgttgctcctagcatattctgttggtcaagcaagtcactataggtagaccagatttaagaggtgagaagcagctcatgaatctgaggagggaaagaactaaaggctgccatcttggagactgtctattacagcttcctttatataaagataacatgcctttgttgaaccgagacagaaaatgaactctcaactgggaaaggaaaaagaatctgtccctgtgtctagaagaaggtacttcttcaagtcccaccccagcctgttttcttacctcataccccaaggtacattctttgactatgtcctaggcccagaattctggagtcagaatgcggaagagagtggaaaaaaccacttacatcatcctaactaaccagcccacatttaagaatgagattgctacgtgactgttgccatgaaattgtttatctgcccttgctgcagtgtggcctttaagggacacaatctggtgccaatgatgtcccagcagcagttgccatggagacctggaggtcaaggttggtaagggagcttcttgccaagatgatgtcacataaaaatccctttgctttcttgtgaccaccaggttattcagctatgaaggaaaaagaaagccataaattcctcagatgtgtgtccacagttggagcagggtgggctactgcagactcctagcatacaagtcacgagacctcctttgagtccttgcactccccctgacttgtctgatgggggagatccatctaacctcactggacatgctccaggagccgcgtttggaaggctgtgaaatcatctggttgggactgcctttctcacccatctgaataattcaagcacaataactcacttctaagcctgccgttggcttcccacagcctctgtctgccagtccccattacctatggggtgcaatcactgtccatataaagcagaactggggtactttgcacatgccacctccccccaactcactcctagtctaccctacttcagaaaccttatctccttccccaacaacacaatgtatttaaatagctactaatttcctcttctttctttcttctgcataaaatttcattaattatacatttcttggttcatgacacaatgtcatctttgtaccatgcacacttcacttgtatttagctattcagttatttttttttaaataaacaccatccagtcagcccacaacccaaaacaaaagccaggcccttgacgacaaccagtatgtcttccaaattccaagtgacagtgaacagaaaaatgaaagagccgttcacccagcataaacaaggcggaagaagcccacgcctatcaaaagtttccatcttctagcatccgaagatggcgcatcttccaaatgtcttggtttttacatgacccaagtgtcccagtctttccagtcattgaaaatttgggttctcaagtggtgtatcattttatcttgagctgtgtgtcctatagaaacatggaagatgactatttcttttttcggctaaacatgcagcagccagcagactagagccagcttctgcctcgggccgccccggggcgcgggatgggaaggggttaacgcagcgccccgcttacctggggtaaaagccggcacagaacccgagcgcacaggtcgccgcgcgcatgcgcactctcctggcccagcacagtgcttgggggccggcggctcccagctcccgggccgccctgctgcacaaaggcctgctttgttctctcggctctgttttaaatatctgacgaatattccccccatccctgctccaaatccccggcctgacggcaggcgcggcacaacggcgcattgtggggccaagcgaggggcgaagggggctgggggtggccggcgcgatggggacgctccggttgcgccaagttgactctgccgtttgggtcacctgggctgagtcgcgggcgtggaggcagagggtagggggtgaggaggtgtttcttgtcttcttcttccaatctcagaagtaaacattggaaagtggggcccccagcagtgtacagcccgtttccaaaccaggcctgtaaggaggagctgaggtttcggctgagcccccagcctcccccgaccgcacagcctcgggcatgaacccgcgaagccagacgcttagttgcttatcaggccatcgctgtacatatttagaaagtacctatcactcagacactttgaaaagcgtggcgttccagcgcaaaccaacccgaacgggttggaagggggcagtcctttcttcccgcaagttcggggctcgagagacggctgcaggaaggccatcacccctggcttcctgcagccacagcttccagccccacacgatgcccaacttcattttagcagtggcccccaggggaaatcacaccattcttggttttgtccctccctcctgaggttgggacattgttcaaacaaaagtaagccttcagctgacagagaagctgccccgcctcttccctgcccttgtcttgctggcattcattgggactaccaggtagctttccttcccagctcaggtgtttacctgctgctgcagaggaggagtttttgcattgtctccagggggtttgcaaaataagaaccccaaaacccacctctctttcccattttcttctttaaaggtagagaaagcactgcatttcacattgggtcttggaaacccaaagctagacacaaaatgtgggcgttagcagctctgaaaagtgtgtgcttggtcttaacgtttattcttaaaaaggaggtgttcataccccagcttgcgaacaaagctttcataccctcagcatcttgaagggaaattgctgcccttccatccagggcaggtgaaggaggaactggcttgggagggttggattcagaagcaaatagctttatcgttttgtgatgcctgtttgaggcctgactgggagcccaggagtcctccttctgtggtagtttgttataaatcccagggtcggacttacattccccagctgcaaaaagcatacatacgtcctaagatatttatttttaatcatactttataattttcacatttcacatattgttacatttcaccaatactctaatacttgagtattaaagctaatccaccatagaccaacagtctaactttgcaaatgaaggaacttgtccagagccattcagaaagacagggcagaggcgagcctggaggccaagcctcctgtccctatgaccaggtttggtcccttctaacatgctagtcatgaactaaaagaccaggtttcctaccacttctcacaaaattcttatcacgtcagggaggattctgactccacagtaagaagctttggaaaaaggtttttggtattcaggtagctttgaggagagggagtctcttctcagtacagcccctaggaatgccgagtttgccaggactgtgctcacaagcttagagacgtaagtcacgttccattgcctgggttgctaagtggcagagaaatcctgggtgtttgtttccaggcactcttgagcctccggaggaatttcttcaagcaacactaactgtcctttcaccactctgttggccagtgaaccccctatctctgtagatgacagcagcccgctctttctcccccactagtccccctgcagcaggtcagcctggagccacatctgggaaggtgtgacctagaacttgacctccttccctgatgagtatgcagaatctccccagctataaaatagcatggccgtccctaccccaccccccatgcacctccggacttggagacattggaaggtttacttcagcacatttgtgatgcgatactagctgcttggagagaaaccttcaccagcagcctcatcctatagcagtgcctgcccatctgggcaggaggtgccagggtttatactcccctgagcttcagagggtgggatcgttccagacaaccttcggccggtaacttctacgggcacatcctttttttcgtatgttctacattgacccataccaccaccaccattccaaccccttgaaccaacccctggtttcaagctctcccaggctggcagatgaaggaacatttcaaagccatcacgtggtaatactgcctgctggccaacaactccatttcaacagcgtcacctttggactgttcagcagtgtttgtgcaagtatttgaatattttctggcattttggccctattattttataataataagtggaaatggaaaaatgaagtgctgattctcatgataagaagggcaggtctcacagagctcatataattgaggcaaagatggaaatcattaggcacgctgaaagtgggattatgtagcctcaatcaaatgctcactggagttaagcctgtcaactatgtgtccaattgttaaaaaaaaatgaatacaattagggagcatatatgaaattctggacgtatatggtcaaagactgtgtctaaaaggcgggtgtagttgggatatactggattccctcaattctaaagctgcattgatttaatagcagttttccaggactgggttgggaagacactgtgagaccagaaatcaggaaaatacagtgataatattgtttcacttcctgggaacagaaccgtccctcataacatgcaagtgtactgcttgcccctggcatggtggaccagagggttttcaggacagtattagggtatgggaggagggagtggcctggagattgatcccttggggagtcactacagctcggaagccggggacaggcctttagttaatgtgctagaatggatggaacttgactcaagagaggccctcatgccacaaggttttgaatctcccatgtgcccggcatatagaaaatttagggagttaaaagcaaagagtataaggtgcaccttttcctctttgggcactcgtccctttaccactgtcccagctctccctgggggccatgctgtcactggcagcctttgcacggtctgttccctctgctgggagtgtctgtcctacctccttggctgcctggccagctctggctcacccttgaagacgccgctcaggctcctgcctccccaggctccagtgtctgtgtgtgcgctgcgtgctggccatccacctcatattcttgctctgtccacactgtataaccatcactggctggcctgggagagtttgaagatgagatttcttgttcatctttcgatcctctgcatcccaggagccctcagtgagggtttactgagtgaagcaggccaggaaggaatgctgcgttctcaggaagacctcttcagcaaaacactgttgacctttgcctttgcatcatgcgccaggcatgacctagcacagccattttaaacctctgagacaccaagaaactctttctttcttctccagaagccaaaccatttgtttctaaattccgctttctttgcctccgaggccccctcatctggagccttcttgcccatctagtgtctggagcttcacatcctccgggaggttctttactgatactttcagtaagtaaagccactgacttttccttcagctgtggggtgctcgctgaattcttaccacttcttcagggaaaaacaacctagaagcactctctgatccaaagtgtttctcagggagagcggccaagtgagcacaggagccgctcggccgtctgggactgtgatgtgatgtctgaacagcctctttagaaacactgcagccttttccagggatgccatccagacggggacatccctcacaagttgtctagggtcctggggatggaggccgggagctccggatcgagggatttagccttatggggcctggttggccccgccaggccagctgtgaatgaggagggtgtctgagctctgttttgcacccgtccactcaccaacttattcttgacctaacacaccatgcccctgctgcccttggctgtgacgatgggaagcaactgtccaaaaagcctgaggggagccagctccaacaaacccaccgttggcccaccatgcccaccctactcagcgcaatgaccagtgggtctttatgttttacagtcagggccttgctctgttgcccaggctggagtgcagtggtacgatcacagctcactgcagccttgaccacccaggctcaagtgatcctcccaccccagcctcctgagtagctggtactgtaagcacacaccaccatgcccagctaattttttcttttttctttttctttttctttttttttttttttttttttttttttttttggagagaggggttctcaccatcttgcccaggctggtcttgaacacatgggctcaagtgatcctcctgtcttggcctcccaaagtgctgaagtgctgggattataggcatgagccaccacacccagccctgggcctctttttgaggacaccaatgccattgcctcctggctaaactgctctccacacaagttagttccacagactctccaggtccttgggaccccatgaaactctctggggctgtgcccagagtccacttgacagaaacctgattcttttcctgtgaggcaaacagctgtgatcgggacatgtctgtcaggggatgacttggcagagctacaacgccaaggctcggatgcatattttttatgtgatttcttaaaattcaagcaggagaatacgccttcccccaaacggctggctcccccactgcattcgcattccccccacgatgtataacaggagtccgcagcccacccctggagaggacaaggctgtaattcagcaaggctccagtgacatcctgaccgtgagagtgcagctggggcagtttatgaacagtgctctagtccctgggggaagttagctctgttctccagcccacaagagtctattgttcgctttcttgtttttctccaaatgtttagatgtgctcagagcacagaaaagcccgaaacccaggccaccagccagggcgatcctgaagcagggaagcctgtgggctggagctcgtggggctacccccacccacacacacccattgttgttcctacctcgccctaagatgtgaccgtcctggaggacagaggtaagggagtggcctctttttggccagggctgtttggacaacagtgggcttggattgttccagcaagtgaggtatgagaccacagctcaggctcacttgggtggtagccagaagcaactgcccaagttaccttgggcccatccaaaatgtgcacagagagagtttggcaactgtcttccagttgcttgtcactgaccaagactgctgaagtttgacaggaataagcaagttctggcctcctgtctgcatcaagaatctgggctccaaggtacagcctcttgagttggactcctgccatcagctcttcctaactgtgcaaacttgggcaagttacttagcctctctgagcctcagtttcctcctgggtaaaatggcacctacctcgtagagttactgaggattcaacaaggtaatcaaggtaagcactcgcacagaatgagccctcaatacatactggttattctttgtattattactgttatcaatgattactagtacaccatcccaaagtcacctcctctgcttagagcatccatttttgtacctaaaccgaatgccttcaacagtctccagttgtgggtcagagaacagctgtgcaagaacggcaatgccagaggaatgaaggatgaagtgccttgtgatgtggggaggagagaacgtgctcaaaagcccgtcgcctttgcctcccactccccttagccccagatccctttctccagggctcatattacctgccctcccccagtggctgggattctcagcctgccactggctccacagtccctacagagccaccgaaaccctcccacccctgcctggaaaatgcctctcccccgtataccaccttggcggccaccactagtcagccagtaatggggtgggggtgagacggaggtggagcctctggaaatggtgctagatcaagggagaaggagatccaggaccccaactccgtaggcctgggatgctgagtacagtttagagattggggattcatttacaccagcttggggggctttggtgtgaagggagatggacagagtatgagggaggaggaaaaggtagagggtagaggaatgcatcctgaatcctagtcctttctgactgggacagttcacatccataaacgaggctctggggcctgcctcaagaaatggaactatgatgatccccctttggatgcattaatcctttcaaaaataagactctgggagcctccggtgacagggccatatggtttccttatcttccttatcttccagcactcaccttccatttggaatgtttatcccaagataatgatcagattccacttagggtgattgaatgggggcctctgagtatccccccctcaatttcaaatgaatgggtgatccgatccaataatagatgagcctaacagtctcctgctaatggatggggctcctcagccccatgccatgcacccccaacttccttttcctgcaaatatccacccccttcaacctgggcaactccacttttacctgctttatatagtggagggtgctctgtgtaaaatttctagtgagccaaatggaactgctttaaactatgtttaaaaaccagagatgtgatgctaactcagcgattttcaatagaaatgtaatgcaagccacaaatgcaagctacacgtgtcattttaaattttctgatagccacacatctgtaaaaataaacagatgaaattaattttaaggatatattttatttgaaatctaatttatatcatagttatttaatataattaatatatactatattttattaaaccccaaaatattttaacttgttaccaatataaaaattatttgtgaggtatttcaccttcacttctttgtacttagtcttcaatatccagagtatatattgattctgactagccacatttcaaatgctcagttgcccctgggctagtggctattgtattagatagggcagatctagacagaccacactaagaacctagggcaaggacaaactctgatgggcatagttgagctggctgctagagagagaccctttgagaagaagagcaatttacaactttgctctgagtctaagtggagatctagccatcatcttgctacctctccttgcctttcccctcccagggaggaaaacacataggacacagcatttttttttttaagtgatagcagttttaattgctactaatttaatggcagtcatttcacctgctaataaaattgtccattgaggcctccagccgtgagtgcttttttccatggactgtttaaaagtgaagctaatgctgattgtcaccaaacatccatgtcatggatccactgtactttgtctgaagaaggggaggcccgactggggtagacagagtcagctttgggtgatcactgccagtagacaccctctgattccagagaacaggagacacaattcagcctttgacaggacattcagataagtgttcactagtcaatcggataccatatttaaggctgggcgtggtggctcacacgtgtcatctcaacacatagggaggctgaggtgggtggatcatttgaggtcaggagttcgagaccagcctggccaacatggtgaaaccacgtctctactaaaaatacaaaaattagctgggcatggtggcaggcacctgtagtcccggctactcggaaggctgaggcagaagaatcgcttgaacccaggaggcggaggttgcagtgagcggagattgtgccactgcactccagcctgggcaacagagtgagactcagtctcaaaaaaaaaaaaaaaaaaaaaaatccatatttaaatggccattcatgttctggaccaggcattggaaaagaacagagtttgtgttcggaggtttgtatatgtgcttgatgtctcccagtcctagtgagtcttgaatgagttaataatgtaacaggtctcctgctgaagcagacatgcccagcgcctccctgatcttcaaatcaagataaacacatacaagagcaggctgggaggggagtcctctggcaaagcaggaggacggcggccccaagcaagccctgcatgagggaaggtggggaagtagattccaggcctcttgggagagcccttcgttgaccaccttgtggaatagttgctctctagcccctgtctctgctttgattttcttcagagcacttataattcttgacattctattttgtttttatttgttgattgctgtcctcagctttgtttcttgctacttccccagtgcctagaaagagtgcccgtcactcttaacaaactttttttttcagacagggtcttgctccattgctcaggctagagtgcagtggtgcaatcatagctcactgcagcctcaaactcccggcttcaagtgatcctcccacctcagcctccagagtagctgggactataaccatggccatcacacctggctaattttttaattttgtgtagagatgggctcttgctatgttgtccaggctggtcttgaactcctggcctcaagcgatcctcccactttagcctctcaaatttccgggattgcaagcatgagccacctcactcggacttcgtaaacatttgctgactgaataaatagtatgaggagtttgttccagccatcctgggcaggcctgaaagatctctgagcttagaaacagccagaggatgagaacaagctggtaggagaggcagagcgagatggtggtctttgtatgtgattcccctagtaatggggagacggagaagaatttgcagaagtgagggaatgtgattgcagcacaaaggcagcaagattattttgtcagcaacatttggatcccattggtgatgagagacatgtgggcccggcaaggagacaattgtggtagtcaagacaggatgtgaataagacataaagaagcgtttcatcagtggggatggaaaagaaccagggctgtggcggccgagttcaggagtaggaagggtcggtcaggcgttcatgaggacctcttcacatacacacacacacaaacacacacacttgcacacacaggcagcctgctgggaccattcatttagaggcccccacagcacattttagcacaactgcaaacctcaccttctgcctcaggctttggtctttgtcttctctttgcttcttaccatagctgggaacattgccctgtgaagggcagggcccagaaactttggaggaggcagtttcttcagtcacagcttttctcctggctagtttgcagaggtaagaggcctcaaagtcacaatgtccctcgggagagaaaggagagaaggccagtgaaggaaggcctggaagaggagagaaatccttttttgaactgggtcaaggagggcaactgtgagctgacatcctaactcacacattcacacatgtgtaggccacgtgaagggtctgtaattgagactgggggactggaggaggcgaatgagcttcttattaggagtgggtggggaccttcttggggatccagctgaaacagaactttatttttaaagagctttagattgatgtccctgctagcctaaatataactgagcagccagcttcttgcgagccaggccaggcttccaagcaagctccaagaccctctttttaagagagggaaaaaaagagagagggagaggaatccacagatggaaaaggtcacacagttagccctctgaatgtgctgggaggagggagatggatgagctggttgtgtacactctgcagtcccctggcctcaccatcaaggaagaaagatcaagggttgctgggtgatgggggaggggagctggcatccactttgtacctgggatctgcctggcccagtcggggacaagtaagacccaggcttgtgctcagagagctgacggtccagtgggaggaaaagggtgccgagcaaacctgcgcagcactgcagtgcagcgcaactgatcagtcccacgtgacgcacaagcagagggctgtgagctttcagaggggccattccatgtggctgggggacctgaacagcccatctcagagaaggaagggtttcatatggagctggagagaaaacaacaggaagcagagacaggagtggacaggatgcacgtcgggtactcaaactcatcagatttgacagaagtgcaagaatgtgagagcaagggggttggtgcttggagcctgagatattgtccttcagtctggaggtaaaggggaggcactgaagagttgagggggaaggcagcaaccccacgtagactgaaggaaggctaacttggcaatgaggtgtagggtggagcttccttgggggaggggagagcccaagaacacaaaggtcagcaaggggtctgagttaggtaaggcgatgctagctgctgtaacagactccagaatctcagctgtgtaaaacaatagagatttgtttcttgctcacataaagctaatttggtagagggctgaggtgtagggctttgcttctggagtaattcaagaatcctgagtgaggggggctctgctgtcttcaacatgtggctccacggtcagcctggaattgacattcatgttgcccaggagaatatggaagacctggcaggaggcttttatgagccaggcattccaccggccagaactcaagtcacctggcccctcctgcatgcaagggtggctgatgggtagtccctggtgggctacacatatctggtggtcacctctgccacaggacagggacagggactgtgatctgaaggaatatgtcagcaataggaatgaaaagggaggaagcaggcagagcgtctatatttaggaattaggaggaagagaagccagagatccaaagcaaaataaggcagcttgagggaacagagagaaaaagacagcactgcagacactttgaggaggagtgtgctgagacagaaccttcggtttggctgccataaggcctgtgggagaggtgggcagagccagggttttgttttgttttttttgttgttttgttttttgttttttgtttttttgagtcagagtctcgctttgttgtccaggccggagtgcagtggcgcaatctcggctcactgctgcctccatctcctgggttcacacaattctcctgagtagctgggattacaggcctgctgagtagctgggattacaggcgtgcaccaccacacccagctaatttttgtatttttagtggagatggggtttcaccacgttggccaggctggtctggatctcctgacctcaagtgatccacccacctcagcctcccaaagtactgggattataggagtaagccaccatgcccggcccaggttttaaggctttgggaagcagccagcaatgattccctaatactttccgtaagcacatccatgcattaggcatgtgtgatgacattagctttacctccaaacacccaaagtggccccagaaggcacccctttccagggactctctgtggtgcagcaatgtgaatatgggctttagagtcagaagatctggaatccaggaataaccatgtcaacctacggcaaacaccttaatctctgggagccttggtttcctcatctattaaatgggcagactggtagctacttttccatctcattgaaagggttaggagtaatccacttcgtaaggtgcttagctcagtgccagtacatagtaattcatgtaagaaacatttattgtatatctactgagggccaggtgccttactaggtgttggggactcaaaggaaccaaaattcctgctctcaagaagcttatgctctggtagggctgaagacacagaagaagcacacccttaaaacatagcatgataaatgcaatgatagtagtatttttagaagagggagactcagccctagtttgttggaagaggtgacttacagtggagaagaagagttcaccaagggatgggctgaagtattccacaactaaggaaatatcaaagaagcagcaatgtgtagcaatgaacagcaactggacttcttgtgagttttgtcagattgcatcctttaaggaattggcccatttcatctaggtgtatgttggggtgggtgctgggaaatggctgagctgggaatctcacagtttactgtctctaaccataaagttaaagcagaagtggcaggaggtgcaatggaaaaggtagccaggatcctgaattttgaaacgttatccattgtgttaatggtctttaccctgtgggcaacgaggagcccttgaagagttttaagcaagagactgattatggtcatatttgaactcatcttttaatgagttcaccttggttgctatttgggtaattatttaaggaaagaatagaggaaaggaggcccaagacacagttcagataaaagatgatgaaggtctgcagagattgtactcatgtctgccgtgtgttgcatgtgtaccatatgccagccctgtcctacgggatttaatttcaaattccaattgttcactgttggtatataggaaagtaattgacatttttgtactaactttgtatcctgcaaccctactataattgctcgaagtcccaggagcttaagaagttaatccttttggattttctacatggatgttcatgtcatttacaacaaagttttctttcttccttctgaatctgaacactttttatttccttttcttgtcttattgcattatttaggacttccagtatgatgttgaaaaactataacaggggaaatccttgctttcttcctgatcttagtggaaaagctttgcatttctcaccattaagatgttagctgtagattttttgtagatattctttatcatgttgaggaaattcccctgtatttctagtttactgagaattttttatcatgaatgggtgttggattttgtcaaatgctttttcttgatccactcaatagaatcatatctattgatatgatcatgtgatttaaaaaaaaatacagagacagggtttcactatgttgcccaagcttgtctccaactcctgggttcaagtgatcctcctgcattggcttcctgaattgctgggattataggtgtgagccaccatgcctggctgggattttttttttttttagcccattgatgtgatggattacattaactgattttggaatgttgaaccagcattgcatacctgaggtaaatcccatttgatcatagtgtatacttctttttatacattgttggattgaatttgctaatattttgttgaggatttttacatccacgtttgtaagagataattggtatgtaattttcttttcttataatgtctttgtccatttttgttattagggtaatcctggcctcatagaatgagttaggaggtatgccctctgcttctatcttctgaaagagattatagcaaattggtataatttcttccttaaatatttaataaaactcaccaatgagcccatctgggcctggtgctttctattttgggaggctattaattattgattcaatttctttaatagatatagacctattcagattgtctatttcttcttgtatgagtttcgccagattgtatcctttaaggaatgagtccatttcatctaggttatcaaaatttgtggacatagagttgttcatagcattatttcttcattatccttttaatgtccatgggatctgtagtgatgttccctgtttcatttctgttattaataacatagatattagtcctctctcttttcttagcctgattaaaggtttattgatcttattgatgttttcaaaggaccagcttttggttttattcatttttctttattgatttcctgtttgcaatttcattgatttttcctttgatttgtattatttcttttcgtctccttccttgggatttaatttgctcttccttttttagtttcccagatggaagcttaggtgattgattttagatctttcttctaacgtatgcactcagtgctataaatttccccaagccctgcttttgctgcatcccacaaattttgttaagttatattttcattttcacttaaatccaagtatttttaaatttcgtctaagatttcttttttgacccatatgttatttataagtgtgtggcttaatctccaagtatttggggattttccagctatcagactatttctagtttaattccgttgtagtttgagagaaaacattgtatgatttctattattttaaatatgtttaggtgtgtttcatggcccatggtctgtcttggtgaatgttccatgtgtgcttgagaagaatgtgtattctgttgttgccggctggatctgtccatttctgacagaggagtattgaagtttttaactgtaatagtggattcatctgtttctccttgaagttctaccagtttttgcctcacacatttggacactctgttgttaggtgcatacaagttaagaattattatatcttattggagggctgaaccctaaatcattatgggatgcccctcttatccctgataactttccttggtctgaagcctgctctttctaaaattaatatagctactcctgttttcttttgattagtgttagcatggtatgtctttatccattcatttacttttaatctatgtgtgtttttatatttaaagtagatttcttgtagacaacatagagttgggtcttgtttcttgatccactcagtcatttaaggagaccagaggaggatgggagtggtggggggataaagatccagatccctctaaaataagcaagtgctttagctaaaccattctactccttatttcagaggggagaaaagagcagtcatagatccaagataaaattcctcctccctgctttttattactttgttttatcctactcctctgataaatggatagatatgttcagaacatataactcacttaaaataatatgaatgctaaacatgtgccaggaaatcagagcagctccttgtgttttcccctttttaggaggtctgggaggaccatccacccctcctggaaggccctgactcaaacactacaacattagatcccagcttcccctttgacagagttttgcaggttcccaggagagaggagtggtcatgaaaagggggtggggcctctctctggatgggagaaggcactggaactagtaagctatcatctctcagattccgctttgggcttcgccttccccagtagctgtcacctgcctttccctttgttgttggggcactctgctacaacctgcttcatgctccccacttactgcctccattgtttccctcccactctgtgcaataattccctctcctcccttcttcttccaggggccttgttttaggcttgaccttggcattgctggcatcctaattcctgcaacgagcatttacttgttcatctaattcatacaatgagcacctactgagctcagtagtgagttcttctaattcatacaatgagctcagacatgaagctgcccctatggcctcagggatcaaggagggctgtgtagggccatggtgtctgccccctttctggtgcccaggcagtggcccctgactcttgccataagtcctgttcctagtcacatggccacaggctctacctctttctgccactcctctgaccctctgagggaccctggaatccatcagtggctttcaagccccctgaggcacacaggacttggtaagaccatctaaggaccatctgcagcatcttttctcaaaggcctgaatgccttcctggggctctgcctagaaacagggcccagattcctgctgttgctttttgaagcccaaaaaccacactgaatgttgctctccttcctgaatctctgcctaaagatcaggaatatgtgagaagaagtggaatctctgctccgttttcaatctcccctcacagattagtctggcctctcctatgtatgtcatcaaatgtcaatagtgcaggttttgatcaggcactggtttgtcgtttgcttttttttttaattaacttcatctccacaaaagtcttatacactcatcatagggagtttagatgacacagaactatataaagaagagaataaaaataacctataatatcagtactcaggaagaaccactgttagcattttgtaagttactctcctgcacatattgttttatatacttgagattataactttgaccctactcagtttgttggtttgtttcattttttcactgtgttaaaatacacataacataaaagttaccacctaaactatttttaagtgtagtcttcagtggtactaagtacattcatattattgtgcaaccatcaccaccatccatcactagagcattttgatctttccaacctgaaattctgtacccattaaatattaattccccattctcacctctcccaagcccctggcaagcaccattctactttctgtctctgtgattttgactactgtaagtatctcgtgagtggaatcatatagcatttgtcttttagtgattggcttattttacttagcataatgtccttaaagttcaagcatgttgtagcatgtaccagaatttccttcatttttaagggtggataatattctgttgtgtgtatataccacattatgcttatccattcattcatcgacagacagttaggttgctttcacattttagctattatgaataatgttgctatgaacgtgggtttacaaaaatttcttcaagaccttgctttcagttattttgggtatgtacccagaagtggaattgctggattctaatacagtaattctatttttagtgttttggaaaactgccatactgttttccacaatggctgtaccattttaaattcccaccaatagtgtacaacagtttcaatgtctctacattcttaccaacacctgtttttctcctttttttagtgatagtcatcctaatgggtgtaagatgcttgcttggttttttaagtttacattatattgcaagcactgtcattaaaaactctccagacacatccctcctccaattcctctattgttggaaatttaggatttttttctttcaatatttttgctatcataagtaaaattgcaacagagaatttgtgcataaatttctgctgcatttttggttatttacataggcaaggattgctagataaaatacaggatgtccagttaaatttagatttcaaataaacaatgaataatttgttagtgtcagtacactcaaaatattccccgggacaaatttattctaaaacagtattcatcatatacctgaaattcaaagtttgctaggcatctttttttttttatttgccaaatctagcaatccaaccatacgtactattcccaggaatgaaattaatgagttaaagttgatgaacattttcaagattctggatgcatctggccaaagggcttttctgtaaactagtgccaggttcctctccactaacagtaagtaagaatgcctgttttctcacaaaagtggctgctttgagttatttcatttaagaataaacaaaagtttgcttctttgataggtgggaaatgatcatttacaaagttttgactatgaatgaaactgacctttcattccaaaggttggtcttttgtatttcctttcatgtaaactacgtgtctgtccttggctcatttatctttttgtgtttcttgtcaagccataagaactcttaaaggatattagctttgtggctttcacattttgttgcaaatatttctcccagcttattgtctgccttttaatttggcttatattatttgccaaagtaaaggcatttgatcgtcttatgtgttctaatctctaggtctttcatgattcttccattgcttttagtccacagccccttcttacttagattacatatatctattcacctgtatttgcttcaagaaatctgtgttgattctttttagtgttttctacatttaaccgtctaaactatatggagtgtctttggaaatggtgttcaatgagtttctaaattatttcttctcttcagatctctaatttgcttcagctatatttgatgaataaaatctcttccttcacaatgacttgtgatgatactttagccttatacataaagaaaaatctattttccttaaaagtgagcttctctgtcatttaatctgtctgggtcttgctatattaactatacaatgaggctattttataattcattcatgtattcaacaaatatttattgagcatcttctgtgggtcagatatatatgtaagatttcttagcagacttagctgagattaaaggaaaaattaaaataaaaataaagatttcttccagcattaaaattctaaatataaaagaacttcatttattcatcctcagatcactggaggaaactgacataatttgcttcacctgttgatttttttcattcttttatattaatctagtctactaattttattcagatcttctccagaacttttacctcttattgctactgcatgtcttattgcattggcaaaaacttcaaaataattgttacatcataaaactatgtaataaaagtgatagatgacacccttgttttgtctctaaggagaatgcctcccattttgtgccattaagaatttcttggcttttggtttaagatagaggtatttttgtatttaaaaagtaatagtctcttcttatttttctaagaggttttttttaagtcaggaaatacttgattaattttattaaatataattttagagcctgttaaggttattgtatcattctttatgagttttgcattttgaagtacaagtactactaacatagtgggactacatgaggcagaattaagatgaatacacacagtcctcaccacattatatggtgcttttgtgaacagcaattctaaacttgaagtacattttaaagccttgattgactgattaatttgttgttgttgttgttgcccaggctggagtgcaatggtgcaatctttgctcaccgcaacctctgcctcccaggttcaagcgattctcctgcctcagcctcccgagtagccggaattacaggcatgcaccaccattcctggctaattttgtatttttagtagagatggggtttctccatgttgatcaggctggccttgaactcccaaccttaggggatccacccgccttggcctcccaagtgctgggattacaggcatgagccactgcacccagccactctgattagttttttaaaaattgagcatatatatatatatatacgtatatatatatatacacacgtatatagatgtgtgtgtgtatatatatatacacgtatatatacgtgtgtgtatatatatatacacacacgtatatatatatacacacacgtatatatatatatacacacacgtatatatatatatacacacgtatatatatatgaaaatgagaaattcgaacccgcatgtgtgtgagtaaagagtgtgcagatgttgcacaaaactctgtacgtgctcaaagtagaatgaacccacaaatatcccactaatacttagcttttatatggctggtctccaaagtagggtgtgtgcaagttgatttattgaggtaagaggaagagattagaatgtctattttgtatctcatcctttaaacttttaatttgttatggtgaaaaagacattctaatcttttccccttaccccaataaatcaacttgcacacaccctactttggagaccagccatataaaagctaagtattagtgggatatttgtgagttcattctgcctggggcacatacagaattctgtgcaacatctgcacactcatttgaatttaaatgtacagaattcaaaatgccctctgaagcttaacgaagaatttttaaactagtgggacaaagctcaataatggtaaaagcacacaaacacacacacacacacacacacacacacacacacacacacagggaaaaacaagttattcaactttgcctgacttggggtaagttatgtagcctccttgggactcaatttcctcattactacaatgacagtgttgggccagatgctcaccaagcctcttcctgcactgacattttgtgatggcgatgaccctgtggggagtatcaggttatgggagaaacagatctacatgtcagtcagcagggcaactctgttattagaaatcaagcagagtgcagtcctaggactgatgaccaagagtccagtgtgcacaatcctggctgtctccagaggcaaccctcgcatgtcatagcaatggaacatgaagaggtggagatcttttggagtgatcagagaaaggattaaaacattttaaaatgagtcctctggggaaaagttacagaaattggattccttgggcacattaggacacattaagatggattgagctcccagctccaagctccgagctctgagcatctcgtggttgagcagcttgctttatactgattgtgacagtcttgggcaaagctctttttgtttcaaggaacagaaacccacccaagctagctcacagaaattcacagctaggaacacaggggtaactgggactcacaggaatagacacactatcaggaccttgggcatctcctgggggctttatgttctaagcattctctctctgagcctctgctccattctctactccccactttgtactctctgtttccacttctctgcaagatcagcgcacagatggacatcatggccccactccataccttgcatgacttttcagcctaagtgtccattggccattagcccagtctttccattttcaagtctaggttcccctgaaatgatgtatttatcttacttaaccttagctttttgtgccaagccacatcaataattggtcatcgttggttagccaatagatgggtcacccttgggtcaagtgcccacccttggtccagtcatgtgtgaagaggggaggtgagtcgcgtgctctcagacagggctgtatggggcagatttcctccaatcactgggggagcagattggccatgatgaacaccttccgcaaagagaccaactgtcttttaacctgatactgatatgagcacaaaatcagtctgaccctgagcctttatacaggagtaagatgtaataacacttctcaggacaccctttgaaataaggtgagactccttctgccttaagacaggctgaccaagggctgcctcgctatggtggtggcctgggctgcagggctcctgagagccacctcttggcccattggtctgggagactctaaagtcactccccccgcagagcctaatttctccatcagaaatgtctgatctttgctgatgggtggttagctatttgagggatttacaaagcactaattctgtttgaccaccgaaagattttccctgcttaagaagatgctaaaaactacccaaggacctctgcaccctcttggactggcttgaccaattttcatccattttgaatattcaatttctagctacttctctgaaccaactcacaacccagtgactgacttttcattccttaatcctacatgtgactcttctgctcagcatcctgcttagaatccccaggatcttatagaacacagaaaatgggacattaatgaacaagcaggcagggtgattgtctgtggtcttttacctgtgctgggtttaatcacagtaccagcctgacacataggtgggcagaaaactcagtttcctcaaatgcaagggctttgagagcttagacttcaaattagagtgagatctatctaccccaaacaaagctactcagacacctcactatctaaaatcagaccagaacctggggatgagccaagaaatgtctaagcagccaacattatctacagaggcccatactgttgtgtttaaagtagcatctaattcaaaacaactagtttctcagagggctggatggcctatcaccctttaagaaagcctggatgaatcctctcaaaataggaaaagctaggttccttacaacctatttactttttgtttacacagaattttggcacatttgcatatctggtttctcaatccagaacagactaaaagaaaatgagtcctgagattgctacaggtatgaacaaaatagcattctccctcacaacagggaaaagtaaccactaccacaggaagagatcagaaaatgatataaagtagacccaagaacctcaaaagcatagcaatatgaagagatacaaatggccacacatatctcaaaggtttgggcactactgggttaacagtacagtaactgaagtttctaaatatgaccctaagtagaacagaaatgtgaaattaagatcagtatattctattttaaaacctggtaagcatatgacttttttaagaaaaacttccatccaaaatgatgaaatgtttacatgtgatgtttattttattttattttgagataaggtctcactctgtcacccatgctggagtgcaatggagcaatcatggctcactgcaacctccactcccccaggctcaggtggtcctcacacctcaacctcccaagtagctgggactacaggcgtctgcctccatgcctgctaatttttgtatttttatgtaaagataaggttttgccgtgttgcccagggtggtctcaaactcaagtaatctgcccgccttggcctcctaaagtgctgggattacaggtgtgagccagcatgcccggccacatgtgatgtttaaaaggacaaaccttaagctagctggaaagctccactatccagaaggatgggttttgttctggataactgaggttttgctatatagctgaagtcgaaccctctagaccacttcttaaaggacatcagggaagcttgtcagccagggaaatgccgttgctgtgacttatatgctatttggacgaagcaaacgggctgaagaaggtttgactgtatttggttgtaggcttcgcttggcaccgtctctttaaaaggctgcctgcctttgaactaatcctctatttataatccagctggagagaggcctcggcaatgtatacaaattcctagaatttgcagagtgctgctcacgtaagccctgaaccccactccagagcttctgcctgggccctcacttctccagcaaggaccctgaatcatcccggaaccgtcttggtgctgtggtagacaggccacctggcacgcccagcgccccacattcttggtgggaagcacagggcgcatctgggaatgggggcatgagttggattaggctcagtaaacaccatcactcactcctgatggcctgcactgctcaatggctctttcctagagaccaagggttgaggcctcaggcacagctcacctctatagggctgttcctttcttataattcattccctcccaacacgacgccaacttcacattttcctttcttccccccttgcacaaattattgcaagtcatggcgatctaaatatagcccgcagtctgcgctccagatgccgaggccacgcagccccgatattctcctggtgtctttccagccgcctcttgctcttgctgtcctttctccttgctcgcccttgttttctccctgatactcctactctctgcctcccagtctccccaggtctttcctgtttttccagttcaaaggaaagttctaaaagcaaggcctgaagcctggacggccccctccccagccctccaacagcactagctgtgggaaagggatcccgtctagagaagaggcagaggtgcagcatcctctaggaccctcggccatgcgtgctgtgcgttcttgcccaaccttcacttactcgctttgtccagaagttgtttatcctccttcctcctcatctgtttcttcttggatcctggacgccaaagagtgactggccactccttccattcaatcacctcctgtgttactggaaaatatgttaggacaccctccaagtcattactttcttgaagttaaatgatatcaattccttttgcctcccttccatgggcctaggtatccagagctttcatcatctgcatggattgtctctgtaccatctccaagttggccatatcccctgtaggaagtagggccaggccttgagtcctctgtcctgctaagggtttgacatctgctttgtgagcataggggagcaatttactgatacttcttaatcacaggcccctaatttaaaaagaagtgctacagtaatgatgtgtgttcatacctaacttgaggtccactctgataataggctggtccttttcttcactgaaagcaaagcatttgattcacacgcatgttttattctatccttgtcaatatgcttgttcactcactattagtcaactttcttaagttctaacttggtgggctcacggtgacccacatcccacaggtggagagtatataactattaagtcagtctgctcatttatttattcaaaaagcagttattgaaagctgggtgcctcggtgcatgcctgtagtttcagctactcaggaggctgagactggaggatgcctggaggccaggggttggagactgtagcgtactatgagcatgactgggaatagcgcactatgagcatggcaccccagcctgggcaacatagcaagaccctgtctttcaaaaaaacaaagccaaaaaacagttacaggatacctctttagacctagccgtggatatacaaataagaatttgcctcaagagatacacagactagtccagggtttctcaacctccgtacaactcacatctggggccacataattgtgtggatggccctgtgtattgtaggatgtctagaagcatccctggcctccacccacaagatgccagtagcaccaccccacacacaaattgtgacaaccaaaaatgtctccagccattgccaaatgtctcctggagccaaaatcaccccaatttgagaaccactggtctgatgagatagatagatatgcaaatgatcattacggctcaaagaagccctaccatggagacacgaacacaggcccatgcacagagggcactggagttgaattctgaaggatgggtgcaatttttccacgtagagactatgctggagagaggatattcttggcagagaaacagcatgtgcaaaggcacaggggtaccacagaacaagtcagttgcctgacatggcagctactgggtaggaacaaaaggagatgaggatgaatgggggctggccccagtgtctaaagggccttgtgtgactgggatgcttgcacttgatcctgaggttagggaaagcaagaaggtttgtaagctgggagcatgattgttggcatgatggcatgacgaagagaggaagctctgatgacactccaggaagagatgatgtgggcttgaatgaaggcattggtgcttgggaagggaacagaaggggcaggatttgaaagctctttctgaggcagaacgtgcaggatatctgagtggagatgaagacagggaataagcccagcgctacagagctgatggaatcctggtggttcggtcttggcattaaggcttttttctatcccagaagcattctggagtttgggctgtgcccaccttgtctgggaagatgaggctgtggggacacctttacgtcagggtgtgtttctgctcatccctccttgtttgcttttagatcaggctcatgggagatgtctggtggacagaaccccccaccccctttaggaattgcattaaggacatgagctgctaattttgtcgctgtcagtgcctggcaggcagatggccctgagcctcagtttctccatttgtgatgggaagagaactccccgccccatctcccaggatgtggtgcgtgtgaacagggctgtttctgtgggtggtttagacccccgtgggtgcttggcacttcctgcctgcagttggtgaggatcgtgagcagttgtaatcaggcctgataggaaggcccccaactctaccgcggccttgagtggctgccagctccatgaccaggcctgcttcaaaacttgcctgcaagttatttttttcagggtgtctggttcctgtaaacaggctttcccaaaccctctcaggctccaagaacccgctttggctgtgcatcccactgccgttcatgctccccagcccaatggaaaacctcaagacaatcccactccatttggcttcatgcaagccctcccctccagctccctccccccctgccttcccaggtaagttagagtgaaaggagggagtaggaggctgggatggagacaccttagagagaggctggccccaccaggcagtcatgatggtctcaggcctgctatgtaacacctttccccagcacacctacactgggtgggctaggtgagtgggttgtgccaggaggcaaatggtgagtgtgtgtgtgtgtgtgtgtgtatgtgtgtgcgccagctagctgcccccactctcaggagcccggtgctgatggtgatctctctctctctcaatgcaggaacaaggggctgcattgttagctagcctatctcttggtttctgattcaccccgggccacggcagcctgagcaggttcacagctgctcagggttatactttccagcacatttaggacttggaacagccccaggtttcaggaacacatggtgatgggggaggggaggggctcaaatagacggggtgtgggggaagcgagctacttctttctttcttcaagatgaatctccattttcatcatctgatagcaggaacagcatctgaggacggcggatgaattgcaaacctgctcaggtcgggggagagggcaggcgtgtgggggagatgggcagatttagttcatcctggctgaggtcttcttgtgcagccgtgtaccctctgacacacagctcttgctccagttacagcctctgcacagccagggcctgccagggacgcccacccgcggggcactctggcatacatctcggaagtcagcccccagagtgggcctctggcttccagcagccatggccaagagggcagggaggagctggaaaccggccctaagaggtgggacgtgaggaacaccagcttccatcttacagatcggcggggtcttttctctctgttgctagtggctggctaaggaggaaatcgagactataatttcccagcctctaccatctccctattttctctgagacaagtaactgcctcacagcagacaggaaccaggtgacactgctgtcccaagcattctgcccacattcaaccacagccattcatccatccatctgatatctgctgagggccttctaagagccaggcatggtccaggtgctggcttttagcaaggagcagaacacagtccctgtcctgcaggagccaggagaacccacaggaatggcaggcattgacagcaccatgtacaaggggctcgggctgggcaaaaccagatttgagcactgtcagtgactttgaaaagcctggaccctgctcacctggcagcaggcagcctcctcctctgctgccatctagctggacaatctggggcagggttctcttgagcctggtcatctcagcccacccacagagatgactataggtatcctgcctacctcctagggcagctgagaaactcaagtaagatttgtgcacagaatcccaaaatataaaacctttgtccagctctcagattcttctcccccttttctcaatggggtaactgaggactgaggcctaacatgcaggagcctgtatcagaacagggaggctgctgtgtgctgccagagattgccacccctcccagcctctctgggcagtactacacagagctggcctctgtgaggggtgcagagcagctccgggactcccacacagagcccctttctcctgcgctctggcccagagctcgctctcagggtcctataattgaaaaggcgaccgcaggccggcagtgtgacctttgggcctgcctgggcgggtgactgagttaggcccccaggtcccccacccctgagaggaccagccaggccccaatttttcacagacacagcaaggaaggtgcagcatggcagagaggaccgggctgagctcctggctcccagcccccatgggtcacttgtcccctctgctccacactgttcccattcactatgcgggatcaagaactaccaccctctctttgaggatagacagggagagaggacagggtgtatgtcagagactagatgagtttgcagctgaataaaagggtttaagcagcctggttaaaacaggaaagagcctcagtacaacctagtcatagtgctgcctttgactttctacatagaagtttctacaaagatggaatgttctagagttgcactgtccagtaggacagccactagccatatgtgactattgagcactgagatggagctggtgtgactgagaaacagaacctttacctaagtttaaatagccacatgtggctagtgatatccatattggacattgtaggtctcgcggtggggggaatgctgaggctttggagccacagagatctaggttcaaatcctgacgctgcagctgaaacttagcacttcatggctagggcatgctgcttgacctcttgagactcagtttccccgtcatttaacaaaatttttttgtaaagacaggatctcgctatattgcccagactggtctcgacctccaggcttcaagtaatcctcccaccttggcttcccaaagtgctgggattacaggtgtgagccactgcaccagcctccccatcattaaatgtagagctgaataatatactaagtgagcctggtggggggccaaggcccagggtccagctcataggagctgatagtccatctattaggactgctgcctcggcccctgcagagatcagtctggtggcttcaggcatctgtgtctaggagggctagattgatccaggctttttcttcctatgtgtgtactgaaggaagcctgcaggcaggaaaaggttgtttctccttagtgtgtggaggatttgacagagcaggtccagaagtgccaggacaggttgtcaggcttggaccttctgctctgtgctcatcagcttcatgcttcataaacagacatccctagattcatttggtgagcctggtggacccaggctggacaaagatgggataagaggacatctcctgccctggagctcagctgccagctgttttcctcctaagctgctgcccatgagctgactttcttcctcctacacctgaatcagaacttacctgtcccacctggtaaaaatctgctcattatttgcctgagtgacagctccttgccttggcccaggcactgaggtcttcctaagatctggccctgcccttgccaagaagcgcatcgccactgcacaactccgacaggagcaccagggaccatgaaaaagagggagctctgggctgggttggcaggtgagatggggtggggagagctccccagctgctctctgaggacagccacgtccctggccttgctctgtgggagcctctgagccagccaccctggaaaccttggtgctaccagtgccatgtcagtgggggctgcccggaccgagaatctggggctcaggacactcagccctgggcagcactgacagacctgtcctcatggtgcatggcaacaggggctcattcagatgatgagggccactggcccgtgccccctggtgacaatggccaggcaggagagctggcaagtgccagggcagccaagagtcacagaggaaaacagccgtcatagtgccaaggatagtgaagcttggtttccccatcaccccttcatctcatctgcaccaagtgtaatcactcagccctacttcacaatccctctacaaggaataggacggaatgaactacactccatccacagagggaaacatggaggttcagtcacctacagaaagtcacctagagactctgcctcagggttctccctgccttctgccccacaccccaccagatcatcatcatcctcgtcctcctgatcatcaacaccattgtcatcaccatttattaagtgcctgattttgtgtggagcatgcattgttacatcatttcatcctcactacaactctgtgaagcaggtatatttatccccagtttacaaagggagaaactgaggacccaagaagttattaacttgtctaaagccacacagctccctggagtaagagagaggctgtacagcccaggatgtcactccctgcacagcacaaccactcaggagagaggggcgggagggaggaaaggctggcgggatggtctctcctccataacatgccaccaagcccaagacaaaggtctgctgctggcaagggtgaccgtgtggcctggagggagggcagagagtggacagcgctgggggaaagccctgcagaagcatgctaatctgcacccctcctctccacccacggagccttttcctccaggccagcctgttccacaggaaaaacaatctcccctgcctggggacgtgaggccctggggccggctgggccaccttctggtctgtcttcattcagatcccatttctctcctctctggaagctgggggagggagtcacgctggggaaggcgaggatgaggctaaagtcttcatctgtccccctttaagccaagcaaagaaaaatagccctttgccaagatctttcatctcagtcatttactctcgcagatgttttctgcaatataaacaagaagcaaagaatgttggggaggagaagagggcgggaggcgggtaggagggaaaggaggagtgaattgacagctttgaaatctgggcctgcagagggcaggaaacaggaccttgggagggtcccgactgccctgagagcctgggcaacctcaggacactgcaccggggcaagccaagggtcgcttcccagggtgtctttgaaaggagattctggagaggcagcccagcccttgagtgggtggtctccccagacgccctccctctgcctgggaagcgacacatggacggcagctgctggggccctatgggcccaatctggagccatgccctgccagggaacacacctgcccaccttagcactccccaaaagttctggggcaaggacgctcagcctgctgccaatggaggcatcagtaggactgacaagagatgctgacacctgcaatgggcattagggtgcatgcgggggaaagaatcttgagctggtgggggttggcacctcctacagtgggtcaagaaataaaccaaggaaatcaggtgtctctgagttcactgttctgtgagattcctattgatgtcagtagcttttaaacgaataagccatggattacgaactcaaatgccaatgggggctggcagtaacccacaggagcaaagccaggtgagcactgccctgacttgaagaaggctggcccatctaaagggggcaccaccactcagtttcagctgggtatttaagacagcctagaaatccagagttctgtataaagtatcctgtttttaaaaatatttgcactaattaaaaacaaaaagcagaaaaataccgggctggacacgtgagacgtgctgctgagtagcttttagtttgtgaatcgtggatttgagatttttgcaaaatatgctggttgaatgaataaatgcttagtctttctgctcttcactttaaaaagggatttgtgagaagcttggataagaatccaatagcaagcttttattgggcatctactatctccccaaaatggagctaaacattctgatggattcagagaatcagaggacctggtcttgcccttgaggatttacactgtagttgggagaccgaatcagctcctggtgcagagcctgggcagacacggggttccagagcatgcggcaacagacactgctcctgccctcagggagctactgttctgatctgtctcctgttctgtaaagtgggaacacacaggaaatgagaccagtccttgacagtccttggttatgcggcacagaatgtttaggggaaggggagaaactaggcaatgctcccagagggggcggtgtttgggctgaaccttgaaagatgggtaggaagagccacttgtttccagctgataagtgaattctgaaactggccgacttctcacccagccaaaacattgagaactctgcaggatcaaaacccaggaccaccaaaatgagggagtcctgcttgctaagaaagagtggctgtcccacatctgccatcaacatgtcaccaaatcgcgtatagtgtctccaggggaaagtcccctagagccttcaggggaaagtcagtgaatgggtggcttgagcggagctgcagccacagaggaaggccagccatttaggaagcagtgacaggcaggcctgatgtcagcaacctttttgaaaggaaagagggggacagatttcacacaagggcccttgagggtttctgagtatccgtggtttcccgtgaatgactatagttttgtgctccttgcaaggaaaggaacggaaagggaaccaactctgagattcccacatattccacaaacacactgcagaacaggagaaattattcccgctttacagaacaggagacagaccagagcagtaagcctcctgagggcaggaaccatgtctgttgctgttgctgcacgcgctggaatccctggtgcctgccaggggtctgcaccaggggttgatgatgccaaatgtgacttgtttgagatcttacagccagaagtggcccgggggaaattcaatcccagatctgccagaccccaaagccctggttccttctgtgatgctggggaaatctgcatctccatagattcccaaaggtcacttaaaggagaatgctggatgctccaaagtttgaaaactatgagcggatgcactccatcatgggttggtatgcccaaggaagtgttagcatgaagggggcgtggcatgcaaacatattcatgtggccaggcattggaattcaacagagatcctttgagacaacacgccctccttttcatgcccggtagaggtctcttctccaacagccctgggtgcgaacatctctaagggaagccaactcaccacctcacgtcccactctgactgccagcaggttgtgctctaggctggcccagttagccatcacccagtggtctttgtactctctttctgtcctccaccaacaaggctcttcaacatgactaccttccagacacttgagaacctctcttttatttgccagctctcttatttatctcttctgcttttccttcacacattctcgtgtgacacactctcagtcccctcccccatccccatggctgtcagcaaatgcgatccattgcattttgcttctcctttaaaagcagtgcagtggcattccaagtgggacagaccagtaaagaggccagcaggagaaatacctccctcatcttcaacactcttcttcagttaatgtcacctaagatgacaccaattttcttggtaactgttcaggttgattcacgtcgactttacagtcaacacacacccctgagtctttcacacctgccccatcccgggcatgtataaaattccatttgtttagccccaaggttccagatgtacattaatcctattatatttcatcttgttacattcagccaccatgaatccaaactgttttgggatcttaggagattctaattctgttatccaagatgtcagctgcctctgaaagttcttcctagtctctaatagaactgttgaaacagaacggtcatgggagattctgggacacggatggaaccacccagcaggctgacatccatctgtttgttagcagctttagggccactcagcacatccccagctgtcccagtgacactgtctccagccctccttgttctcaagagagccatgagctgtctgctctgctgcctaccacaatgccatgtgctaccaacttaggaatcctgtctcctccctccaaaaaagtacagtgagtagtcatcttttttcttggtaaatccatgctgattcctaacgatcatcactttctttcctaagccttcataagccatccctttccttgtagatgagagaaattaaccctgagttcaaagcagaagccttcagacagctgtacgtgttaattcattatgctgggcatctccatttgcccctccacagccaccccatcctcctccccactgctctgtaccccaggaagctgaccttgtggaccgcattactgggcacccttgccctctggcttcagttgggttctgccagtgggaggcaccagcaagagacaggagggtggggccaggcgtggtgggtcacccctgtaatcccagcactgtgggaagccaaggtgggtggatcacctgaggtccggagtttgagaccagcctggccaacatggtgaaattctatctctactaaaaatacaaaaaattagctaggcgtggtggtgcgcacctataatcccagctactcaggaggctgaggcaggagagttgcttgaaaccagcagggttgaggttgcagtgagttgagatctagccactgtgctccagcctgggtgacagagtgagactccatctcaaaaacaaagagagagagagagagagagagagatgggtgggacaaggtcaagatatttatttatcctcctggttctactgtaatgggcccttgcttggctgtgtctctccactgcccctgtatctaaggccatagcccctgatgaatggctctctcctccagatactttctctttcacttcgccccctttacccttcaggctccccccgctgctagccctggagggcttcatctttccttgttagcttcctttagctttacgcataacttgtaagtagtgacatttctaaattctgctcaattaccccatttgagtgtgccgtctgtctcctgccagaacgctgaccaatacactcatattttgagtcattgcctaaagacttaggcctaacagtgctagacgtgggagggagtgtaggtgttggtgagaatagcataagagttaaaggcacggaatttgtggtctaactaaccaggattgaacttgatttccaccgctttccagctatagttactgaacttctctgagcctctgctttctcttctgtaaaatgggagcagtagtcccctctcacaaattctttgtcaggattttatgtgattatatttgtgaaacattaaatttagcatcaggtgcattataagcacttgataaatgtgttattctgattattattaagacagactctaaccattgagggtattgctttggtgctagaatacgctagcaataagcttcaaggttttcctgtttatgtccaccagggaatttggacctcaggtaatctgcccaaatcctgcccaaacaggagtaagaaaaaataagcattgttgttgctgttattttattagctagagaggcagtcaattctatcacttattgtcaacataattttttagcaaagactactctaggaggctgtagttacattctttctgacacctttcccctatctcttttctacataatcttagagtcccccaaccaccaaggatgattcctactgattcaaactaagaaaatgtggcaccttttaacctctgcccttacagagcttctccccaccacatccacccccgcccacaatgatattcttaccaaaataagctcagaagagagtctcttaactttgtccaaaagctaaatctgaaagaggttaaaggttctctggtcagtcgcatttcacccgactatttttagctgatatagggcaaaacaagtttccccaaagatctgggccctgtgaaagctggaatttctgccaagatggaggaatacagctctccctgctggaaaagagagcacaattccctctttcctcaccccgggatacctatttgctgccagtgaatctcccacctactctgtcatgctagcatttgatcacattgggttcatatgtgcttatttgctgctccaaccccaatccttactcctgagcctttaccactcaactatcaatgtgtccactcatcctctgggccatcttgtgccctcttatcctctatctcctgggtcagaagcttggcagttttctggatgtgactcctaatggaaatccatgacaaaaatgccctggattctcaaccagggagagaaactcctcttctcagcctcttctgccaatgtgccccactcctatttctctctcctgagagccctaagccctgccatgttccttctgtcctttcagcccctttcttcccctactcacataatgcaccaagggtaagcatcttcctgcccagatatatctgccctttcacatactcccatgtgactctttgacctctgttgttggaatctcttgacttagaaaaccagagatgtttccatgacttttaaggcttttgttggcaagacagcaaggagaatggagtgaggggccaagctcaggctttctgcctggccccggagggcaatgccatgggaaggtgacctcgtcacaggcctgggggctatcccagtgggatgacgccattgggtactctatctcaggctcctctgttgctctgcccttcaggcaggatattgagttttaagttaaaagacaaggatcgagcttcatcttatgatttatggtttaggccagggtttccaaaactgtataaaaagttattcctggccaagttccctattagtcatatgtgtgaagtggaaacatcactttatcagaaatatacttcccccaacccatcccaaactgtgtctataatcaggctctggagggaagacactggtattagagctggtgtcaggagaagaactcaagggaagacgctttactaataggactgtatggccctggcagtggtgattataccaaacacatatggaaagggatcatggggcagccaaaagaatgatgaaaacttcacattggtactgcccctagaggtgcttttccacgaatggctagattatgaatgtttaagctttcttatttaagtgaccttactccatcagcacccgtccactctcttctggtacccatgcccctgtttcttggggaatcccacaccatgccctgctctcagtccatgagatttcagtgcagccaactttacccccaactcagggtgaagcacaggacccaggcctaagccaatcagagcattagattctcttgggcatagtgattggtttaggaatggacatctgatcaatcagagccaatgagataccttaaggtcttccctaggacttctgggaaggggactcactctttcccccttgaacctgaaatctgagaggtatagagctggaattgctgtcatttttctgtcacatgaaacctgactctgaagccagcatagcagagagtagagctgagagatttttctgtcacatgaaacctgactctgaagccagcatagcagagaggagagctgagagatggagagtacccaagtcctgataacacattattttatccctgaatcaatttatatctgatgctggccctaattctggatctttttgttgcatgggccattggatttcccctttgctaaagcagtttgagatgactttctgtccctggcaaccaaagagccgtagtttacagctattgtttaaaaatacattcctaagtgtaaatggaactaagagaaaggagacagggccagcaatagatctgtactttgcaagcacaatctattgctcaggggcacagacagaggcatatcacatacttaaatgtgaggagagcagtactgggaggtcctcagacaggaagagggtgaaccccaggcaggaagttccatcagcaagcatcatgtctttggaaatgaaattattaaacaaccagaccatttctattgagtttcgtttttgttacacccctcttggtatgcttaacatagtaataagtattactgctatagtgaaactcccttatttatatcatcacaatttctatttccctattatttactcccttttcctatgaaataataaaaatatttactcatcatgaaattactttctctaatttaatctgcttttcccccagtgtattataaaggttctccagagaaacagaaccaacaggatctccctctatatatagagatagattagatatggatatacatatgtagatgtggacagaagtgatgtctgcctctttcagggttggccttttaaagcaactcagcaaccctccagctctctcttccctgatgacagcaatcctgaagtcacgtgtttcaggtgacataaccactgagatgcaggggtttatttgccacagcagcataacctttcacattctgactaatgtagatgtatctagagagatgtagctatagacgagatggagagagatggatttaagggaattgacgtatgtgacggcggtggagggaggtggcaaatctgaaattttgcaggaagttaggtggactggagagcaagtaagagttgatgcttcagccttgagtccaaaggctggaaactcagacagaatttctgaaactcaggcagaatttctgttgcagtctggaggcagaattccttcttcttcaggaaacctcagcctttgctcttcaggccttcaactgattaatgaagtccacacctattttggcagtttctctgctttgcttaaagtcagctggttgtaaatgttgactttattgtaaatcaaatataaaaactaccttcacagaaacatctagacaagtatttgaccaaatagctgggcaccatagcctagccaagttgacacataaaattaaccattacatccagctggagccaatattcccccatgctcctccatatattagtgagggttcagctttggattcccaggccaacactaaggtagacactgcaaataatgaacccttgacaaagctctgttagttcccagatggaagaaaattaatgatgattgctcaattcagtctggacagaatgctttactatttctgttgtggttaaagtatgtaagtcagctcttatttattatatctccattggtttacttttcactgtttgaggaattctcctcccagctaccatgccagaaaaacacttacaccctgccccgtggatccccaaaaactaaggatgtatccacagacctaactgaaggcagatcagccttcagtaaggtaactccagcaggagaaagcattttccccgttgtgaggcctgtgggagatcctcatctgaggcagatgtaaagaagcacttccctggcctgggtctgctgggaaacaagtgattaccaatccttgtgctgtccatgaaagggcctcacccctggctgctgagggtctgggaaatatctgcttcaatgaatacccaggtgctcatttttcttctccccagttacctgctaaaggctccatcttgacatcaaccctggggtcaccctccaggatacttcctcgaagcagccacattcctgggggcatctgtgccagcaggggatggtgggatggcaaatcagcaagttctgtcagtcctcagcaccactctgtccacagcctcatgagagttttgtctgaggaccttcattaggcttcagggcctgtggctgatgactccaggtcaaagccccagatgatacctgctcatcgaaaaccacgcattccactccacttcccggcctcccctgccgttaggtggaggccatatgactagatcctggccaaacggatgtggacagagtcatgtcagccactttcaaggcttgtctttaaaagcatcacagcagccctccagctctgtctgtgatggcagcaatcttgaagccacatttcaggtggcataaccattgagacatggggatctatttgtcactacagcagtagccattcccattctgactaaggtagagcataaaggaattatgatccatggctcccctctgccgcccgagtcatctcacagatggcgggctgttctcctgcacccccaggcacgctgatccgtgacatctctcccaatcgctggttaaatgacctcagacacctgctgtgctgaaggtgacaagtcaggggcagcatctgcatgtctgaagcagctcaggatcttctctgtgcccaaatccccaagaaaagtctaaaactggtaaagtaattgaaccaagatgggttttcccgaaagaccttttacagctttgagctcattaaggaaagaaagaggatttcaagacctaaacagtgctggattctttctattttagttgaagttgaaaagacgatatctttgctagagtccagaaagagtcttacctgttgaaaactcatgcaacttaaagttccttcatcacggagagcctaccaggcctgccacgtggcatgacccatggatgtgggtgggactgcttggtattttcagactgttggaaacagtggcctcttgatctcagagagagccaaattaagctgatttcactatttataatccctccggaaataagcaaagaagagaagtctaattgcaaacagactgaactttacataggaaatatgtaggccccctgaggcacctagaaagtgtctaaagccctaactgcctccctgcctcccctgcttccctctccagagcacgtaggccacatctagagaggcctgaggctgcagaatggccctggactggccaaaccagcccagccagccccttgggcctaggggcagggacttttggatgagaaacaggaagacatttgcccacagcttgaaccatggctttgggaagactctttgttctttcttccccattattttgggttttctggtctttattccgtgcttgtcaaattccaggcatgcaaggctttcaaacacactatcaaacccgccacttacacacacacacacacacacacacacacacacactccccacccccattgcattcccatcacaatcacatttgtagcagagccctgggatttgtaaccaagtggggcccagtaagagctttgtgaaatttcacatggcccctggccttctgtaacaactccagagctaaagccccagccagaaccctgggccttgctggcagctgtgctgccgggtcactgtgggagatgagacaaggacctgcgacctgctgtgcctcagtttccctgcctgtcagtttggacaaccatgactgcagctaattctgaattgtctgcctgctggtgggaccaggccctggtggggggctcagattaatggcacggaagtcccagaatgagtcaaagaagagagagaccaaaatagatcaggagccaagcgcccagaatggcagccagagaagattagacacgctgccgagagaaccgtcccgatgactttattgagggctcttgctcataaacagccactatgttattgtaacttccacagaccaggccgacccttccttgtgacgggaagtttgggattggaaccgtccgtgggccctgctgttgctgaggtcaccctgggagctggggctcttccaaaaggaaatcagcatggggctccggggcttggtggaacagtggacagatggatggtttttgagtgagaaagtcatggttaggagtcagggaagagtggcaagtgccccccggcccacccctctgcagttcagctggtgggactaagtctttctttatgggcatttctgctgaaaagtccttcctcccttacatttgcttcttggtctcatgaatccaaggagagggcactaggccagggtgacagatgtggaaaaagcccagaactgctgccatagttcccatccctgggagcctccagtccccagccatgcccagcaatggcttttcctctcacatcctgacccctcacatcctctgtctcattgcacagcccttgccctcctggccacttgctacttttaatcctcctctcatgtggagagcagccctggcaggtccatccactctcatcttccactggagtgcttcaggcaacaatggaaaaacttaagtttgccagcaaagtggtcgaaggccagaacttgtccatttgaagatagagacacaaatatctcatttcagtaccaaagaccctttctttcttatcactgccagctctccaccacccatccatctcctgctcatctctgctggaaatgctactagccaaggcgagccaagccaaacagctgtttgtgggctcacagaccctccaaggataagggtctcttctgtgatgaccagattgcaccctgatgccagccagctcctggcgtctgctgctggcccccccaagatggtagcctggggagatacagcccaaacgcctgatccagtctcttcccagtctagctctgttggcaaaatgaaactccctgccaagggaaagccagtttggactgtccaaggggcacccatgataactgggcaaaccatccatcctgggttggtccgtgtgctttgagacttacactaggtgggccagttgaggaaggagataggaggaagaagtccaaggcaaatgtcagatttttagacaagccactgctggcaacatgtttttatttggaaaatattgcacaggaacttacagtgaaaaagaagctttcaaagccctacataatgtaaccctatcctaccacatctccagtttgctgtaccatgccctcccctatgtggattcaccttggccagacatacaaacccaccccctatcctcctccatccctgctctttgtccttgctcattccattccctttgcttgaaatatctgtctagactgtgcccatcttctaagtggtccagcttcaactctgctctctcccccaacaccccgcctccgacaacctctggggagcatggagttaacattgcccctcctgtgctcactgcattttttgcctaccatagacagtttaattattgaaaaccgccttgtatgttctgtttcagatatgttggctttaatgaatctgtgtgtcccctaaccttgtctcagaattccttatatgccccaaggatgcctccacagtgctctgaacactgtagggccttaggaaatactgatggctttgactggttatcaaaaaaaaaaaatgtaagtgatcaaaaagatgcataaccaggaagaactataatgttcagcaaaaactgcgagagtggttccaggtgctgccttcttggggtcagtggtataatgggttttcctttccagacagtcccttgatagtcctagaatcccacaggacagttgggtggacagtgtccagcaggcaaacaagaccataaacgcaaagccagagaagctaaacaatgttcactttacaactccaggtgatgataatggtatttatagactcagtgacatgtttgaagctgtgagtcccagaggctaatattttaagctggatatcctgagacccagacgttctgtttttgttctcctccccatccttccctcctgtaacccctggaactttccatgcaatctggacaaaagcatgaaacctctattgtttctcaatccttactagtgctagggaaggatttaagaactgcttcatggaagggtgacttgtgatgagtggaaaacattctgaggccttaaaatgacatttgccattacaccaaaacttccatcagagaatttcaaaattctaggcagagacaagggcctttctgccgtcagagaactccaatggtaaaggagctggggtttggaagagtgaggccttatttatagatgaactcatcttggccagaggttctggagagtctaggtccacctatttaagaactttctttctctcaggtccatttttatattggataatcattcctgaggcaaatctataaacaaagggtgggaacctaaaacttggctagttatatagcccagaataaaatggggaaatcagtgttttccttcaaagcaatctagaaagcactagccaaagaacaaattgcaaacagctacacaagcatcagggaaatcccatcgatcataagagatggaaaataaccatgagatcattgcactcatctcccctggggcctggacatccaggatgcagcttcatggtgtcccttcagagggtgttacaggcattacctttctcttgctttgcactgtgaatcgtgctcctgattagtctgcaatacatccccctgaagacaggcagcaaccacagaacacagtacctcatgcataggaattaagtccagaacattctctactaggtgggttttttgctgtttgtaaacaactctagatgttcatccacagttcactcaactgtgctgactggtttcatgcactagccagaattggtcaaacttaaacatgcacaaaatcctgtagtcactttaggcccaagtccaacatttagaagctatcaacacaggaaaaaagttgtacctgttttcacgctgagaaaagcagatagctaatctgtaccaggaaaacaaacaagaaaaatgatctgaaaataacttggaaggttttgttttcaccaaaggaagcataaatagtgaaacacatacacataagacatgcatgtacacacatatatatacatgcacacacatacacacattgtatgcacacatatacataaacacacatacataaacacactgtacacacaaatatatacatgcacacacatacacacacatactgtatgcaaacatgtatacatgcacacacgtacacatactgtatgcacacatatatacatgtacacacatgcacatactgtacacacatgtatgtacacacatatgtacgcgcacacacatacacatacatatgtacacacatatgtatgcacacacatacacatactgtacatacacatatgtacatgcacacacacacgtacacatactgtgcacacacatatgtatacatgcacacacatacacatactgtgcacacacatatgtatatgtgcacacacatacacatactgtacacacatctatacatgcacacgcatacacatactgtacacacatatatatacatccacacacgtacacatacacatactatatgcacacatatatacatgtacacacatacacatactgtacatacacatatgtacatgcacactcatacatgtacacatactgtgcacacacatgtatacatgcacacacatactgtacacacacatatgtatatgtgcacacacacacatactgtacacacacatctatacatgcacacacatacacatactgtacacacatatatatacatccacacatgtacacatacacatactgtatgcacacatatatacatccacacacatatacacataaacacacatactgtacacaggtatacgcacacttgcatatatatacatgcatacacacatacacacacatatacaatactgtacacacatatatacacacatactgtatacacatatacatcacatacacacatatacatacatatatacgtgtacacacatatgtatacacacgtacacactatatacacatatatgcacacatttacgtatatacttacatatacacacgtgttttcctcctaattacaaaaataaatacagaaaaacactactagaaaacaacatgttattgtgttccttccagaatttttctatgagtagtcacctgtattctaatgtatcatacatattatatgttacattatgtatcgtataatatataaatgaggaggtatatagaagtctttttagatatatttaatgaatatatattttaattaaaattttatataacatataatgttaccaattttatttttttatttctatcctaaggtaacatactggttgtagaaagtcagaaaatgtgtatgagtaaaagaaaaagtgaaaatcatgcatattctcagcattcagaaaagagtactttcatttgttgtatgcccccctcacttatttaaatatacacccctaagtataaaatgggaagtcccattacacaggggtatgtgtgtaatggggcatatgttccataagtagaccaggggtatcaccaatgagcgtcttaaaccactgttccctctttcccttgtaaggcatgccatgctatggtttcccagccacagacccacttctccctgtggaaggggacgccacctggacgatgggccgctgctcagccttgggggtccatgctaaccctcttgagttgctagaggctttgtggaaagacttctaaattttaaaatcttcctttaaagtgccaagtcagatggtctgataatgggactttaccataagccatagttcagaaaagacagtcgacagcctaataaaacttcccctcagatagcaagggaaagtagacagctctgcccagcctggaggagaagcaaaggagagagaggacaaaggtagcaggtagacaagcaaggcctctcctgcctccctttcttgggatgattatctcagggactagggtgtcagtaacaaacacagggagttggggaggggtctaaaacaatctgggttagggctctgcttttctgagacatagtttgaggagaatccaagtctcctgaacttatctggcacagatccaacatggtgccacaggatggtttaggaatgacagagggaagtgactcagtgtccaggcaaatgggcatgagacggccctcctattctcacagcttgcttaggcatctaggatatgcctgattcctttttggcccccaacacagtaacacaaagtgctaagagaaggcctggggttgaacaggccacagttcttctcaaccttccattctaagtcaaaggagaagaaatacagctaatacactcactttccaatgctgttcaattccatttgatggagttcccacctgccttgaggaataaactgtccttcaagtttaattcattctattccattgtggtacacacatcagattaaggtagatactgggggactccagagatggggacaattccacagacactgtgccattgccttgggccttcagagctccgagagggttagcccaggcattgttctctcatcctatttctaatggtctttatcttctccctgctcctccagcccagccacatcctcttctcaatcctccatctccacctgcttcattcaacctctcttccatcccctgcttctgtgagccttggagtgcttatggcagtagtcaacctagggcagatagggccaggccttgaggctatggtgagaaagtcagaaaaatggaactagaatgataattggggtggaacatgaataataatacctactatcattattactattatttcacttataatgattcttactatgtgccaggcactggtttaagcattttacatgtatagtatgagctcatacacttgtgttaactcatataattaactcaactcaaacgcatgagttcatactgcatatgttacagcctatggggtaagtgcaactatgatcccactttagagacgaggaaacctaggcacagagaggttaaagtgccttgccctgggtcattcagctggtacatggaagctagaaccccaccacagcaagctggctgtagaccctcatagtaagccacatttggggacaccaagcaagctagaccaaggcaagtggctgcatttggtttgggaatgcaagctgacccacggaggtcccagaggatcagaaacaatccataataacttttaggagatttgctagaaggcagggagtttagagtgtctgtggctcctgctttgtagttctggaaactaaagccggggagttagggctacgtgacatgcctgcagttgcaagaagtagctgcaagagagtggaatttgcatctgcactgcacactaggtggggcagagccaacgttcaggaaggtgtacatgtctacacctgcacaggcgcttctggaggaggcaggtgtggcaagccccctgctgaggaatccagccagggaaggcatcctttgtcttgctctggtggctttcaagcaaagagcccagtgtgttttgcaggcgtccattcatgagcttagctcctgagctgcactgactggatgacgggcgtccccgcccaggagccagagactgtgtctccacatgcaggcagggccagcgtgaggtcaggattaaccagagaagctgtgctcttcttgcagcgccacactaggctgggcggggggcctgctgaagtgactggtccttggaagcacaaagcgtggagctcccacagccaaaggccccagaggttcatcatgaggggcttgtgaggggagccagctatgctcccccctgtcatagatgaggaaactgaggctcaaaattaaagctggaaaatgatttctggaacctcaaatcaagtctactgtcccctattccaggtctatcttcccatataccatgctgttttgggtacctatgccatttaaaatatcaagcagaatggggacttcttgagcctaaatcaggctcaccctggggaacaagttcagaggaccccatcagtatccagggcagaatattcatttgcccagtgatggatgcatttgggccccgcttggaggcgggagagattccttgcgcaccctgctattgcactgctgctccggcccgggcctcttcacattggacataacattttcatacgtgctccctccagtatgtagtgtctcttctcttccaagcccctctcctttagatgcccactgaaaacccatctcctgtaatgaaaccacaactatcttcctggaagtaaaattacatcacctcacccgtttgcccttttgctcctccttggttctaaaccctgtagttctcaactcagggtatcttgtgaaaccttgtgtcctttattcttgggcatggcttcagcgtgggtgtcctcccccgtatatactgtcttacgtgttgaggcatgtttgtggttattttgcccaagggaagacaccatccgtgtagtaaggcattggcgtcattccagtggcttctggatctagctagggccatgatggtgtcagtccccatgctacagccaggtcctcttgggtaggtgttactgctgtaggcctctttgcagggccccattgcaggctgataagatgccatccgagtacacagaggtcttctgcaggctggcctttttcccagctcttccagctgtgtttttccccctacccaaatgctccagctccacctccacctccatagtgccatgaatactggctccctttcccgtgccaggctccgtgctaagcattcgccatgctttatctcgttaacctgcactacaactttaagaggtggatatttttatccacattttacagataaggaatatgagactcagagataaaataacttgcccaaggttacatagctaataaatggcggggcctggatttgaaccaccacgttcttaaccgctgagctccaccacctcgttcagtccatgtcggctggtccatggcccatcctcagagacgcctgtttttgcagtgaacaccccctcaagtctttgacaacacccttacctcctcggtttacccttgtgtgccctgagccaaatctgaacctgttgagcttgatcaaagaatgaattgttatttgaaagagaaaacaaaaggtgaggatgactcactttacgctcttctttgagccactatttattgagagctttctgtgtctctagcactgttctaggtctcacattaaataaaaacccctgccctcacagagattacagtctagtgaattaatagcatgcctagtgctgacaagctgtaagaagaaaggcccatccagaaggaggagtgagggccctgggaagtaggggggtggctgcctccctgccctggcagctgagggatgacctgaggcctcagcttttcatggggatgggtcttgttccaaggcagagagtgctggtgaggccgtgagggtttcaggggcacagaggtctccaagccttctcatttctgctggtggtgatatggagccctaggtctaggcagaggcagtccatctggaactctagcttctgtggcatgaaatggccttgttgaacatgatagtgtatacagattatctccaattatcagtgagtgaaggagccctttacgaaattttaattcttcccctgcccagatgctccagctccacctccaccttcacaggaatcataaccagatttcctcttctgacccacctcttcccttctcccttctccctcctccctgcccctgcccccaccccctcaaattggtctggcctaaggccatgcagagtaattaacctaaacccaacaaatataattagaaaagtaaatatgttagccaaagcagtcttatactatatttcaaaatcaaatgtaagtaatgtaagtacacggtgggaggtgcaaaggcttcccgagcaccaggtcctttgcacctatcatctccttaaactaaccctcactgcaaacttatgatctaggctttatcctccccattttgtaagtttaaacaaacaaacaaacaaacaaacaaacaaaaaaccccaggcttaaaaaggtaaagtaacattaccaacattacataaatgtcaaggttgagtttttaaccaaagtatgtctgacccacaagtctgtggtagttctgttcccatctagtcccagggcagccatttatgcagaaacagtaaccttgggcaaactactttaccttccactgcctcagtttcccatctgtaaaatgggcccaatgctgatagctaactttcccctcaacctcagttctgttctggtgatcacatgaactggtgtctaggaaaggccacagaactttcaggtactgtgaaaatacagtattaatcctacccttgaatttagaagtgattatggcttttccaccatttaaccttgttggtatccagttcagcatatctggtttatttttcacattcctgttctgagggtagtctctggctgctgactgtaaaatctgtgttgctctctctccaggaattagcatctcctcttccacagctgtacttcagctgtacctcaggcccctgattgccaagttgtaggtgttctataacgttctttcttctggaatcccaagcgagtagtccatatgcacttctttccagtagtgtgctggtaaatgtttaacagctgggtttccaattgtgaatctgatgtgaatgttggttaataattacatctacaataataagtaagataaaagtgaaacaacaaagacgcattttggaacttcactggttttttttccatatgagccacttttttgctgaatcaggtaatcgttttcaaaaactagaaaaatattacctcaatatattatgtgattcacaatgtcactgctacagacacggcacacttttacgtctaatcttactgtattaacattttctctagcacttccataagtctagataatcaacacaacaataaatcaagccctgagtatagagtgtgccaatttctgtggtgtaaatattctcaccacggccaatttcaagctaccaatgtgatgttactgactgtggaattgggaagagagtcagtagtatactacgctacagtcttcccaccatatgtgtaataaacataactcaagcacatagatgatagtaaactgtagtttaaaaaaattaggatctgatctgttgttagtatttattacctttttaaaatataattaattatatgtttatatcatttaatttttaacaatggctgtgttccacagccagcttgcaaaattcctgaaaatttaccaatcagctttcacaagccaatgcaagcttcagcacaccaccgtcccgttcctcttcccgttagcccagatgggtcccatgctatctgatggccacaccctttgttaaatagctccagttagtcctgatccacgcaaatcaagagaacattagtcaatgcccagtttctccaaataaacaacgtcaacagcttcagtccagtggagtgacttaatgatctgtttccttcaataaactgtgatttctgaactcaattcagatacctgagcgtcgcagtaagctgagagtgaggcccagaggcgttcataatgtaatatactaagtttaaacttggcaagcagatgacattgtgagaaatggctttttttaggccgattttgggagtttggggtgtttttttaagagttaagccaaggcaaaaaaataacccttgcaacacatcacttcacagctggtcagcccaggagaggctattctgggatattcaagctaaagaacctctttttaaactccaggcaaactggaatcaggatgcagggtttttatttttgtctgtcatggatttactctgtccagtaatcctgtacagtaatctctgtccagtttgttccctgggtgggcctcagtttaccttctggagaagtcaagtcagctgcctttacctagggcattattcgatttttgaattgtggagactgaaaaaagatagttgctagggtttatcagagggtttggagtgtctactcgaggtgttccaaatcagcggagagtcagagaggggtgaagttgaagtaggatcttataagaaatgacaaatgaacaagatgtaagagagaggaggaggaagaggaataggaaggtgaaggaggaacaagggcctccaagcaacgtaccatgaaaacatcgggcaagtggctaaactgtgcgtccagtgttcactttgctaagacggagagtgagggcataagatgatttagttacagaagaaaaggcaggcaagatggagcaggcaggtgccttttgtctgggtttgacaagagagtttcctgggtagggaaggaatgtgatcaaagttatgattctaagacctgcctggaagatgaccagggagtgggcaaacttggaagcaaaaccagcctcccaaacacctgtgtaatatcgtgtcctgggccactgtataaataacctccctcctgttcatcagtaggctttgtagttctcagcctctctcctctgttgaaagtgtgagccagccctttgcatgaagaagcattagaagggatcactgcatacttctttaattgtcaagaatgcatacatgccatgcatatgaaagatatagtggactttggggactggggagtggagcaggttgggagtggggtgagggataaaagattacaccttgggcaccgtgtacactgcttgggtgatgggagcatcaaaatcgcagaaatcaccactgaagaacttatccatgtaaccaaaaaccactcgtacccccaaaaatattaacattaaaaaaaagaattcccaccgtgccttaaacttatgtcatctcactttttttttgtcagcagcctagagggaaggggacacaatcccaattttaacaccaaagcaactgagacctacagatattaaattacttgctccagattacaactgagactcaaacccatcgcctggccacaagtctggtgccctatctacaccaatctgtctccggtaaacctaactagctagtcaacttttcccatccataggccagacaccttttgaaataacaaaccatctgatctctagaaaaactgaaaggccagttccagttgtcagacacaccaagctcgagagagtctctcccaaaagttctctggaaagcccagggattccgaattccaaagccagccaaatttgaatttcctctataaagagatagtccctcctggtttagaacataaccttcctcattaggctggttccatgttttgtaataacttttgcttacaccacaaaattgtcatagattacgaaaacacaaaggccttggaaaaaaggcccagagccccctggaagtcattatttcttcctttagcaattgctgagttaagcaccataaatatggttcccatcctgctccccttcccccgccctccccgccccccacgatcagctggacatatgttaggaagaaagcagggacgtgggggtggaagaagattcgcatgtcgtgaatcttgagcactgaaaagaaaaagtggggagagggcggggagtttgcagccctggaaatggaatctctgaaggatttattgcctttgagtatctcacaaggcttttttttttttaataaaaatctgtagcttatggcttttttttttttttttttttgtatagggcagtaaacaagagctctgaaaggggaaggaagccaggagaaagccagctccattagtcacgcagcagcatatcctgtcacaaaggaccccagttgagtaatcgcccaaaatatgcctgttatttttttctgtcagaaaaaaaatggggcctgccaaaacgtactgtaaaaaaaaaaaaaa

SEQ ID NO: 95 - DNA, 20078 bp, Homo Sapiens
tttctgtacttttccttttattttccattccctggtgtcttcgtcccctcccagccagggtcatggctctcagacggatggccacagtgctggtgaaagacagagggattatttcatacactagggcactagctgtggtacagctggcaggaagagaggtgtaattatattgcatcttggagccaccagcaatgaatttctgcataaaggactagatttgccatgtattatttacgtcagcatcaattttcccagctggctctatttactgtgcaaattctcctctgtctgtttatgggcaaggccatggttcagcacctctggttatgctgtactgtggaggggccccacagggcaccatgcatattaaatgagtggctggattcaccaggagcaggtcataccctccctttctgttaaattatatccctggaactgcagcgagcccacacgttctcacctagtcatggtgatgcaggcaggtctgaaaccaaatcagcaagaggaaaggaggaataaactgttctttgggcctcactgggggaaactgaaaaacagccttctaaggggaaatcaggtggctctagggctcggggaattgcctttttatatttttaagagcaaaacagagatgaagaagagtatttcatttataagcttatttccacccagtaactcagagacagagctaaggaagagtgggcccccatctaacaaatggaaaggcagagacaaaagaaaaaaaaggcagcagcagcaaaggcaagttagaggctttcccggcttggccactgcgctaggagggagcacaggacacaatggtgatgcacaggattatccatccagtcgccagcatgcctcatcagagatgctcccagccagggtgaacttggtttccaccagaaacatacacgttagaaataagggaaggaaacgtggcaccagtatgaatttctgggtcctcgcaatgcagcatcctctttcgcctgtggtttatatgcttacagagagtgaggccaaggaacccaagatgtctcttctggccagcctgagaacgtctgtagtcaccagtgccaggtggcagtaaacagcaggcgttactgggaagaaaagttgggaggggtccccaatgcttccctgtttcccaaacaacagcacaggtcatgtctgatcaccctgtaatgtggcactctgctctgaggtcccccaggtcccaatgtctaccatctcctggaaacctgttggctggaagaagaagtaaggagtcagtggagttaagcaacccaagtgggtagcttctttagttgcaaggtttcagcctctaaagagttcttctcgaagacatctgtgggtatggaaaccaccctccagggcccaagattactggcatcttcctggggctggctcacctgtcgggaagatttggccagacacgccatgcgccggccgcctgatgctcctgctccctcgatggtgtccaggagaatccgagtgctgggcacaaagctccaggagcgtccgagggcaggtttgagcctcccgctgtccctgtctcgagttatgtggttggtcacctgcagcagaaacagacttacagatccataatgctagtatagaggacatcgattactaccgcttcattttacggagaggaaaacagaggcctagcacagagaaataacttccccaaggttacaaaacctaatggcaggtctggaactagaacctgggcctcctgacttgtgccccgctctttccactaaatctcgatgcctcaggtttgacccgaaccagaaggcgatggggcacatgtcaccatgctttccaggctggtctcaaactcttgagctcatgcagtccgccagcctcagcctcccaaagtgctgggattacaagtgtgggccaccacgcccagacactcagcctttaaaaggaaggaaagtctgacacatgctacaaggtggatgaaccttctggacattatgctaagtgaaatactccagtcacaaaaagtaaataccatatgattccatgtatatgaggttcctagagtagtcaaaaagcatagatacagaaagtagaatggtggttgtcaggggctggggaaggggaaaatgagttatttttaatgggtacagagtttcagttttacaaggtgaagagttatagagatggatggtggtgatggttgtacagcgttatgaatgtatttaacaccaccgaactgtataccttaaagtggttaagatagtaaattttatgttacatgtattttaccacaataaaagaaactggaaaaaatatatagctgctaaaaattacatttctaaaaaatctattttaaaacataggaaatggactcagatggtattttttatgttgttgttttggtttgtttgtttttgagatgaggttttgctctgttgcccaggctggagtgcagtggcatgatcacagctcactgcagcctcgatctcccaggctcaagcaattctcctgccaccaaggccacctagtttttgtattttttgtagaggtggggttttgccatgttgcccaggctagtctcgaactcctgggctcaagtgatccaccagccttggcttctcaaagtgctgggattacacgcataaaccagcgcacctggcctatttttttttattttttcatgaggttagtttagttagaaagctggttaagtgtgggctcacacctgtaataccaacactttgggaggctgaggcgggtggattgcttgagcctggaaggtcgagctgcagtgagctgtgattgtgcccctgcactccagcctgggaaacagagcgaaaccctatctcaaaagaaaaaaaaaagaaagaaagaaagttggctaaaagtataagtaaatatgcagaaaaagtattgtatggagatatgtaaaaatattaatatggtttctgtggatgtggagattgatgacaaatttgaatcatatttattttctatcctttctatgagaagcatgcagactttaaaaaaactacctcataagcagaaaaagttacttcaatagcaaaaagatccatttatatgaagctctggaaaaggccaaactattgggatggaaaacagatcagtggttgcctgggcctgggggaccttttggtggggtcacaagactggatacaactatatccattagtcaaacttcaaacaaggagaaagttactctatgtaaattatacctcaataaacctgactaaaaagaaaaaatgtagaaacaaaacaaaacaacaaaaaaacaacaagacgattcctgattcccttagctatttatggtgcaaagctgtagctgacccagggaagctgggatatgtccctttcctaaagggccactttggggttcagaagctgacatttaagggaaataaagagctcgcaataactagaaatcaagttcattggccaagcctgcttcctcaccaccactgccatgccaaggtcccgggccagggtcttcagctctcgggccagctgcatcatcaaggccaagcctgcaggaggaggagaagcagagagggagggcagtggggaaccagggatggggctggccagagaccagactccagagctgggaggcgaggtcacattccactggccccaggctctgccacatcactcaccttccctctgctgacctcccagaagtggggaaaccaccgcagtgaccgagtccacaaccaccaccttcacagttcctgaagaaccagtcacctgaaggaatgtgggggaagcactcatgaacctgtcagcctctaggacacattacaggacaagcttgcttttctatctaaaactagtaagaaatagcccccccatcccaaatacagcaagctgcacgggcatcacagaatgtcatcagcagcaatgtctccctcgtcccattggcatgtgtaacagacttcaatgaagacttgggtagaaagaaagggtttaaatcacaggacatcaaaactacactaaagtggctgggcgcagtggctcacgcctgtaatcccagcactttgggaggccaaggcggtggatcacttgaggtcaggagttcgagaccagcctggccaacatggtgaaaccccgtctccactaaacatacaaaaattagctgggcgtggtggtgcacacctgtaatcccagctactcaggaggctgaggcaggagaatcgcttgaaactgggaggcgggggttgcagtgaactgagatcacaccgctgcattccagcctgggcgacagagcaagactctgtctcaaaaaaaataaaataaaataactaaaaactacattaaagtcatcaaatttcagaaagctccgcagagagtcctgaggcctctggtcatggatctctcagcagccatctctctcctgtgtccagcctcccaccatggtggtaaggcccttcttttccttttctgactccctcctttctttcccttgtcctgctaactaccaccctcaaattcctaacttcctttgctgaagagtttagccttctctttacttcactgtctccttctagatcatgcctctaggcctcatcttccgtatctaaaatgcctccaaataaattccctaagtcttgctctgtcacccaggctggagtgcagtggcatgatctcagctaactgcaacctctgcctcctcggttcaaacgattctcatgcctcagcttcctaagtagctgtgactatgggtgcacacattgggtgcacactacgggtgctaatttttgtatttttagcagagacggggttttaccgtgttggccaggctggtctcgaaatccggcctcaagtgatctggccactttggcctcccaaaatgccaggattacaggcatgagccaccaagcctagcctgtgccatctttctaaccataattttctgtctttacacaagcaggagaatcctcctggtttccctggacttaaactgtttttgatgcttcttttctcttctcccttacttcttatatcctgattctggttctttttcttttcttctttctttttcttttttttttttttaagacagggtcttgctatgctgcccaggctggtcctgaactcctgggctcaagtgatcctcctgccttggccttccaaagcattgggattttaggcgtgagccaccgctcctagtctcagattcttaacccctagaaactgtgagataagaaatactatgtcttaagccactaaggttttggtaacttattatgcaataatagaagatatatcatctaatggtcctacagtaaaaaatacagtcttctgatctggaattgagaggtttgggctataaggttagttcttgccctaaatatttggtcaactttggtcaactcacttcacttctccggccttcactcttctcatctctaaaagtgaggtaagcactactcagcttcatgtctcaacaagctggtgggtcataaccagctatgacttctgaggtaagtatttgttcaacatttttttttaaagacggggtctagctctgctgaccaggctaaggtacagtggtatgatcatagctcactgcaacctccaactgctaggctcaagcaatcctcccgtctcagcctctggagtcattaggattacaggtgtgggccaccactcccagcttgttcaactattatatgttctaaagtttgtaaaaatcattgactttatatatagtcgtggggatgcccgtgtgaacacgtcatgctttggggtgagaggaaaagtttgagataaactattctatctttaaggtatcctccacatctagtcatttataaatcagtgcaccaaatcctgtctaagcacccaacatgagtagcaaagtgccaacccaaatgccattctaaatccttcccattaacatgactctgaatgtgttcagcgactgggcagaaatctgacttcagggatggtgggcccaggtcttagtccaagatacacacataaccccattttggccaactagatgtaaggggaagagggacgtctattagtgggctctggagaaagattcttcatccctgataaaagggaggaggtacagaaaagaaccatctatcttttactgccttgaatatggatgtggatgtgtgaagacaagatgcttggagctttggcagcctctttgcaaccatgaggggaagaacaagaaaatcagacacacaaatctattgccctgatagcatggacctgccaacctcccaactcatgtgacataattaaatgtcctcaagcttcaagtctctgtcagacaacctctattacttgcagctaaaagtattcctcactcacctagtggggaatgcagacataaatatgacatgatccttccactcagggggctttactgttcagcagggaagatgaacatgtaaacaatgaggtatgtgatttaggtgctcgggaattccatcctgggagtagcaagcatagttggagtcaccagattgcacatctgcatttccaaacagtctgtagtaggacacctgcccacagagatagcacctagaaagctgaattaagcaaggaggggcagaacagcaggctcacctgctgggccacagtgcctcggagctcctgcagcacatccagcatctggaagatgtcaaatgcatgcaccacctggatcctccggagagcttctgcctgaagcggtggaaaagaaaagcaaggactttggataagagggagtaggggggtcaaggtaaggctgagaaggaagaggcacctggatgcaaggactcaggtccagggtggcaaatgagctttgtctaatggtcagttgtcacagtggtggctgcctgggtgctgagctgtaaagtactcagaactcagcaggaaagagggatatgactgattagtgatgtctctcacaggtgagaaatggactggaaacacaaagcttggtgtttgccagccctggtttagggcatgcaaagagttgggagggtttcctggaagaatcagtgtgagtagcatcccaaatgggatgatggcatcaacaggggtggcttaaggaatacgagatgtattaatagaacagcaagtttgaaggcaaggaatgactattcaacccaaattcttacaatgttaagggataatggggttttcctgtgtcagaatctcaatggaacccagcatcctgcccttacctgttcctcctcatcctgggttttagcctgaagcagctggaggaggcgggaagctgtcagccctccattggaatctacatataggacgttttgctgcaggccatgggccacatttgctgccatacagagacatacctgggggtgggggcattggatgaacttgacacttcagagagggtccagatgggagctccccaccaaaccttgcccagattccagcaacacaaatgggctgagtcccgaccccattccttattacccatcttctctctgttgggctctgaacccattagtacgctgaagctcccccagggaccctgggctatgcatctaccaccctcacccctaaatcctcctgactgctggcctcacatgtacctgagttttgccgctacctgggcctcctacaatttcagtcacttctccagtatagagaccagcatcaagcagtttatcaagactgatggcagaagagaagaaaatcaacacaagaggttaggaggaagacaggggaaaaggtaccaagaagaaaagtaagacatttctttcaagcactggttctgtctttgaacatcactggccaggaggcttctcctggtgttttcttctggtaaggagggaatgcccaaatgtgccttctctggtctctcttcatccctccactcttaaagatcagctctccagagaggcctctgccaccccatcagaaggttctcccttcatttttcatctcaggccctgtgggtttcctttttttttttttttttttttttttttgagacggagtctctctttgttgtccaggccggagtgctggagtgcagtggcgtgatctctactcactgcaacctccacctcccaggctcaagtgattttcctgcctcagcctcccgagtagctgggactacaggtgcccgccaccatacccgactagtttttttaattagagacggggtttcaccatgttggccagcctggtctcaaactcctgacctcaagcgatccacccacctcggcctcccagagtgctgcaattataggcgtgagtcaccacgcccagctgtttgtgggtttccttgatagcgtttcccaaaatttgtcgctttttttaaactttgatggtggcacacgcctgtagtcctagctactcaggaggctgaggcaggagaatcgcttgaacccaggaggtggaggttacagtgagccgagatcacgccactgcactccagcctggtgacagagcaagactctgtctcaaaaaaacaaaacaaacaacaacaacaacaacaagaaaaaacaactttgagataattatagattcccaggaagttgcaaaaagtccatgaacccttcacctggtttaccttaataataacaactgtactacaaaatgtattgtactagccaggggcctgtagtctcagttacttgggaggctaaggtgggaggatcacttgagtccaggagttcaagtctagcccaggcaacatagcaagacccttttctctttaaaaaaaaaaaaaaaaaaaaaaaaaaggactatagtatatcacacaagtagcaaactgatgttggtactatccacagagcttattcagatttcaccagtgttcctagcattcaagcacgtgtgttgatgtgtctagtcctatgccattttatcacatatgtagatttacacgactactataatcaagatacagaacatttccatcactataagtcttcctcctgctacccttttatagccacattcctcccattcacccctaatcccgaatccctggcaaccactaatctctattatgttatttcaagaacaaagttatgtacatagaattatacactgtgtaacctttgtgattggctttttttcttttcttttttttttttttttgagacggagtctcgctctgtcgcccaggctggagtgcagtggtgcaatctcagctcattgcaacctccacctcccaggttcaagcagttctcctgtctcagcctcccgagtacctgggattacaggcgcccaccaccacacctggataatttttgtatttttagtagagacggggttttgccattttgggcagactggtctggaactcctgacctcaagtgatccgcccaacacagcctcccaaagtgcggggattacagacatgagccaccgtgcctggccctgcgattggcttttttactcagcatcattcccttgagatccatcccagttattgcatatatggatagttcattcctttttactgctaaaaagtattccatggtatggatgtaccacagtttatttaaccattcatccattgaagggcatttggttgtttccactttggggctactataaataaaactgctataagcattttttacaggtttttgtataaacccaagtttttacaacgttgggataaatgcccaagaatacaattgctgggtggtatggtaaatgcattattaattttataagaaactaccaaactattttccagagtggctatgccattttacatatccgctaacaatgtatatatgagtagtccagtgtctccacatcttcatcagcatttggtattatcattatttttttattttagtctttctgataggtatgaaataatagctcactgtgtttttaatttgcatttccctaatagttaatagtgttgaactttttttttttttgaaacggagtttcactcttgttgcccaggatggagtgcaatggcgtgatctcggctcaccacaacctccacctctcaggttcaagcaattctcctgcctcagcctcccgagtagctaggattacaggcatgcaccaccacgcctggctaattttgtatttttagtagagacgaggtttcttcatgttggtcaggctgatctcaaactcccgacctcaggtgatcaacctgccttggcctcccgaagtgctgggattacaggcgtaagccaccacgcctggctttttttttttttttgagatagggtctcacgtctcactgtgtcacccaggctagaattcagtggcatggtcacagctcactgcaatcttgacctcccaggctgaggtgatcctcccacatcagctcccccaagtagctgggactacaggcatgtgccaccacacccagctaatttttgtatttttttggtagagacagggtttttgccacgttgcccaggccagttttgaactcctgggctcaagcaatctgaccacctcagcctctcaaagtgctgggattacaggtgtgagccagcccttgcccattttctaattgaattgtttgattttttattgttgggttttaagaattctttcttcattctagatacaagtcctttgttgaatacatggcttgtaactatgtttcccattctgtacttctcttttcattctgttttgcacagcaaaagttttaaattttgattaggccccattaatcaaaaattttttcatggatcatacttttggcatcaaatctaagaactctttgcctagattttctcctgttttgttctaaaaattagacaatttggttttacatttaagtctatgatccattttcaatttttgtataaggtataaggtttaggttgattattgtatatttttagcctatgatgtccaatagctccagcgccctttgttcaaaggctgtctttcctccaacacattgtttctgtacccttgtcaaaaatcaattgtgtgtaatcccagcattttgggaggctgaggcgggagcattgcttgagcccaggagtttgaggccagcctgggcaacataatgaaaccctgtctctataaaaaaaatacaaacaggctgggcgcggtggctcacgccagtgatcccagcactttgggaggccgaggcgggcgatcacctgaggtcaggagttcaagaccagcctggccaacatggtgaaaccccatctctattaaaaatacaagattagctgggcatggtggcatgcacctgtaatcccagctacccgtgaggtcgaggcaggtgaatcaaacccgggaggcgggggttgcagtgagccgagatcacgccattgcactccagtctgggcaaaaagagagaaactcaggccaggcgcgttgactcacacctgtaatcccagcactttgggagtccgaggcgggtggatcacctgaggtcaggagttcgagaccagcctgaccaacatggagaaaccccgtctctactaaaaatacaaaaaagttagccaggcctggtggcatgtgcctgtaggagaatcgcttgaacccgggaggcggaggttgcggtgagccgagatcacgccattgcactccaggtcaggcaacaagagcgaaactccatctcaaaaaaaaaaaaaagagagagagagaaactccgtctaaaaaaaaaaaaatacaaatacaaataaccaggcatggtgtcccacacctgtagtcccagctactcgggaggcttggggtggaaggattgcctgagcccagggaggtcaaggctgcagtgagctgtaatagcagcagtaccctccatcctgggtgacagagcaagactctgtctcaaaaaaaaaaaaattagttgtgtatacttgtggaggtctatttctgggttatctattctgttccactgatctgtgtccatctgtcccttggtcaataccacactaggcttaattatgtagctatatagcaagtcttaaccctgggtagactgattcctccagctatcctttttccaaattgttttagctaatctaggtaaaactggtcttcccgtaattattagaataagcttgtctatgtctatagaaaaaaaaaacttgctgggattttaataggaactgcgttaaattacagatcaacttggggacaattgaaatcttcattatgttcagtctcccaatccatgaacaaagtacatgtcatccatttatccgagtcatctttgatctctttcatcaacaatttaaaaattttcagcatacagattctacacatgctttgttagacttatacccaagtatttcatttctctgaaacaactataaatggcattgtgtttttgtttgtttgtttatttgcttgtttttttgagacggagtctcgctctgtcgcccaggctggagtgcagtggcgcaatcttggctcactgcaagctctgcctcccaggttcacgtcattctcgtgcctcagcctccccagcagctgggactacaggcacacactgccacgcccagctaatttttgtattttcagtagagatggggtttctctgtgttagccaggatggtctcgatctcctgaccttgtgatctgcccacctcagcctcccaaagtgctgggattacaggcgtgaaccaccacgcccagccattttgtttgttttgtttttttgagacagtttcactctgtcacccaggttgaagtgcagtggcacaatatccgctcactgtaacctgcatctcccagattcaagtgattctcccgtctcagcctcccaagtggctgggattacaaccacccaccaccacgcccagctaatttttgtatttctagtaaagaccaggtttcatcatattggccaggctggtctcgaactcctgacctcaggtgatccacttgcctcgaccttccaaagtgctgggattacaggcatgagccactgcggccggccaataaatggtagtgttttttattttagttttgacatgttcactgtgagtatagagaaatgcagttgatttgtatgtgttggtcttgtatcctcactagtcctaggagtttgtaattatttgttatttgcttgtttttgtttgtcttgctcatctagctgagagcaccatggggcaaggactgggtccgatccctgtcgcatccccagcactagcacagtgcctgaaacacaggaggcacccaataatcattccagaaaaatgagtaacagaaaggtgctatcacttttatttcgcttctgtatcatcaacactggctgtgaaagacttgggataaacctcatgacatgccaattcctaaaccaggttctctccctcaaccacatgaaacaggtcaccacctaccctccatgccctgccctatctctaggctgaagtttcttctatgccacggcctgtaccaatgcctgatcacatgcgtacctttcctagccctacaatcaccttcctaggttccagtccttgagatggttcttgatgacctcccatgacctctctgtatatgccgaacagcactttagtaagcatcccatccattttttttttctttttgagacggagtctcgctctgtcaccaggctggagtgcagtggtgtgctctcggctcactgcaacctccgcctctcgggttcaaacaattctcctgcctcagcctcccgagtagctgggattataggcacccaccaccacgcctggctaatttttgtatttttagtagagatggggtttcgccatgttggccaggctggtctcaaactcctgacctcaggtgacccactcgccttggcctcccaaagtgctgggattataggcatgagccaccgtgcctggcccccaaccattttaattccagggactccccatgattatacccacaggttcctgccagtcaaaacactctggttaccactctagccctgtggcttcttgagataattgtgctcaccccatctctgtttaataagtatccagcctctaccactcctgattccattcttcccattgagatcagaggaaccccagtgtggtccccagaccaggtgcatcagcaacctttaaggactagctagaaatgcaaattcacagctccgctccccaagacctactgaatcagaaactctgggaatgcagcccacacttgaaacttgagtttcaacaaggcctccaagtgattttgaagcctgctcaagtttcagaaccattagactagagtagttagtctcaatcctgcctgcacattaaaatcaggggagttggctggacgcagtggctctcgcctgtaatcctagcactttgggaggccgaggcgggtggatcacgaggtcaggagatcgagaccatcccggctaacacggtgaaactccgtctctactaaaaatacaaaaaattagctgggcgtggtggcgggcgcctgtagtcccagctacttgggaggctgaagcaggagaatggcatgaacccgggaggtggagcttgcagtgagccgagatcgcgccactgcaccccagcctgggcgacagagcaagattccgtctcaaaaaaataaaattaattaattaaataaaataaaatcaggggagttttttaaaaaatgcctatgtcagcagtacccaaagttgtctgcacattggattcacctgggagcttcaaaaaaatactgatgcctggccaggcatggtggctcatacctgtcatctcaacactttgggagacagaggtaggattgcttgagcccaggaatttgagaccagccttggcaacacagcaagacccctgtctctacaaaaaaaaaaaattttttttaattagccaggcatggtggtgagcacctgtagtcccagctacttgggaggctgaggcagggagactgcctgagtccaggagttcaaggctgcagtgaactatgattgtgcaccactgcactcctgcctgggcaacagagcaagaccctgtctctaaaaaacaaattaaaaaattaaaaaatactgatgcctgtgtcccactcacagtgaatgagattaattggtctgggggagacttggacttcgtaatgtttaaaagagtcctcaggtgactccaatgggcacacaagtttgggaaccactgacctagactaattaaattagaatatatagagttgggaccagagcatgaatatctcaagtttcccagatgattctaacgtgcagctggggttgaagcactggtgttgactctagtcaagaatcaaccacatccttggctgtggagatcagtctgtataaggtattcccaaatccaccttccagccaacttctcacctgagtttccattccgtgcctctccgactgcccagagaaccttcctaccaatatgtccccatcacctttaactccgcatgtcaacagggagagacccctgtcttgccccatgaagcagaagtacacctgggttttaccactgcctagaatacaggtgatttctgggacttatcctctgcctttccctctgaactgccttttagccattctttcagtcatccattcacacaccacttcaatgcctcatatttcctgacagtcttattctaaaatgaggggactgtgggatgaacagacctagctctggcctataaggaataatcaatctccctcatcaacatagcttttcccaaagtacgttacatgctataacaccctgtaaggaatcattgcacctcagcactaaaggttctgaggcggcctacaacagagaaacctgtttaatttggattagtcaggcatttctcaaacttctgactacagaactcccctcctcccaagttttaaagttacaccattaactgtccacagcacacggtaagaaaggctagagactgggcatggtagctcacgcctgtaatcccagcactttggaaggccaaggcgggcggatcacgaggtcagaagatcgagaccatcctggccaacatggcgaaagtccatctctactaaaaatacaaaaaattagctgggcgttgatggcacgcacctgtagtcccagctactcgggaggctgagtcaggagaatcacttgaaccctggaggcggaggttgcagtgagccgagatcacgccactgcactccagcctggcaacagagtgaaactccgtcaaaaaaaagaaagaaagaaggaaagaaggaaaggaaggaaggaaggaaggaaggaaggaaggaaggaaggaagaaagaaaaggaagaaaggaaagaaagaaagaaagaaagaaagaaagaaagaaagaaagaaagaaagaaagaaaggctagaaacctggtgagtcagctttgattcttcacaatacattccaaactccgacaaaaaaaaaaaagaaagaaagaaagaaaggctagaaacctggtgagtcagctttgattcttcacaatacattcctcctggtagtaggtcttgtcacagttcctcttcaacatgtctcccactgttctagactggactcacataccccaggccagcactgccagggccctgcttggcctctgccacccttccaccctgcacacctctaccccactgtctataaccctgctttcacaatggcctcccgcctccagggagacagccgggcagatgagttaagagccgcgttcttagacttaggagtgtgacaagcatgaactcaaataactggtctgccgtttgctaactgcacaatcttgaacaagtcatttaacctgagtcccaatttcttcacctatagaatgatgatttatttttattttattttattttattttatttttttgagatggagtcttgccctgttgcccaggctggagtgcagtggtgcgatctccgctcactgcaagctccgcttcccgggttcatgctattctcctgcctcagccttccgagtagctgggactacaggcgcccgccaccacgcccagctaatattttgtacttttagtagagacggggttttaccgtgttagccaggacagtctcgatttcctgacctcatgatccgcccacctcagcctcccaaagtgctgtgatcacaggcgtgagccactgcgcccggcctagaatgatgatttaaacagtaacatgctcattggtggttgtgacgaataaatgaaataatgtaccgtgaagtgctgaccgcagtgcctcgttcatcgaaagcattcagcgaaagtccatctgttcctccatgcccaagtcctgccttcttcagagcattcctgaccccactccacgatctccctgcggggacctgaggcagctgcagtcctcccaggttcccacttgagtgcgccctccatgtctgttggatttataaactccctaagcccaaggccaatcggcttcctgttcaccactccctccttaccgttgcctccctcggtgcttacagctctcttgtattcacttgattttcccctacacccaactagaggccttaagggcaggggccttgcctcattcgtgtatgtatcatctgcacataccaagcacccagcaggcccttagccagtgcttgatggatcacagactcagacccccaaccagggaaagcaagcaccacactgcatgaaccctgccaagagaatgtgttaaggaaacagaaagggccacaccaatccaaagacctttatggtggcagttattcatcaatttctgaacaaacagaccaggaaaaaggtcaagactcacttggccagcaaacgtctgtcgtctttgcaactcttccccaacccaccaaacaacgtggcgggacataactgctccttttttttgagagagtctcgctctgccaccaaggctggagtgcagtggtgcgatcttggcctactgcaacctccacctcccacattcaagcaattctcctgctgcagcctcccaagtagctgggactacaggcgcccgccaccacgcccgactaatttttgtatgtttagtagagacggggtttcatcattttgggcgggcaagcaggccaggcaggtctcaaactcccggcctccagtgatctgccgcctcagcctcccaaagtgctgggattacaggtatgagcactgcatctggaccgcaactccttctttctctgaactctcctgttctctactgctgcagatgtggtgaataagttctgggccacatactcccgcgcttgagcctcacctttgccacttgctcctcttaggctaaactcaagtagggttaattatctctaactggtagagtcactgaagagattacctagaacatacaggtaatgcctgcacatagtaggcactcagtaaatgttctctcttgccatatccttaagtaaaataagaagtagggccagagaagatggtgaaaataatgagatactgacagcttgtgttataggacaatgcttctcaaccagaggcaattgtgcctcccaggggacatttagccatgtcaggagacatttttgatggttacaactggagcagggctggtgctactggcatctagtgggcagaggccagagatgctgctaaacatcctacactgcacaggacagcctccaccccccaacaaataattacctgtccctaaatatcaatagtgccaaggctgagataccccataaccctgttataggataagaattcagatgtcctgacccctttccttcccatccattattggttaaaaaaaaaacccctcccgtctagactcaagcatcaaaagcagagctgagaggaggccccatcctcctgcctctctccttcttccccaagtacacacacaaacctgccaatgccagtggacaggatggcagtggaggtcttcagttcctcgtagagatcagcgccattcacggggaaagccgagaactgagccagcagcacccgcctcagggcaaccagggcctgccaaagggccccagactgctcagcaacaaattgcccgtagaagctggcatcccagggtgtcattcaccctacttctcaatatctgagaaccctctgctccctttggcttgggatggacttttgttattgttgttgtttcagacagggtctcactctgtcgcccagattggagtgcagtagcacgatctcggctcactgcaacctctgcctcccgggctcaaatgattctccttcctcagcctcccgagtagctgggattgtaggcgtgggccaccacacccagctaatttttgtatttttagtagggacagggtttcaccatgttggcctggatggtctcgaactcctgacttctgactccaagtgacccacccgcctcggcctcccaaagtgctgggattacaggcatgagccaccgcgcccagctggcttgggatggactttttaaaaagacactcaggtttggaatgtggagatcaggagctcaccttgtaagacaagccacatttctgagctacctcttccaggtctgcagaaaccaggtccaccactgaaaacaaaacacgtatagcggattggcagagaggactggggcctcccacacttggtttttcctcatctgtcaaatggggtgtcaattctaccccccggcaggccgtctcaggaggccagtgtgaaataacaaagctgcaggagccggcgcggtgccctgcacacagtaggaatctctaccctgttttagagcttggctccccacgcccacccttcctgagcctctccagaagcgcggccctctaggaatggaggggaagcgccctgcaggtatgccagggcagtgcgccagccctcggggcctgcccaggttgtgcgaggcccgcgcggctccctggcacgcgcacacccggtcacctgtcttgatcctgtggctcctgagaagctggatcatctcctcggtaaggccagggcacagtccgaccctgagcacgcccatgttccccgcaggccggaacagccccagggggactgcacgtcacgtgggcattcgcggggggtcctctccagacgcccctcccctaccccttcctagagaggacacaggcgcgctggctgccggaggagaaaggagagaggaggaggcggcaccaagggtagggctgggggtcatccgcccgcccgggatccgccgggattcccgcgcccagagcccgcccgccgggtcgcgccgcgctgccgcttccgggttccag

SEQ ID NO: 96 - DNA, 61133 bp, Homo Sapiens
gcctttgtcatcaacttttattttaattctggggtacatgttcaggatatacaagtttgttacacaagaaaacgtgtgtcatggtggtttgttgcacagatcaaccccttgcctcggtattaggcccagcatccgttagctattcttctcgatgctctccctccgccgacccccaacaggccccagtatgtgttgttcccccgctccatgtgtccgtgtcctcttctgggtctttgatagtcttcactgatgctttctgctcacgctcagataatctgcattttcacgtaagataaaataatcatagagcagaggcagcagtcagctatgtgtttgtttcaggcgagcagagggatgactttttagttttgtcctttgtcctgtgcttgtgatggtaaaccatcaatgtacattgtcggggtgaaattcaacggaactgttttagtgtaaagatcttggaggcccacaaggaatttctttgtgggcaaattgtgagaggcctatgtagctttttttgttttttgtttttttttagagacagagtctcactctgtcgcccaggctggagtgcaatggcgcgatcttggttcactgcaacttctgcctcctgggttcaagcaattctcctgcctcagccttctgagtggctgggattacaagcatgcgacatgacgctaatttttatattttttagtagagactggcttttgccattattagccaggctggttttgaactcctgacctcaagtgatccacccaccttggcctcccaaagtgctaggattacatggccaccgcatctggccttcattatatattacggtgtaataataatataaataggccgggcctaatagaaatagtctggctaacatgatgaaaccccgtctctcctaaaaatacaaaaaaattagctgggcgtgatggcgcatgcctgtagctactcaggaggctgaggcaggagaatcgcttgaattggggaggtggaggttgtagtcttaaaaatggtatttacaggctgggcacagtggctgacgcctgtaatctcagcactttgcggggctgaggtgggcagatcacttgaggtcaggaactcgagatcagcctggccaacatggtgaaaccccgtctctactaaaaatacaaaaaattagccaggtgtgatggtgggcgcctgtaatcacagctactcgagagcctgaggcaggagaatggcttgaacccaggaggcggaggttgcagtgacccaagatggcaccattgcactccaacctgagcgacagagcaagactctgtgtctaaaaagacagaaaaaagagaagtttcctctagagcgctgaatgacaagagacaatgtggagagagaagtctcatacttacaagtatatcctgccaagaccccagatatacaagtgaggccatcccagacccttcagccagcctactagctgaatgtagctgcgtgagtgagctatttccttcctccccgcaaaatcccttatctttttcttcatgttttcatcttaggatatgaaaaggaaactgctgtagttgttttttaaccatgaagggaacttttggagaacagaaccagcacaccgaaggtggggaaagtggagagaaggaaagaacctgggcccttgatgacattatagagtcactgtattagccaactgtggagctggttgacttctggacttcttatttgaaatgacatgcttcctcattgtttaatctacttttttgagctttgtgttacttgtagctgaaagcattctaactgatacactcctcaaccagctcttctaatacaagtacaaaatctgaaacaagtcaggcatggtggcatgtgcctatagtcccagctacttgggaggctgaggcgggagggtcgcttgagcccaggcatttgaggttgcattgagctatgattgtgccactgcactccagcctgggtgacagactgagaccccatctgtaaaacaaacaaacagaaaatctgaaacaccttgcatagtatacaataggcattcaataagtttatcattaatgaggaagtaaaagaagattttgttgtaaagaatgctaattgcttatccaacaaccattctccctttctcccttttcaattaagagtcaggaggctggcgctgtggctcacacctgtaatcccagcactttgggaggccgaggcgggaggatcccttgagcccaggagttcaagatcagcctaggtaacatagtgaaatctcagctctacaaataataaaaaaattagctgggtgtggtggtgtgtgtgtgtggttccagatactttccatatacgtggaaggctgaggtgggagcgtcacttgagcccaggtgcttgaggctgcagtgagctatgcttgccccactgcactccagcctgggtgacagagagagaccctgtaacctctggaaaaaaaaattgagcgagagagagaagacagggtcttgttctgtcacctgggctggagtgcagtgacacgatcacagctcactgccatcttgaactcctaggctcaagcgatcctcacgcctcagctgctgagtacctaggtctacaggtgctcatcaccatgcctggctccttttcctccttaataacagaactccaaattttagctgggcatattgatgtctggaacaaaagtctgtattttcctacctcttttgtgcatgggtatggccaatgagatataagcacaagtgttgtatggtagggctgctttacaggagctgagtcagctagacagagcttttccttctttttttttctttttgcccttctgccttttatctttctttctttctttgagacagggtctcactctgtcacccaggctggagtgcagtggcacaatcttggctcactgcaacctctgcctcccgggttcaagagattcacccgcctcaacctcctgagtaactgggagtacaggcgcatgccaccacacccggataatttttgtatttttagtagagatgagatttcaccaggttggccaggctggtctcgaactcctgtcctaaagtgatccacctgcctcaacctccctaagtgctgggattacaggtgtgagccactgcacccagactgccttttatctttcttctctcaacttggtttctctgactagagctccagctgccaacttaggcaatgagctgaccttgaagacggaagtcaaaaattaagatggtcaagcagaaagatagaggcctgcgggcctgatgacaaagtggacccactgtagtagcatctctggactgcctagctttagatttcttttctatgagagaaaaataaacctgtattttgtttgggacacttattttgggggttttcccttatattcagtcaagtaaaatctaagctatccctttaacaacttccctctcaaaatattgaagcctggcgtaggaaagcacgtgaagagtatgaataatgagagctgtcccacccgagtgttaagcaagcccctcctggcttccctttctccagtccctgaaggcggcacttgagaggcactctgttgttaccttggttggagttctagatggcaagtgatagaatctaactggctaactaaggcaaagggaaacttattagaaagacattaggggctgagcgtggtgactcatgcctgtaatcccagtgctttgggaggccaaggcgggtggatcacctgaggtcaggagttcaagaccagcctagccaacatggcaaaaccccatctctattaaaaatacaaaaattagctgggtggggttgtgcacacctgtaatcccagctactcgggaggctgagacaggagaatcgcttgaacccaggaggtggaggttgcagtgagccaagatcacaccactgcactccaggctgggtgacagagctagagtctgtctcaaaaaaaaaaaaaaggacattagggttcattgaattagcagaagactgcagaaacagcctgggcatggatgggagtctgagccactcagcagtctaggagccggaaaccccagtctagcagcaggaacagcctggtcaggcctctgccactgctgctaggccctgctgcccctgctccccctgctgtcactgcaggtgtgagcagcctctaacccctgctgtcatccttgtgactgtcacttcatattcaatgtctcaggatgcactacctgaattggggagaggtgactctttgaaagaaaacaagtgttattatgatggagaaatgcaaactgtgcaaccagaaaatgtgaaacatttgccctaacaagccagggtcagttgaaggagtcctgactagccacacttggtgtctaaggcccaatccttctcctcaccatgatgaaagatatcccttgtatctaatctctttctctttctctctctctttcttttttcttttcttttttctgagacggagtttcactcttgttgcccaggctggagtgcagtggcaccatctcggctcactgcaacctccgactatccggttcaagcgattttcttgcctcagcctcctgagtagctgggattacaggtgcgcaccaccaaacccgactaatttttttgttggggtttcgccatgttggccaggctggccttgaactcctgacctcaggtgatccgccctcctcggcctctcaaagtgctgggattataggcgcgggccactgcgcctggcccagaatgaataatctatgaggaaaaaggcatgttcctagtgagttttctaacttgatgcatcccaccaaagttagaagcagtaacttggctactgtgtggggaaggcctgtttgaaaacaatagcagcacggaaatcagcagagcaggagatggaggcagcaagatcgagtcctgaggctgctgtcgacaccttggcttcacctgtggctgaagtcagctcttcctctggatttttcagtttcgtgagccactgaattccttgtcttgcatttgctagcattgttagaggtgttcaaaccagagggattccatcttgaatagtggctgggtaaaataaggctgagacctactggcctgcattcccaggaggttaggtattcttttttttttttttttttttttttttgtgagatggagttgcaggctggagtgcagtggcatgatctctgctcactgcaacctccacctcccgggttcaagcgattcttctgcctcagcctctggagtagctgggactacaggcatgcaacatgacgcccagctaatttttgtatttttagtagagacgggtttcaccatgttggccaggatcgtctagatctcctgacctcgtgatctgcccacctcagcctcccaaaatgctgggattacaggtgtgagccaccaggcattcttaatcacaggatgagacaggaggtcacaaagatacaggtcacaaagaccttgctgataaaacaggataggtaaataagctgccctaaacctaccaaaaccaaggtggcaatgaaagtgacctctggttgtcctcattgctcattatacactaattatagtgcattagcatgctagacactcccaccagcgccatgacagtttacaaatgccatgacgtcaggaagttatcctgtatggtctaaaaggagaggaaccatcagttccgggaattgcccactcctttcctggaaaattcatgaataatctgccccttgtttagcacatgctcaagaactaaccgtaagtatactcagtcaagcagcccatgctgctgctctgcctatggaatagccatttttttattctttttttttttttttttttgagacagattctgttgcctcagcctcccgagtagctgggactacaggtgccagccaccatgcccggctaattattgtatttttagtagagatggggtttcaccttgttggtcaggctggtcttgaactcctaacctcgtgatctgcccacctcagcctcccaaagtgttgggattacaggcgtgagccactgtgcctagcctgaaggcaagtttattaagaaagtagccggggccaggtgcagtggctcacgcctgtaatcgcagcactttgggaggccgaggcaggtggatcacctgaggtcaggagttcaagaccagcctgaccaacatggtgaaacctccatctctactaaaaatacaaaaaattagccaggcgaggttaggcatgcctgtaaccccagctacttgggaggctgaagcagaattacttgaactcaggaggcggaggttgcaatgagcagagattgcaccattgcactccagcctgggcaacaagaatgaaatccctctcaaaaaaaaaaaaaaagaaagaaaaaagggaaaaagaaagtagcagggcacggtggctcatgcctgtaatcccagcactttgggaggctgaggtgggtggatcacctgaggttaggatttcgagaccatcctggccaacatggtgaaacctcgtctctactaaaaatacaaaacttagccgggtgtagtggcgggcgcctgcaatctcagctacttgggaggctgaggtaggagaatcgtttgaacctgggagtggaggttgcagtgagccaagattgcgccactgcaccccagcctgggtagcagaggaagactccatctcaaaaatcaatcaataaataaacaaacaaacttgtttttgctttactctatggactcaccccaaattctttcttgggtgaggtccaagaactctctcgggtctggattaggacccttttctggtaacagtatgtttctgtggcttgcaaccaaaagagtcctaaccaataaaccctcttttttgagtgctcctctcccctatataggccagaaatagaccagacctatgtctacactcaaatggagagtggaggactggaaagccatggtcctttgctcacaggaaacaaattgaaccccggcctagaaaagctcagtgggcactggtgattttcctgctggcccagatacctgcataatctgcagttctgtcccaaagttgggccccaagttacagctttttagttcacattctaacactcagccactgttctccaaagcaggacatgtaagagtggctggacccagagagatttccagccttagccagatgccatattgaaaccagcttctccactgaactttaggcctttgttttgggccctgttttccaacccaaatgcccacttcttggtaaattgtccttcgtcaggggtactctgcttaacccagaaaaattctctgaatttcaagtcttgagagttttatttctgtccctactaaaagactctgggctgctatgcaaattggtccaccccctctccagggctcctcataccagggaatctctaggagatgctcagtttttatcaaggatgttgtcaaagctatttaaattgtacatttataggatagtcagatgtcgccacaggaggaaagataggagaggcttgtagaagaaagtttattatactcaggtcctaaagagggggtcaccacatgccatgcagagatcactggggaatgtgggggtagtcaggaggcagaacactgggatgggggagagcttgggccatggcctttgttgacatttctgaggcagggcaggttaaacagttgaggagtggccagttgaataatctttttctttttctttatttttcttttttgagacagggtctcactgtcgcccaggctggagtacagtggtgccatcacggctcattgcagcctcgacttcctgggcttaagtgattctcccatctcagcctctgagtagctgggactacagacatgccaccacacctggctaacttttgtttgttttttgagaccaggtttcaccatgttgcccaggctgaaatttcaataggctctaaattagatgggtggcccctagttgcctggtagcagggcctgggatgattaagggaaaggaatagtctcttctggagtgtaagggccagatagagctaggatggctgtagattagttagtttgcgcatcaaaggcatgctcttggctagtgcctttgctatctctaagaattggctatccctgataggggcagtctctccccagctagaatgatttttcaagatgttaaaacaggccgggcgtggtggctcacgcctgtaatcctagcattttgggaggctgaggcaggtggatcacctgaggtcaggagttcgagaccagcctggctaacatggtgaaaccccatctctactgaaaatacaaaaaattagcgagcattgtggtgggcgcctgtaatcctagttactcgggaggctgaggcaggagaatcgcttgaacccaggaggaggaggtttcagtgagctgagattgcgccattgcactccagcctgggcaacaagagtgaaactgtgtctcaaaacaaaaaacaaaacaaaaaacaaaacaaaacaaaacaaaaaagttaaaacagcataatacacagaaaatttaaaatatacacaatgaatcaagtaacaaagccttcctttccctaggacaaaagtgtgcctttatatttgcatacgaaaataagccatttaagtgattttgcagaatgcagaaaatctgctcctagatgactttatttctgcttattcagggaagcagcttctgtggttttcaaaaggtaaaaggaagaaaaaaagctcctatttcccagtatcctgcattgtgaacaatttctacttgccgagttagtctctgttttctttccatatcccagctcctatacctttgcagtctctcagcttaacctttcccctcccatttttggaattttacttttttttttttttttgagacggagtctcgctctgtcacccaggctggagtgcagtggcatgatctcagctcactgcaacctccgcctcctgggttcatgagattttcctgcctcagcctcctgagtagctgggattacagacgtgcgtcatcgcgcccagttaatttcatatttttagtagagatggggtttcactgtgttggccaggctggtctcgaattcctgacctcaagtgatccacccacctcggcctctcaaagtgctgggattactggcgtgagctaccgcacccagcagaattttactttttctttaagggtcaatccaagattacactgcttatgaattaattatataatcatttgctctcttgttttcctaaatattagtcttttctcttaactagtgtacacatgctttatgtgtaggaaccacattttccttgtttattctttagcgcttagcattaataataattagtgagtgaataatttcatgaataatcaaataccttttgtaacaaatggtacttcgaatacttgaattttcttctctttccttctttttttttttgagacagagtctcactctgtgacccaggctggagtgcagtggctctatcttggctcaatgcaacctccacctcctgggctccagcaatcctcccacttcagcttcctgagtagctgggacctcaggcacacaccagcacgcctggctaatttttttgtatttttgtagagacggggttttgccatattgcccaggctggtcttcaaactcctgggctcaagcaattcactcgccttggcctcccaaagagctgggattataggtgtgagccaccacgcccagccctggaattttcatgtaagttgatgtaacattaaagtctataaagattgaagtctataaagctcttcattgtatattgtcattagtatattaatttttacatattttcaccatacatgcattttgaaaacaggattttatttgtttaacaatcaaaataatatcttttacacatttctaagattagtattcagaaattttacatttaaattaattttaacattttaaaaaagttttttttttttttttgagacggagtctcactctgtcacctaggctggagtgcagtggtgccatcttggctcaccgcaatctctgcctcctgggttcaagcaattctcctgcctcagcctccagagtagctgggattacaagcacatgccactgcacttggctaatttttgtatttttagtagagatggggtttctccatgttggccaggctggtcttgaactcctgacctcaagtgatccacctgcctcggcctcccaaagtgctgggattacaggtgtgagccaccacgcccagccataaatacattttttaaaagtaatttctgcttgtcaaagtcaaatgatttaaaatttggcttaatttaatgtctgttttctgttgctataaaggtgaatatgcagtttgatattataaatagaaagagcttttgtgtgtgtgtcctataaacattcctcccttaaatcctcttgtggaaaaacatctagctatgtaagtcagtggcactataccctagaaaaatggtgaagggaaagtccttaggagaatgggacatttctgaactcttagactttctgtttagtggctcactttgaaaagtgaaagggagggaatcacgtactcctttcccaacaactagttttccataggtatatatacatacacagagtgagagaatttcaataggtatatatatctactatatatgtcaggtatacacacacaaacacacacacacacaaacatacatatacatatccctgaatttacatacaatgtatagttatcataaatcagggacttttaagataaatataagatttaaatctctttgctgacttttctttagtaacatgtgggaaaaaacctctatttcaagatgtgaaattggagactgcttttccatttcttcagctcctaataagcactaagaagcaatttgcatcaattcaccacctactccttggcatccccaattcctccagcagttattgcgaaggtggcttcattttcaggcatctcaggactaacagaatacaagggaacagaagtttataaaaagctctatttctataaatactatattcatgtcacaggcattatgtgcccatcagtctgaatctccagagacatctcagagttggtacaaccaaatgtggcctacagaacttacccacaagtattattaaccctcacaaacatttattgagcaacttctatatataaagttctgaatgtcaagaaaaattactccaaacttggaaacaggtgaaaggataactggatgttctttcatttatttattttaattttttttttttggcgaagtcttgctcttgtcccccaggcaatggtgagatctcgtctcactgcaacctctgcctcctgggttcaagccattctcctgcctcagcctcctgagtagctgggattacaggtgcctgccaccacgcccggctaatttttgtatttttagtagagacggggtttcaccatgttggccaggctggtcttgaactcctgacctcaggtgatccgcctgcctcggcctcccaaagtactgggattacaggcgtgagccactgcgcctggccaactggatgttcttttagtatagtgtcaggcattgtatagcagccccttagaggtttatctgattctataggggtatgcacctttcttatgactagactaatgtaggagcaaactgtaaaatactttgaaataaattaaaagattactgagtaccttccatggaaacataggttgtctagcacatcctcccaggttatccaattcttttttgttttttgtttttgttttttttttttgagacggagtctcactctgtcgcccgggctggagtgcagtggcgcgatctcggctagtctcaaacttctggcctcaggtgatccgcccacctcggcctcccaaaagtgctaggattacaggtgtgagccactgtgccgggccaaaatctgtaattcttaattaaacacgtaaagtgctgagaaagaatatagggtataatatactgagtagcctagactgtaagggttagggaaaggttccctgagaaagtgatgtttaaactgaaacctgaaaaacaaatagagttaacctggcaaaaagaaaggaggatatgttcccatacttgatacttaccttgtatttaacacaatttaattggaattgatgatttcattatctaggtgtatgctttgaaaggtcagggaccaagtctatgtgtcaatagaatccctcaatccctagtacctagtaacagtagggacttcccaataaattgaataattttttagaaagaaattcaaacacacagcatctggcagtaataattacagccttgtggtggctcacacctatagtcccagcactttgggagcccaaggtgggaggattgcttgagcctaggagtttgagaccagctcgggcaacatggcaaaaccccgtctctacacacacacacacacacacacacacacacacacacacacacacacacacaaaataaaaaaaaatttacctgtcataaatcttggcaattctgagctctcctcttccctttcgcaagcttattcttgttgttgaagcatgagccagaatgtgtcccccaatgggttttttgggatctgcctgaaagctgaattaataaaatactctttcaggtttcatcatatggactatatatggcaatatctgcaattacaaggcaatctttctgtggtggatgtcaggagttggaataagtgtatattctaaacaagcagaggcttgttcataaactaaggagtgaggtgagttttggagctgctatataccccatctagtctaggcttttgagattcctatgataaatagtttatattttgtttgactttttttttttgagatggagtctagctgtgtcgcccaggctggagtgcagtggtgtgatctcactcactgcaacctctgcctcctgggttcaagcgattctcctgtctcagcctcccaggtagctgggattacaggtgcccaccaccacgcccagctaattttttgtatttttagtagagatgaggtttcactgtgttggccaggctggtctcgaactcctgacctcatgatctgcccgcctgggcctcccaaagtgctggggttacaagcacgagccactgtgcccagcctgactttaaaaaatgagattactggctgggctcggtggctcgtgcctgtaatcccagcactttgggaggtcgaggtgggtggatcactgaggtcagaagttcgagactagcctggccaacatggcaaaaacccatctctactaaaaatacaaaaattagccaggtgtggtggcgtgtgcctgatgcttgtaatcccagctactctggaggctgaggcaagagaattgtttgaacccaagaggtggaggctgcagttagctgagatcagccactgcattccagcctgggcaacagaataagactccttctcaaaaaacaaacaaacaaaaacagaaagaaaaaaagaaaatgtgggcttagaaatcatcaataagggaacagcacaaactaaaggttatacttgatcaaaataaactatgatatagaataatagcttcagttctgaaagaatatagttacaagtcaattcaagttgtgcttgctccattaaagtgttcatgattctggttttactctaagcttcaggcttggtatagcaaggatgtagctgattggcatgaggttaaatatatttagactgtaggttggtcgggataagaagctctttggtaaaggagtttgctgagataaactgctacttgattaaatggctcagaggttaggaccagaagacccctggttggtgctgaataggattaagattcagtagaaactggacactatggcacatatctgtagtcccagctacttgagaggctgaagcaggaggaccacttgagcccaggaattcagaggctagcctgggcaccatagtgaggccctcttaaaaacatttttaaaaaaatgttttaaatgcaaatgcagcaggtccaacataggaacaaggacaaagagttagttttggagtgaaccactatcaagaaagtagtagccagacagttgagactaacggcggcagttaagaagtcagaaagctgggttgctttgccaggcacctgacatggtagtaaagcaataaagccttctcagttggataaaatagctagataagtgagttgtctctataatgcttacagatcgatgccacttaacttttcaggtcaccctaccttacaggtggttcttcatggttttaaaataatcttatgttctatatagatgggctgcttgagaccctgaggatattctcaactgagctatgaactccgagcctgcaaacactgtatttatgcttctgtaatgtacttttcatgttctgcctttagtactattatttatttacttattgtattccttctcaattcctctcttattctctatcactaagctccttaagggcagactatattgtgtttagttctgcacaaccaggcacacagtgggtgttcaaaattgttttttcagctacgtgggaggctgaggcaggagaatcgcttgaactcggaaggcggaggctgcagtgagctgagattgcgccactgtactctagcctgggtgacagagtgggactctgtctcagaaaaaaaaaaatagttttttcagcttaagatatttatgctacaacaattccaaggggaatattggactgcaaaaagattggtgttttcacagaagttaagaaaaaataaaattgagaccagttggaaatttctatcaaaaggagctaagaacggatagtcaaggttagctaaatgggcagagagaagtctgaacacaatgctactgcttctcccagctagtctctcaatgctgctcattctcctgtgtgagcatggttggctttactgcctcaccttcagtagtctccttaagcccccttttccattcttatcccctcaccttggatgacattgcctgctactttataaagaaaataagggcttggccgggcacagtggctcatgcctgtaatcccagcactttgggaggctgaggcaggcagattgcaaggtcaggagtttgagaccagcctggccaatatggtgaaaccttgtctctactaaaaatacaaaaattagctgggtgtggtggcgtgcacctgcagtcccagctactcaggaagctgaggcagaagaatcacttgaacccaggaggcagaggttgcagtgagctgatcgcgccaccggtggccctccagcccaggcgacagagcgagattccgtctcaaaaaaataaaataaaacaaaataaaataaaataaaactaataaataaaaaagaaaataagggctctcaggaggacacttcctcaacttcttctttctgtccaccacctatatacttaactacagttgtactcatgttttctccttccctctaaaacttccttttttctgatttcagaaagtcttcttatccttgatgactttgcacacattactccctctgaaatgaaagctcctttccccaccgtgtctgctcattcagctcctacacagccttcaagtgtcctcccttctaggaacccttgcctggttccctgaaacagtagaaaactggccccctctgtgctttccaacagtctgtattcttttattaaagcacactacaggtgggcgcagtagcactttgggaggccgaggcgggcggatcacctgaggtcaggggttcaagatcagcctgaccaacatggagaaaccccgtctctactaaaaatacaaaattagccgggtgtggtggcacatgcccgtaatcccagctactcaggaggcggaggcaggagaatcgcttgaacctgggaggcagaggttgtggtgagctgagatcgcaccattgcactccagcctgggcaacaagagccagactacgtctcaaaataaataaataaattaattaattaattaagcacactacatggtaattttaaatgtatgggtcttattccccaactatactctaaatatctgttcatctttgaaactccagcgcctggaaaagtgcctataatatacagggtactccataaatattgcagaatgaatacagagatgacaatttgggactccctggtctaggtccttcttggacacagatttgtgtcatatcttcaaaactgtaattcagggaacttttgaagagtgttctgacagaggcaaatataaaagaagatagattcccccagttgaagcaccatgcctcccatgccattatagataacctaaacaagactgggaagctagagcttctagatgtatagccatgatttttttttcttagcaaactattgtttgctgttactagtgtggtacccaatgtgcaaaaaagaatagagacaattgcttgtcattactgtaggtgaagagcctgaatgttaagaacattatttccaaaaggagatgattttgaatcacccaaatggggaaataaattatagcatttgcaaaagggcaaagaaaacatataggaatgaggctgggcagagtggctcacacctgtaatcccagccctttgggaggctgcggcaggtagatcccttgagcccaggagttcaagaccagtctggacaacatggtaaaaccccatctctacaaaaatacaacaattatctgggcatggcggtgcatgcctggagtcctggctactcaggaggctgacgcaggaagatctctcaagtccaggaagttgaggctgcggtgagtgttcattgtgccactacactccagtcactccagcctgggtgacagagcaagaccttgtctcaaaaataaaataaaatacataaaataaaagaaaaaaaaagaaaaagaaagatattatggggataaaaaagtctaacaaatgattaataaactaagaagttatatcaaaataggctgtgacatagcagccttaactccaggagactatcaagccaattcaaattttgtttgtttgatataatccataggtttaaaagaaaggaaaacaaacaaattttgtttgttccactaaggtgttcaggattttgtgtcaaatttatggattttttttttttgagacggagtcttgctctgttgcccaggctggagtgcaatgccgtgatcgcggctcattgcaatctccacctcccgggttcaagcgattctcctagcttagcttcctgagtagctagtagtagattacaggtacatgccaccacgcccggctaatttttgtatttttagtagagacggggtttcactatgttaatcaggctggtctcgaactcctgacctcatgatctgcccacctcagcctcccaaagtgctgggattacaggcgtgggccaccacgcctggccaaatttatggctcttaacctttcttgtaggtcactaacactttgataatttaataaaaacatcccctccccaccaaaaaaagggcacatatacacacatacaaaaatttttgtgtaagtctgggaaattcataaccccttctctggtgtacatgggtattaataataataataataactaagatttactgagtccttgctatgtggcagacattcttctaagtcatcaattttttttccctttgcttggattccatatctagtaaataatttcagattaaaatttggattcctattgaggtctacttacagggagagaatgtgctggtcacatgaatctcaaatgtagctacattttcgttatcaataaactggccgtctggttcttcattcagtctcatgagcttgattaatgtgtgtctgcccccaggaaacagattggttcttagtaagctgaccaaatcaaatctctgcctgcaaggctgagggctctggactatggtcaattcactggagaaatggatacatccctgcaaaacctctcaggtgacagcataccagccattccccaggcagaagcagtcctgatatactgtgtgttgtatgagctatggagttagacctgagttcaaattctgtctggctttttagccatatgacttgaagaaaattgtttaaccattctaaatctctccttcttcttttatttttttttttagacggcatctttctctgccatccaggctagagttcagtgccaggatctcagttcactacagcctccgcctccccagttcaagcaattctcctgcctcagcctctggagtagctgggactacaggcgcccgccaccaagcccagctaatttttatattttcagtagagacagagattcaccatgttggccaggctggtcttgaactcccgacctcaagtgatccgcccacctcggcctcccaaagtgttgggattacaggtgtgagccactgcactggacctcctttttctccttttttttttttttttttttgagacggagtcttgctctgtcacccaggatggagtgcaatggcacgatcttggctcactgcaacctctgcttcctgggttcaagcaattctccctgcctcagcctcccaagtagctgggattataggcacccatcaccataccggataatttttgtatatttagtagagatggggttttgccatgttagtcaggctggtctcaaactcctgacctcagatgatccacctgcctcagcctcccaaagtgctgggattacaggtgtgagccaccatgcccagccttacttcttcatttttaatgggggataataactgtacttaatagttgtaaaataaaatgcaataattcaggtaaggcataactccagtgactgcaattatttacctgctttcctaatcctgacttaaacatttattacctatattaccttggggtacctttatgaacctcagtttctttcactataaaatgggaataaaaagactttacctcttagggcattgtaaggattcaatatatattgaattttttttttttttttgagacagaatctcactctgtcacccaggctagagtgcggtggcatgatctcggctcattgcaacctccaccacccaggctcaagcaattctcctgcctcagcctcccgagtagctgggattacaggtgtgcgccatcacactcagctaattcttttgtacttttaggagatacagagtttcatcatgttagccaggatggtctcaaactcctgaccttaaataatctgcccgccttggcctcccaaagtgttgggattacaggtgtgagccactgcgcctggcctgaatcttgaatattatacatacaaggctcctatgtgccaggaactgtacctgttcacttacatacatttgttctatccttacggcaatcttggcacataagagatcctcgataaaggataattattggctgggcacagtggctcacgcttgtaatcccagcacattgggaggccaaggtgggcagattgcttgtttgatcccttggaggcccacaagtttgagactaggctgacaacagggtgaaaccctatctgtacaaaaaatgcaaaaaattaacccggtgtggtggcatgtgcctggttctgtgctgccttggaggctgaggtgggaggatcacttgagcctgggaggccaaggctgcagtgagctaagatcatgccactgcactccagcctgggcaacagagaccctgtctcaaaaactaaactaaactaaaataatacataggataactattatttaactaaacaattcagctaaaacagtcactctgtcagtgaaaagtagaccaggaaacttttcttaaagtttctttgaacttcctgactattacagcagttataaccaagtcttgaggtgaagtacaagaaggtataatagcattccacattcttttagagggctttaattttcttctatttctttctttctttcttttttttttgacggagtttcgctcttatcgcccaggctggagtgcagtggcaccatctcggctcaccacaacctccgcctcccaggttcaagcgattctcgtgcctcagcctcccaagtagctgggactacaggcgtgtgccaccatgccctgctaatttttgtatttttagtagagacggggtttcaccatcttggccaggcttgtcttgaactcctgacctcatgatccacctgcctcggcctcccaaagcactgggattacaggcgtgagccaccgcacccggccaattttcttctatttctgaccaagtaaaaacagcttcagaaaaccacccacaaacctccttgagcctatcatcttatttcttcttcttttatattttcttctcttcttcttttttccttttgtcagggaactagggagtatggcaaggaggaggagatgggggtggatattagtagtaaagaggggatgagaatatttcacttctccccctctggttgaacaggatatggcatattatattgttgagagtaagacccaaaacagcctgacctggcaatgtcaaattaggatgctggggtcatgaaacatatatagagttatggtataggatggggaagatggtacagtgaggttcaagtagcattaactttgatgtcaaagatacctgggttcaaatcctggctcacacatttttaaattctggaattgggcaaacgctaagtattctgagcctctgtttccacctttataaattaggaataatcatcatgcctaccttaaatactgcttagagtgtggatcttgaggggcatgggcaagggcaagcttgagggacaataagtactcctgatgctttttacttactaaggagtgagattacagatggcattttcgagaagtggtccattgaggagagaaagattgaacttgcccaagaatgaggaggcttttttggagatggagtcttgctctgtcgcccaggctggagtgcagtcacatgatctcagctcactgcaacctcagcctcctgggttcaagcaattctccctgcctcagcctcccaagtagctgggattacaggaaccccccaccacacctggctaatttttgtatttttaataaagatgcagttttgccatgttggccaggctggtctcgaactcctgacctcaggtgatccacctgcctcagcctcccaaagtgctgggattacagttgtgagccatgcctggcaggggaggctttgagattttgggaagatgggggaaaggggagtaccgccaaagaagaattttgaggaaagagaagaggtggttaaaaaaaaaagggtatgtttaagaagttttgttaagtaattctcccctctgtcttctcccaaaatatgcagaaaaatatacacttttttcaacattttaaagatggaattctgggttcttttttgcggggggaggtgagatggggagggattcaacaacttactgagattggcttcacaaaagcaacagggaggtccaaggaggctgtgagttacattggggtcacatgagaattagataagatgatgcataaaagcacctggcacatggtaagtaatcaataaacataaattaattttgagagggaggaaaatgcagttcaaatagtttaaatcacttgtacaaggtcactatgctagtgaccctggtttaatgttttttctctaatcatattgcctcttaatttatgctaatgatgttggatcagaaggtgacatccttaggacgggtgtggtggctcacacctgtaatcccagcactttgggaggctgaggtgggcggatcgcccgaggtcaggagttcaagaccagcctggccaacatggtgaaaccctgtctctactaaaaatacaaaaattagccaggtgtggtggcatgctcctgtaatcccagttactcaggaggctgaggcaggagaatctcttgaacctgggaggcggaggttgcagtgagccaagatcatgccattgcactccagcctgggtgacaacaaacaaacaaaaagaaggtgacatccttagagaataaactgactgtatatttacaagactgcaaatgttctacggtgactttttgttttcccaaaacaaatacacaaatgaagtaggtggcaacatcatggtcttatttgttgttcatcttgttatttgccccagtgtgggactttatggactgatactttgactttttatctccaagtcttcatcaactggatcattccagttctaaagtctgtatctgtaagcctcatctaggagctactcctcttgctatatcgtatggcagctcctcgcttctataatttcgttcctttttaataagatgtgcaatcaagtataatgcatgggatataagccccaattattgtcagtgtacttgcggactcataccaattatagtgatagttccctgacaggccccaggggaactgcagcttggagtttctcaacactgagaaacaaagatattttctttatgggaggtttcctaatagtatttaaaatcctttagtttaaaattgtccttttttttcccatttagctgtggcaacttttgtgctttatataaagacaagcatttaatttgtattgttataatttaatatactttattaacataccaattatagtgaaccttgtttcctaacaattcagctaggtggaggagatgatgtttcagagttgacttacccagtaaaaatactagcctttgttactttgtctagcactttacttagcttcctcattttcagtctcctccccattccaactccctcttcaattatctgtcatctctctatttctttcattgtcttattggaattaattcaaaattgttttactctttttgaaactttctacaaatataagaaaaagaacccctatctgacctaatttccgctgatttcctttgccttctaactctagagtgacagttttggcctcttcaatgttccctcccgacacctgaagaaagaacattgctctttaacttgtactgttttatttgaatgcaacccacttcctccctctgagccaatgagtcattttctctttttaaaacgagccttaaaaatcttccatttctcttcagtttaaaattattctctttgtgaagcacttcatgtcctgtgtatgaaagtcatcccataaaacagagatgattgccttaaccactcagcgactatactatagacaatgtgtgacttaccaagactaaaattttgagttgaatggacatcatttattgtctttctttttttttttttttcttttttgagacagagtctcactctgtcacccaggctggagtgcaggggtgtgatctcggctcactgcaacctcccctcccgggttcaaacgattcttctgcctcagcctcccaagtagctgggattacaggcacgcgcatttacgcccggctaatttttatatttttagtagagacagggtttcaccatgttggccagcctggtctcgatctcctgacctcgtgatccactgaccttggtctcccaaagtgctggattacaggagtgagccaccacacccgttcacaagacttttttttttttgagacaggttctcactctcttgcccaggctggagtgcagtggtgcaaacatggctcactgcagccttgacctcccaggctcaagcaatcctcctgcctcagcctcccaagtagttaggactacaggcatgtgccaccatgcttggctaatttttaattttttttagagacgaggtctgtctatgtgacttaggctcctgggctcaagcgatcctcctgcctcggcctcccaaagtgctgggattacaggcgtgagccaccgtgcttggccgaggccaggatttttgtcttttttgttcactagtgaattctcagaatattgttacatagtagattttcaataaatattcattgagtgaataaatgatttcccctgctcaatctttttaacttgcttaataacatttgagtagttaatatttttcacaggaatctcttgtaactaagtagaaaatacttataaaagggtcttgaggccagacgcggtggctcatgcctgtaatcccagcactttgggaggctgaggcagatggatcacgaggtcaggagatcgagaccatcctggctaacacggtgaaaccccgtctctactaaaacacaaaaacaaaattagccgggtgtggtggcgggcgcctatagtcccaagctactagggaggccgaggtgacagaatggcatcaacctgggaggcggagcttgcagtgagccgagatcgcgccattgcacttcagcctgagtgacagagcgagactccatcacaaaaaaaaaaaaaaaaaaaaagagtcttgaaaagtgagagatagatatcaaactgcgaaagatgaagcaaaattgttaagggtaaatttggaaaatgcttaaagagagacacattcatttcaatgtaatttacagaatttactccagcatatcaaatatcttttaatatatctgtcaatgatacatttaatctgctaccatatgatgcattgcttctgttttaaagtaatagcactttgtattgcaaccatcagagtaataattaatttactctaattaatttaggcaagaatcttcaatggatgctaatataaatgcatgaaagcttattgcagagcaagatatttacacagtctcaaattatcacaccacaaattactaattaaatataaaagagaatttttgtaattttcttttacaatggagacatcatgtgaatatcatcttaatcatatgatcagaattaacatcactaataatgggacaaactgccatcatgtgcctcctgatatgatatactgagaaggccataatattgcttatgtagttttcctgtcaaaatgcttaacattttaagtaatgaagaaaaaattcaacttcaaattgagggacattgcaaaacagttggtctgtgttctacaaaaatgtcggtgtcataaaagtctaacaaaggttgaagagctgttctgattaaaggagactaaagagacatgacaattacacgcagtgcatgttcttcaattgatcctgaattgaatgcaaaacaaaaaaacccccaacaactataaaggacattattggggcaactggagacacttgaatacaactgtatattagataacattattatgccaatgttagaatttctgaatgtgataattatattgtggctatgtagaagaacatcattattcttagaagagatatgctgaagtattaagaggtgaagtgtcatgatgtctgtgaataattttcagtggttcagaagaaacttctcaaatggttcaccaaaaaatacatatacaggctgggcgtagtggctcacacctgtaatcccagcactttgggaggctgaggtgggcgaatcacctgaggtcaggagttcgagaccagcctggccaacatgaagaaaccccgtctctactaaaaatacaaaaattagccggccatggtggcaggcgcctgtaatcccagctactcgggaggctgaggcaggagaattgcttgaacccaggaggcagaggttgcagtgagctgagatggtgctgctgcactccagcctgagtgacagagcaagactctgtctcaaaaaacaaacaaacacgactgagtgcggtgggtcatgcctgtaatcccaggactttgggaggccaaggtgggtggaacacctgaggtcgggagttcgagaccagcctggccaacgtggtgaaaccctgtctctactaaaaatacaaaaaaaattagccaggggtggttggcaggtgcctgtaatcctagctactcgggaggctgaggcaggagaattgcttgaacccaggaggtggaggttgcagtgagctgagatcgcaccattgcactccagcctgggaaacaagagtgaaactccatctaaaaaaaaaagaggctgggcacagtggcttatgcctgtaatcccagcactttgggaggccggggcaggtggatcgtgaggtcaagagatagaaaccatcctggctaacacggtgaaaccccgtctctactaaaaatacaaaaaattagccgggtgtggtggtaggtgcctgtaattccagctactcaggaggctgaggcaggagaatcgcctgaacctgggaggcggagactgcagtgagctgggatcgtgccactgcactctagcctgggtgacagagcgagactccgtctcaaaaaaaaaaaaagaaaaagaaaaacaaacaaaaaaccgtatacacataccacatacatatacatatgagaatgtgtgtatgtgtggagaaacaaaggtgtatgtacacctccacacacacacacacacacacacacacatacaggagagagaaaaaatgtggcaaatttaacaactgatgaacctagataaatgagtatgtcttgctctgtctcccaggctgaaatgcagtggcatgaattcattgcactagttttttaacttctctctggtaaaaatattttctaaataaaaacctttaaaaaaatcttttttttttttgtttttgagacggagtcttgttctgtcacccaggctggagtgcagtggcacgatcttggctcacttcaacctctgcctcccaggttcaagtgatcctcctgtcttagcctcccaagaagctaggactacaggtgcacaccaccatgcctggctagtttttttatttttagtaaagacagggttttgccatgttgtccaggctggtcttgaactcctgacctcaggtgatcctcccacctcggcctcccaaagtgctgagattacagtgagccactgcccactgcacccagcctttaaaagatttttttaaaagctttttggctaggcaagggggctcacacatgtaatcctagcactttgggatgctgaggtgggaggatcgcttgaggccaggagttcgagaccagcctggccaacatggcaaaaccctgtctcttctaaaaataaaaaaattagccaggcgtggcgatgtgtgcctcccagctgctcgggaggctgaggctggagcatcacctgagcctgagaggcagaggttgcagtgagcagagatggtgccactgcattgcagcttgggtgacagagtgaaaccttgtctcttaaaaaaaaaaaacacacacacactttaaaaaagcattatcatgaatttagatttgttttgctttgtttgagacagtcttgctctgtctcccaggctggagtgcagtggtgtgtatttaggattattttgattgcttattcagacacataatgctcaaaatttgttacggtggcaacaaacctttgtttgatttatctatttttattatcctactttagctctctgtgtgtttctattcactgccgtctttcagagtcatcaatagttatgtgcacaaacacttcaacaaattctgaatatgcctagtgtgaactgaaattctttttcttcaaacaggagacttctcccatagtgcctctgataaatatatctcatgtatatcctgtagaaagatgacttttttgtttttatgaatggtgtttattatactgataagctgcaatataagtttttatttccctaggatctatttcttattgtcctcccatacccctttagccctagaccaaagagaagcccaaagtactgctgaaaatggttaaagtattgctttattctataaagaactagagaaaaatagattctggttaccaagtgatatttacaattatgaagtcatatacactgtgcaataaagtgattttttttttgagatgcagttttgctcttgttgcacaagctggagtgcaatggcatgatcttggctcactgcaacctccgcctcccaggttcaagtgattctcccacctcagcctcccgaatagctgggattacaggtgcacgccaccacgcccagctaattttttgtatttttagtagagacgaggcttcatcatgttggccaggctggtcttgaactcctgacctcaggtgatccaaccatctaggcctcccaaagtgttgggattacaggcatgagccactgcgcccagtaataaagtgatttgtgatatatttgtgcccacataaagactaatgatttttaaattcttttcttttttcttttttctttttgagatagaatcttgctctgtttcccagacaggagtacaatggcgcgatctcggcttactacaacctccacctcccaggttcaagtgattcttctgcctcagcctccggagtagctgagattacaggtgtgcgccaccacacccggctaatctctgtatttttagtagagacggggtttcactatgttagtcaggctggtctccatctcctgacctcgtgatccgcctgcctcagcctgctaaagtgctggaattacaggcgtgagccaccgtgcccggccttgaaattattttctattctacgctctaaccctctttatattaacctctgtgaaataaaaagtagaatattggggcttacgtcatagttgctcctggatcggcagtcatttgattggtcacaaaaacagccacgttatattctgcatcaagagataaaattttaaaactatgagaaaggcaatatagatatttaaaagttcattgtttagatttcagagtttagacatattgcatcatgaatttattttataaataacatcatattcctatttttcattgacaacagaaattatttgttattattattattaaggttagaataaatatttttggtttaaaaagagttgtaaagccgggctcagcggctcatgcctgtaatcccagcactttgggaggctgaggcggacagatcacgaggtcaggagctcgagaccagcctggccaacatggtgaaaccccgtctctactaaatatacaaaaaattggcctggtgtgatggcaggtgcctgtaattccagctactcaggaggctaaggaggaagaattgcttgaacctgggaggcggaggttgcagtgagccgagatcgcaccactgcactccagcctgggcaacagagcgagataccatctcaaaaaacaaaaaaaaaacaaagagttgtattctcataaaggtaattttatttaaaaaaaaatcgctgcctcctgacattatattccaagcttctctgcaaagtatacttgacaaacatagtcacagatgccattttattttaaagatataccttctgagattttttggagtcgtgacaacatctgggccaatttttgctgccgttcggccaactccccacggccactgaaatccactcgaaaaagtgccattattgaatcgataatctacacaggattaatgtaaaaataaacatgcatttggaaattgaaggaagacgttatttgaatagagatcaatagaagaaaaatattatgctaaatagctctgtgaaagcaatatttaaaagcttgtaccaatagcttgaagatgccagcttcttcatggaactttgctgctacataatcaagtagctccatctgatgttcacctgatgggaaatgcagtgagaaaatgttataaaagttgaaagaagcagaggctaagatcattcatattcttgggagccaggcaaaataaattccttgaaggattttcttaattattgatgactttattaaatattattgcagcagggcatggtggctcatgcctataatcccaacactttgggaggccgaggcaggtggatcacttggggtcaggagttcaagaccagccttgccaacatggtgaaaccctgactctactaaaaaatacaaaaattagctgggtgtggtggcgtgtgcctgtaatcccagcgacttgggaggctgaggtaggagaatcacttgaagccaggagttggaggttgcagtgagccgagatcataccactgcactccagcctgagtgacagagcgagactccatctcaaaaaaaaaaaaaaattattgcatattctgccttagcatgtataccaaatgctacattatccaaaaagaatgttactcttaatttcaaagacaaagaataataaataatttgagggcactttattatctaaggacttaccagatgataaaatttatagactgagtaaattaatttagagaaaaataaaatagaaaaaaagtatcaaaatgttgtatccctcaagtagtaaatcagtgctgccaaccttacattgacccaagcatccaactgcatggggctcttactagtatatgcacgtgcataaagtacgttgtccagtactgcatcatggtctacattaaagcgatcagcaatgtccctaaggcgatctggacggctggagtatgccaagattaaggatccaataagtcaattctaaaaaagtttagacaaccactacaaaacataatatcttccgtaaattaacagagaagccaaacaatgtacctgtgaaggtattctagaggatgctagcaaccatttaaagtctatacaagatttgtttattcataagtgcctcaacttaccataggtagtgataatggtcatagaaatgtgaggcagtaatgactttaactattaaattatcaaaactttacaataaccttggaagctagtttttatggcctgttttacattttacaacgtaagacactggcaaacagagattaggcaaatgacttgagcttatgcagcaaatcagttacaagagaaaaactaggaactaagctttgtgagtccttttgttctcagatctataaaaatagacctgtaatagataatatcactgaattataattcaataactgcaaagtgaattaattcactctcttcatacccctcattcctcaatatgaaatagtttattatattattaatcacatgttgttaaatgataaatttgactacatgaaccaaagggtcaaaaaggtaacttcaagggcccagaagagaaatatcgaccaaaggttttttgttggcataggttttctttttcttttcaaatcttacctggaaagtatatacagtttaaaatctactttcttctaaaggagttgttagctttttttttgttttctcctccttcagtctcctgagtagctgtgattacaggcgcgagccatcatacctagctaatttttgtatttttagtggagacggggtttcaccatgttggccaggctggtttcaaactactgacctcaagtgatatgcctgcctcggcctcccaaagtgataggattacaggcatgagccaccatgcctagccaggagttgttagctttctgaaattagcaaattcatagggaagcaaactaagtgcacctgcaaaagtattctggaagaagctaataatcacttatacctataaactataaaggagtaataaacattttttttaggtctttggtgatcccaacaatatgtctgaagtaaaatgaggtaaaattaaatgcatgtttgtaaccttatttcactttgtttatagtgtttacataacactgatcccagtataagtaactgtaaatcaaggaccatttataatcttatttgtgatgtttgcaattaatttaaattcccagccatttatatcctaatgcactagatatgttcttgttgttagagctttggtgacagccacaaaaatcttccattgttattgagtatacccagtagatgtttttggtggacaagttagacagggaattggaagaggcaataaaaacattttcatcatgtcggtttctacaaatcccagatactatgttgtggcaggccaggtcttactaatgcaggcctccataacaactgtttcagcactgactgagtggttaagttaaatattaaaagctgaaagtgcccttatacaaaggctggaatgtaacaaaaggccaccaagagttttgcccaggcctttcctgggccttgaagcatgacaagataatgaagaaattcttaacagtacctgtttaggattaaacgagttttactgggggcctgaagaaactccctaggtctccacaaacaagttattgggggtctgaaggaactccccaaacctccatgatttagcaggagataagataagggtaatcaccccagcacctggacccatttagattaagtaaatttactgaggctccagaggaatgtctttaggactcagatcttagttatagatcaaaagaagttaatcacttatatatttttaaaaatttttattttatttttttgagatggagtctcactctgttgctcaggctggagtccagtggcacaatctcggctcactgcaacctctgcctccctggttcaagtgattctcttgcctgagcatcctgagtagctgggactacaggcgtgtgccaccatgcccagctaatttttgtatttttagtagagacaaggtttcgccatgttggccaggatggtcttgaactcctgacttcaagtgttccacccacctcggcctctcaaagtgacttatgtcgttagatgaatgcacacttacaataaacatatagctgagaaggtatataagttctggaagactttgtaattttgagttggtctggtgttattttccaggtcttctccctgtaaccggttacggaaacaaaaactccctcctttcccagttcatttgcatctcattattgggccataagaataagcagcctgatcctcagtttggtctgggaacaatgtgaccgcgggtgtaaaacttgggcttaaatcctcaacaaaatactagcaaaccaaattcaacaatacattaaacagatcattcatcatgaccaagtaggattcgtctcagggatgcaaggatggttcaacatatacaaatcaatgtgatatatcaacagaacggacaaaaaacatatgatcatttcaattgatgctgaaaaaagcatttgataaaattcaacgttcatttatgataaaaaaaaaaccctcaaaaaattgggtatagaaggaacataacccaacataaaaaccatacacaacagacccacagctagtatcatactagatggggaaaaactgaaagtctttcctctaagatctggaacaagtatgcccactttcaccactgttattcaacataattctcaaagtcctagctagagcaatcagacaagagaaataaataaaggtcatccagattgaaaaggaggaagtcaaattatccttgtttgctgataataagatcttatgtttggaaaaacccagactccaccaaaaagctattagaactgataaacaaattcagtaaagttgcaggatacaaaatcaacatacaaaaatcagcagcatttctaaataccgacagggaacaatctgaaaaagaaattcaaaaattaatcccatttacaatagctacaaataaaattaaagacctagaaattaacttaaccaaagaagtgaaggatctctacaatgaaaactataaaacattgatgaaatacattgaagaggacacacaaaaaacagaaagatattgcatgttcatgagttggaagaatcagtactgttaaaatgtccatactaaacacagcaatctacagaatcaatgcaattcctatcaaaataccaatgacattcttcagagaaatagaaaaacaaccctaaaatttatatggaaccacaaaagacccagaatagccaaagctatcttgagcaaaaagaacgaaactaaaggaaccacataacctgacttcaaattatactatagagctatagtatccaaaacagcacggtatgggcataaaaacagatgcatagaccaatggaacagaatataaaactcagaaacaaatccacacacctacagtgaactcattttcgacaaaggtgccaataacatacattggagaaaggacggtctcttcagtaaatggtgctgggaaaatgggatatccataagcagaagaatgaaattagacccctatctctcaccatatacaaaaatcaaataaaaatggattaaagacttaaatctaagacctcaaactatgaaactactaaaaggaagcattggggaaactctgtagaacactggactgggtaaagatttcttgagtaataccacacaagcacagtcaactgtaggatataataaattcctcttcaaaggttttagcctgtaaattgtttttttttttttttttgagacggagtctcgctctgtcacccaggctggagtgcaatggcatgatctcggctcactgcaagctccacctcccaggttcacgccattctcctgcctcagccacctgagtagctgcgactacaggtgcccgccaccatgcccggctaattttttgtatttttagtagagatggggtttcaccatgttagccaggatggtcttgatctcctgacctcgtgatccacccacctcggcctcccaaagtgctgggattacaggtgtgagccatagtgcccagctgcctgtaaattgttaagtacaatgagttttgagatcctctccaaggaaccaatgtatcagtatgttcagctcccctgttctttgttctccattttaaaggttaacttcctccttcttcttgctttcttgcccctagtttcagtaaacaaccttttccatcagttctaatcagtagtttacatctgttcccctggtcatctactccatgctgagtctcccctggtcaattgctctgtcctaagtcacccctggtcacctgctctgacctgagtcacctttagtcacctgttcctaaccatccttcctgccaaactactcactccaccactccgactcataaccctgctctctttaaaatagccagtcggaattagcttagactgtgcagtccaaccctagccaataggggaatgacacagcagtaggggctacttgagtcaggaataaaacccccttcccctcccttgttcagatgtgctctcgccattgctccatcagtgagtcacacccttttatagaagtaaaattgccttgctgagaaaatatttgcaaactatccatctgacaagggattaataaccagaatatataaaaagttcaaactactctataggaaaaaaatctaataatcttatttaaaaatgggcaaaatatctgaaaagacatttctcaaaagaagtgtgaaaggaaaatatcttgggcctccaaaatcactaaggaaaactcaaactggaaactgcttatggcaaacctgcctttcattctattcaaagtcactcctctgctcactgagatagatgcatatctgattgcctcctttggaaaggataatcagaaactcaaaagaatgcaaccatttgtgtctcacctatctgtgacctggaagcccactccttgctttgcttagtcttcctgtctttgcttcaggttgtcccgcctttccagactggaccaatgttcttcttacatatactgatagatgtctcatgtctcccaaaatgtgtagaaccaagctgtgccccaaccaccttgggcacacgtcgtcaggacttcctgaggctgtgtcacgggcgtatccccaatcttggcaaaataaactttcttttttttttttttgagacagagtcttgctctgtccccaggctggagtgcagtggcgcgatctcagctcactgcaacctccacctcctggaatcaagcaattcccctgcctcagcctcctgagtagctgggactacaggcacgtgccaccatgcccggctaattttttttttttttgtattttagtagagacggggtttcaccatgttggccaggatggtctcaatctcctgaccttgtgatctgcccaccttggcctcccaaagtgctgggattacaggcatgagccactgcgcccggcagcaaaataaactctctaaactaactcagacctgtctcagattctctgggttcacagaagacatacaaatggcaaatagctatatgaaaaggtgctcaatgtcactgatcatcagagaaatgcaaatcaaaactacaatgaaatatcatctcaccccagttaatatggcttttatacaaaagacagggaataacaaaaccaggcatggtggcttatatctgtaatcccagcactttgggaggcccaggtgggaggatcactagagctcaggagttggagaccagcctgggcaacatggtgagaccctatctctaccaaaaaaatacaaaaattagctgggcatggtggcacgcacctgtagtcccagttacttgagaagctgaggtgggaggatcacttgagtcctggatgttgaggcagcagtgatccatgatcacgtcattgcactccagcctaggcgacagagcgagaccctgtcccaaaaacaaaacaaaacaattttttttttttgagatggagtctcgctctgtcgcccaggccggactgcagtggcgctatctcggctcactgcaagctccgcctcgcgggttcacaccatctcctgcctcagcctcccgagtagctgggactacaggtgcccaccactgcgcctggctaattttttgtatttttagtagagacagggtttcaccgtgttagccaggttggtctcgatttcctgacctcgtgatccgcccgcgtcggcctcccaaagtgctaggattacaggtgtgagccacagcggccagccaaaacaatttaaaatgaaaaaacttgggcttatgctgaagggaagttcagatcaattataaatatttattaaccaattaccatatggaattaattaccatattaatcaattaccaaggcaaagcattatggaggatataaggagtcctaagacaacctatgccctaggtaaatttaaaacataattaaggaggcaaaatataaacatataaaaagaaaactatcaagagacagcagtataagtatgagacacggaaagaatgagaacactccaatgtggcccttgccacagtgccctgcacccccacccagctgttcttctccactctctcttgcatatgacttagctcctaagtattcctattgttcttagtaaaatccaaattgcaggccgggcatcgtggctcacgcctgtaatcccagcactttgggaggccaaggtgggtggatcacctgaggtcgggagttcgagaccagcccgaccaacatggagaaaccctgtctctactaaaaatacaaaattagccgggtgtggtggcatgcacctgtaatcgcagctactcgggaggctgaggaggagaatcgcttgaacctgggagatggaggttgtagtgagccgagatcgcaccattgcactccagcctgggcaacaagagtgaaactccatctcgaaaaaaaaaaactccaaattgcccaaacagtggctgctactctgcaagaacaattcttccctctctgagataagaatcatccttaatcaattgtttctgaaaccagctgaactccagctgagcacccttgttaaagccctgtacgacatttcaccctccttccccaagttaaaaggctctttcagagacttcttatgcctggcatttctgaaaagggacttctgcaaacagttctctgttttgttttctaagtgagtattttagatagtaaattctataataggtcaagaaggacaagattttctaaattgagtaattagggaagattagaaaaagcaggccttgaaatgagagccttaaatgatttgtatgattcagaaagactgtgagatggggatggaaggagcaaatacccaagaagatagaaatataccatgcaaagttctctgtgaccagacaaattaacagccaagagtgagagcaaaataaaggcactttcagacatactaaggttcaaagtttaccacctgtattacatttctgaaagaaataagtattacagcaaaacaaaaatacaggaaaaaataacatctgggatgcaagaaaccataatgaacaaagaaaacaaaaatctttatagttaaatctaaataactgctgatgtacaatgtttttagattttttttcttttggtagagacagagtcttgctatgttgcccaggctaatcatgaactcctggcctcaaataagcctcctgcctcagccttccaagtagctgggatttatagcaaccacacctggctaatttaaaatttatttcgtagagacactatgttgcccaggctggtcttgaactcctggcctcaagtgatcttcctgccttggcctcccaaagtgctgggatcactggagtgagactagacatatgtgcaaattttgataacaaagtatgtttacaggcaatgggatggactaaaacagattcatctctttgcctctaatagtggcaatggtgagtactgagcttggagaggcaggctggggcttcactgtgaacagccttacaaatgtgcataggtcttctttgttattaaaaagaatttcctctgaatacctcctcaaactagtatattttttcttcctatttgtttttgtttttttttttgagacggagtttccctcttgttgcccaggctggagtgcaatggcacgatctcggctcaccgcaacctccgcctcccagttcaagcgattctcctgcctaagcctcctgagtagctggaaatacaggcatgtgccgccacgcccggctaattttgtatttttagtagagacagggtttctccatgttggtcaggctggtctcgaactcctgacctcaggtaatccacccgcctcagcctcccaaagtgctgggattacaggcgtgagccacggtgcctagccttcttcctttcattggtcaatttcatactgcctccctcccttgttgtttgtttacataaagcttctatcacctcaccctatggcaaatgttcgcttgaactcctaattttgaacttataatgatctttctcaggctgtatcctcaaaatccgtgtgtgtgtaacattgctgacaactcatcgtcttgaaactttccttttgcttgacttttacaaccagatttccttctacttcctctgtctctgggtttctcattttagtcctcttcctaaatataaacatacctcaaagttatgttctcaattctcctctcttctctctctataagttctctttcccccttggttaattcgtccatatttctgggcctacccctttctcaagctgaattcaatatttcccagtgccatctggatatcctcatgtacatcatattcaatacattaaaatgatggctgggtgcaatggctcatgcctgtaatcccagtcctttgggaggccaaggcaggcagatcgcttgagcccaggagttggagatcagcctgggcaacgtggtgaaacctggtctctacaaaagataaaaaaaattagccaggcgtggtggtatgtgcctgtagttccagctactcagaaggctgaagtgggaggatcacttgaccctgggagttcgagtctgcagtgagtgtaattgggccactgcactccagcctgggcaacagagcaagaacctgtctcaaaagaagaaaaaaattaggccaggcgtgatggctcacgcctataattccaacactttgggaggctgaggtgggtggatcacttgaggtcaggagttcaaaaccagcctggccaacatggcgaaaccccatctgtattaaaaatacaaaaattagccaggtgtggtggtgtacatttgtaaacttagctacttgggaagctgaggttgcagtgagttgagactgcaccactgcattccagcctgggtgatggagaaagacactgtctcaaaaaaaaaaaagtaaaattagtacattaaaatgaaacatcaccttttctctttttctctgaagcatgatctttccagttctattgttagcatcacataactattctcctagtatctagacaaaaaacctgagcggtttctcaaacctgtctttcctttgtctaccaaatatagccatcaagtcctatcaattttcctaatacttcttttccttttctttttattcttaccagttccaacctagatcaagttctcattacttgcctagaatattgctaaagtatccagtttacacccactatcttgtttcaaagcctttcatgtctaagatcccaatcatctttctagcccatatcctggaataccttacactttaattaaactgcaattcgttgtgttacccaaacaggttctgcctgttttccttattaactttcaccctcttcataccgttcccttcatttgggaccatgactttcagtgagtcaataatctttcagccaggcgcagtcgctcacccctgtaatcctagcactgtgggaggctgaggcaggtggatcacctgaggtcaggagttccagaacagcctggtcaacatgtcaaaaccctgtctctactaaaaatacaaaaaaattagccaggtgtggtggcacacacctgtaatcccagctactcggtaggctgaggcaggagaattgattgaacccaagagatggaggttgcagtgagccgagattgccccactggactccagcctgggcaacagggagattccgtctcaaaaaaaaaaaaatcttttttctaactattaagcaacatctttagagaagtaagaggattaaaaatgatgatataatttcctctcatgtatttgttttgtctcataaacccatatgaagaagtgaaacctcattaaatacaaagtgattggagaacttaaacagtaattgttttccctttggtttgtctcattactactggtttatggaatgactacaaagattgtatatctcagacaaactcttcagtggtaacattcctatatcacactattatgttagcaactttaaataaaaaggttacaaagtattttctgtatcaatgaagataatctttcctcctgggtagccaccagctcctggaagttgagctgtcactaggaagcaattaaaaatttatattaataggagtgaataaactttgtacacatgactatataaatacacatggaatctgctgttgcaactctttagtacattttgcaaagagtcatgatcctttcgtttctaaacaacatgttatattttcatattacttaaccagtgtgaaattataagtattctgccagcatagttgttattcaacaaataatttcactatctttcacaatggaagatattcgtgaaagttagttctcccaaagaatggaaataaaatttaaatattactaattttctttctttttcttttcttttcttttttttttttttttgagacgagtctagctctgtcgtcaggttggagtgcagtggcgcaatctcagctcactgcaatctccgcctcccgggttcaagcaattcttctgcctcagcctcccaagtagctgggactacaggcaggcactgccacacccagctaatttttatacttttagtagagatggggtttcaccatgttggccaggatggtcttgatctcctgacctcgtgatctgcccacctcggcctcccaaagtgctgggattacaggcttgagccaccgcgcccaacctactaactttctttctacaagaaatagtcacaaatatggccgggcatggtggctcatgcctgtaatcccagcactttgggaggccaaggtgggtggatcatttgaggtcaagggttcaagaccagcatgaccaacatggtaaaaccctgtctctactaaaaatacaaaaattagctgggtgtggtggtgcatgcctgtaatcccagctactctggaggctgaggcaggagaattgcttgaacctgggaggcggaggttgcagtgagctgagatcgtgccactgcagtccagcctgggtgatagatcaagactccatctcaaaaaaaaaaaaaaaaaaagaaagaaagaaagaaagaaagaaaaaagaaaaaaaagaaagaaatagtcacaaataggccgagtgggcggatcatgaggtcaggagtttgagaccagcctcatcaacatggtgaaaccccatctctactgaaaatacaaaaaacaaaaattagccgggcatggtcgtgagtgcctgtaatcccagctactcaggagactgaggcaggagaatcgcttgaacctgggaggcggaggttgcagtgagctgagatcgcgccactgcactctaacctgggtgacacagcgagactccgtctcaaaaaaaaaaagtcacaaatataatttatgctatataactaatatgttacctttaaattaatgtatgtcaaattttaaaaatgcatttactttttttttcgagacaggtctcactttgtcgcccaggctggagtacagtggcacgatctcggcccacggcaacctctgcctcccgggttcaagtgattctctgacctcagcctccccagtagctgggattacaggcatgttcaaccaggcccagctaacttttgtattttttagtagagacagggtttcaccatgtttaccaggctggtctcaaactcctgacttcaggagatcctcctgccttggcctcccaaagtgctgggattacaggtgtgagccaccacgctagactgcaattactttttatgtagtagtagttaacactaaggagctactttataccaggtacatacattatttcatttacttttcaaaacaatcctaacatttggcactgtcattatttcaattttattggtgggggaaattagagaagtagagcaacttgcccaaggtcacacagctactaacgatagaaccaggattgaagtccggcattttgattccagaactcctttctttttttttttttttttttttttgagacgagtcttgctctgttgcccaggctggagtgcagtggcgcgatatcggctcactgcaagctccgcctcccgggttcacgccattctcctgcctcagcctccccagcagctgggactacaggcgcccgccaccatgcccggctaatttttttgtatttttagtagagaccgggtttcaccgtgttagccaggatggtctggatctcctgaccttgtgatccgcccgcctcggcctcccaaagtgctgggattacaggcgtgagccaccgggcccggccagaactcctttcttaaccactttgccaagttccttctccatagctcaaagaaatgcacagtagtgtatttgtggaaaaggagatatctttcgttattttgtttaaaacaattttgtttttaagtctctcttagggccaattttatgccatggaaagtgaaagattctaggactcaatagattttgtgtcactcttctaaaaaagatatagaaaagatggaatgggaaaaactgagacagtggactcctcaccaacacattcatacacccattcaacttctctctatttctactcaggtgttcatagtgcagcacatacatcacctcaaggatcacacattcaaagaccagctgtataaccacgggcagtttacttaatctgcctgtgttttagtttccttgcaagtatgttcagatatgagattatttagagtatcaggcacatagtagatgtttgataagtaatagccatgattattattgttattgttgttatatatccttaccacagagggtatgagaaagctgggtttttccagtacgaaattctgtgaaatacagaaaaaaatgattttaaaaatgcataatttccagatattttcataaagaataaaacatggctttagaatattactgttttctttttcttttccaactggcaaatcttacttataaagtatctcggatgttattttttattttttttttgagacagagtcttgctctcactcaggctggagtgcagtggcacgatctcagctcactgcaaccttcacctcccgggttcaagcgattctcctgactcagcctcctgagtagctgggattacaggtgcctgccaccacgcccggctagtttttgtattttaagtagagatggggtttcaccatattggccaggctggtctcaaactcctgaactcaggtgatccgcccacctcagcctcccaaagtgctgggattacaggtgtgagccaccacgcccggccttatttgtttaatataaattaatttaaatcaagttttccttagtaacagtcatataaatgaaagtttaaggccgggcgcggtggcttatgcctgtaatcccagcactttgggaggctgaggcgggtggatcacaaggtcaggggattgagaccatcctggctaacactgtgtaaccccatctctactaaaaatacaaaaaattagctgggtgtggtggtgggcgcctgtagtcccagctactcgggaggctgaggcagcagaatggtgtgaactcgggaggcggagcttgcagtgagccgagatcgcgccactgcactccagcctgggtgacagagcgagactccgtctcaaaaaaaaaaaaaaaaaaagaaagtttaagaccctaccacctggggtaaagtgcggtgactcacacctgtaatcccagcactttgggaggatgagatgaatggatcacttgaggtcaggagttcgagaccagcctggcaaacatggtgaaaccccatctctaccaaaaatacaacaattagctgggcatggtggctcatgcctgtaatcctagcactttgggaggccgaggcgggcaggctgcatgagctcaggagttcgagaccagcctgggcaacatggtgaaatgccatctctactaaaaaataaaaaattagctgggtgtggtggcgtgcacctatagtcccagctacttgggaggctgaggcagaattgcttgaacctgggaggcagaagttgcagtgagccaagatcaggccactgcactccagcctgggcaacagagcgagactccatctccaaaaaaaaaaaaaaaaaaaaaaaaaatcagccaggcgtggtggcagttgcctgtaatcccagctacacaggaagctgaggcagaattgcttgaacctaggaggcagaggttgcagtgagccgagatggcaccactgcactgcagcctgggagacagagcaagactccatctctaaataaataaataaataaatgaaaataaaataaagaccccaccacaggaaagaaagcctggggttcccctactgaactgaggtccttaaaggggagctgaagtagtcttaaactggtgccatcccctagctaccagcaaaagcaaattcgttctggaggaaaactttcctacctaccaatccaggtccattgaactttcatagattaaaatcaaacaataagctcagaaacaccaataaatacagaagaaggtaagccactaagactgagtcaacagaaataatgaaaaccagatttagtgcccaagtcaacagaaaaaaaaaaaaaaaaaacagatttagttctccaaggacagcaaatactggaattcccagatgtgatacacagtgtagctatgcatgaattgctttttaaaaatagaggataggacgggtgcagtggctcatgcctgtaatcccaatactttgggaggtcaaagtgggaggattgcttgagtccaggagttcgagaccatcttgggcaacatagcgagaccctttatctattatttaaaaaaaaaaatagaggatataatcagggaagagggaatctagtctctatgttcatggaacattaattgcctagaaataaaatcagcctcattattcaattaccttttgaacaaataagtgaaaaaaaatctattatcagctgggcgcagtggctcacgcctgtaatcccagcactttggaaggccgaggtcaggagatcaagaccatcctggctaacatggtgaaaccccgtctccactaaaaatacaaaaaaattagctgggagtggtggcaggcgcctgtagtcccagctactcgggaggctgaggcaggagaatggcgtgaacccgggaggcagagcttgcaggaagccgagattgcgccactgcactccagcctggacctgggtgacacagcgagactccgtctcaaaaaaaaaaaaaaaaatctattatcttctataggaatcacaaataaaagatgaaaagtgttgataagacccatctgttaatgttcatatatattttcgttgcagtacagaatgatctcatgttatgataattgagattttgtaagttccaaaatacttacaatttattattggttgtttatttaattatatgtgtatgtatacacatagatgtgtatgtgtgtgtgtataatatttcatttaacaaaatattaaggttctacctacctccaaaagcttctgtaattgccatactttcaattccacctcctagtaacttactggaaatagaaagaaagcattagtaacaggaatagaaatagaaatattaagagaggagaaagtattcatatcattagtatccttcctatctatgtatctatctatctattctatcatctacctatctatctacagaacatgaacagcaattcttggctgaacaaatagcatgccacttgctagatcacaggttctattgtgtatgggcaagtggatcagcaaaacaaatgataagccctatcgttcttacttcaatagtaaatggaacctgggaatactgcatgctgtaggcttaaaaaataataataataaattattttaagaaaaaacttaaaaaaatagtaaatgggttagcaaggccttatgtcttactagtctttagaattgaattggagttacagatcgtcttaattattattattattattttttttttttcgagatggagtcttgctctgtcgcccaggctggaatgcagtggcgtgatcttggctcactgcagcctccgcctaccaggttcaagagattctcctgcctcagcctcacgagtagctgggattacaggtgcctgccaccacgccaggctaatttttgtatttttagtagaaatggggtttcaccatattggccaggttggtctcgaactcctgacctcaggtgatccgcctgccttggcttcccaaagtgctgggattacaggcataagccaccatgcccagcccatcttagttattaattgggtatttaatattgtgctggaactatgtttctatagtcaattgaattttcaatgttttttctttttcttttttgagacagaatcttgttctgtcacctgacacagggctaattttttattttttgtatggctggggtcttgctatgttgcccaggctggtctcaaactcctgaggctcaagagatctgcccaccttggccttccaaagtgctgggattatagacatgagccatcatgcccggcttcagtttttaatatactgaaaaacatatgaaaaacaggtattaggaaaatccagtgattgtcattatggtcaggttatctcacataaaccaaatattatggaggacatgtcagaatagtaaatgtcaaagatgttgtaggtaatgctagcagttagaagagtaactgtcagattctgacagcatacatttaattggtagcccaatgttgtagtgcatttaaagctctgaataagaaaaggcctaaatttaagtcatgatctcattcattcattaaatgcaacacatattaattgtgttaattgtgctaagacctggtaggggcactttaaaaaccttgtatgtagtctattaacatgattttttgggatgtgatcacaggtcagacaaaaatttaagatatatagataatccaatacatttacatttacatagtttaagagagcaatttaaatgtaaattgaaacaatgttggaagttatccacaaatttagtgagggctgcagacttcaataaggaaaagaaaaatctagatagtgtacctgcacaacttaaatctaaaggacatgggctaagcgatcaacccatttggagggaatacacttggaaatcttataggcccagcaactatttttttcttcaacttttattttaaattcaggggtacatgtgccagatatgcaggtttgttacataggtaaacgtgtgccatggtggttgggctagcaactattaaagaaagctttatttgtccctcttcttcctgagaaaaattaccctggaaagctatacctctggaaaatcccagacaaaattcctggttgatatgtaatctcaatcagctgaaaaggtaaccccaaaatttacctgtgaggataccccaaattatttgggatagcacaattgtttcctttttgagactcaggaaaatttagaattaagtgtagaaatagtgtttttaaatatagggagatttaaaaatagagacacaaatcaaacccatagattactattttcatattaaatttggcaatatgggcatggtggctcatgtctgtaatcttagcactttgggaggccgagggaggtggatcgctcgagcctgggagttcaagaccagcctggataacatggcgaaacccagtctctacagaaaataccaaaattagccaggtatgctggcctgtgcctgcagtcccatctactcaggctgcagtgagccgtgatggagccactgcattttagcctgggtgacagagtgagaccgtgtctcaaaaaataaaatagaatataaataaataaatttggtaataacctgtgcatatttgctatttgagaccttttaacgtttaagataatttgacctttttgtaatggattggcctctgactgattaaatggtacattccttcaattttcaagttgataactaattttataaatagtatttgaacatttaatggtgcctacaactcactatacttctaaatttatttgagttacaaaagatatttaggtaattgggaagattttgctgttaataattagataattagacaaagttcttttttttttttttttttttttttgagacggagtctcactctgtcgcccaggctggaatgcagtggcgtgatcttggctcactgcaacctctgcctcctggattcaagcaattctctgcatcagcctcctgagtagctgggattacaggcacccgccaccatgcccggctaatttttgtatttttagtagagacagggtgatcctgtctttagtagagaccttgtgatccacccgcctcagcctcccaaagtgttgggattacaggtgtgagccagtgcacctggccaacaaataaagttcttaaagaaaatacaatacactaaatgtataaacataattaaaatgtttaagagaatttaatcttgttataaaagcacccttaaaatgtgctagatttataaagggacttaaagcttaaggaaaaatgtataatattttaattaattaaatattaatttttaaaaacctagctcctggctgggcgcagtggctcacatctgtaatcccagtactttgggaggccgaggcaagtggatcatctgaggtcaggagttcgaggccagcctggccaacatggtgaaactctgtctctactaaaaatacaaaaattagcccggtgtggtggcacacacctgtagtcccagctactcaggaggctgaggcaggagaattgcttgaacccaggaggcggaggttgcagtgagccgagatcatgccactgcactccagcctgggcgacacagcaagactctgtctcaaaagcaaacaaacaacaaaaaaaaacctagctcctgaatgatcttttctgttctcaagagcaaacatcaagggcaccagaaaactcacaataacagtaattatttctttagcccagtggttcttagaccaccatgtggtagagtaactaaagaaaatcagattgtcatttgaatcaagtgttttgttgatcaacctcattttgaccaatttgcctaggggtaggatttctccaagcctcttccttaactttacttgaaaaaagggtatgtgattttaaaagtctgggacaatgctgggttaaacaggtattttctttttctttttttcttttgagactgagtctcactctattgcccaggctggagtgcagtggcacgatctcggctcaccacaacctccatctcccaggttcaagcgattctcctgcctcagcctcccgagtagctgtgaccacaggcacatgccaccatgcccggctaattttttgtatttttagtagagacggggtttctccatgttggttaggctggtctcgaactcctgatctcaagtgatccacccgcctcggcctcccaaaacgctgggattaaaggtgtgagccaccgtgcccagccatttttttggtaatttttagtagagacagggtttcaccatgttggccaggctggtctagaactcctgacctaaggtgatccacccatcttggcctcccgaagtgctgtgattacaggtgtgggccaccgtgccctgccaaaacaggtgttttgtgtcactgcaggatttcacaggctagtgtgcgctgtgactcttcaagaagaatatatagtatatggtacttctcaaacttattcactatttgtttattcattcatttagtcattcaacaaatatttattgcacacctagtttatgccagggattgttttgtgcacttgggataaactagagaacaaaagagacagaatttttttctctcacgaagtttacaatctagtgagagattagataataaacacaaataggccaggcgccggtagctcacacctgtaatcccagcactttgggaggctgaagcggtggatcatgggatcaggagttcaagaccagcctggccaagatgctgaaaccctgtctctactaaaagtacaaaaattagccgggcgtggtggcgggcacctgtaatcccagctactcgggaggctgaggcaggtgaatcgcttgaacctgggcagcagaggttgcagtgagctgagatcatgccactgcactccagcctgggtgacagagcaagactccgtctgaaaaaaaaaataaataaataaaataaaaaataaacacaaataagtaaaatatgtagtacatcagatgttattaaatggtatggataaaaataaggccaggaaaggggacaaggaagacagagtatgaaagttaggaggttatactgtcaaataaagtgatcagagaagttctcattgagacatggacatttttgccaagacctgaaagagatgacagcaagccatgtagatctaagaggaaagaatatgataggcagaggcagcacaaagtgcaaaggccctgatgcaggagtgtatctgacatattctgggaatagcaaagaggtcactatggctggtacatagaaaactagaaaagtgaaatattagagatgggagaggactttggcttcttttctgagtgagagggggaatcatcagggtgttatgagccactgcattccagcctaacctatgttttaaagtgaccattctggctctttagtgaattaaaaaaaaaaacaaaacagtaggggcaaggtctcaaggagggaggttaattagaggttattataataatccaggggagatattaataggtggtagtttagtccagtgaggtaacagtagaggtggtaagaaatagttgaattatattctcactctctatgtacacacacacatatacacataaaaataacatatattatatattaatcttttattatagaaaatatcaagcataaacaaatgtagaaaaaaaataatgaaccatcgtgtctatcactcagcttcaacaatcgtcaactatgaactcagggtaaatcttttttcatatagaccactaaccatttacctcccttcccatattattttaagcatatactaagcaacatatcatttcattataaatatttcagtatgtatccctaaaagatgaagatgaagactctcatctttaacaaccatattcccactatcacacttaaatttagtaattccttaatttttttttttcagacaaggtttctctctgcgtcacccaggctagagtgcagtggcatgatcgcggctcactagagcctcaacctcaacctcctgggctctagcaatccttctatctcactcagactgctgagtagctagaactacaggtgtgcaccatcacacccagctaattaatttttttttttttttgtagagacaaggtctcagtttgccgttaggatgatctcaagagatcccctccccacctccagccttggcctcccaaggtgctgggattacaggtgtcacccactgcacccggccaggtgatatgtcttttaaatctctttaatctataggtcttctccctgactccatctcttttttcctccttgtaatttatttgttgaggaaactgggaggtttgttctgactaaatatattttgaaattagaacagacaggatttattaatgggttagagttagggtgtgtgagagaaaaaagatgtcaaggataacacccaggttttaggtcagaggatcaggaaagagatagatctaagatgagggagactttgggagaagcagatttggggcaaaggtcagaagtttgatttttggacctgtgaagtctgagctatcaattagacgttcaagtggaggtatatttgactatgaaatcctttttttcttaatgtatcttgtgaggccagcattttgagaaatacttagaggaaatactgcttttgttctaaatgctcttgggcactgctgtaacacatgaaacactaattctttctagtaaggtagggagaaaaaacccacattttagtaaacttgcattgagaagatgatgatatgtcttggggatcataaaagagtaaataaaaagggatgttaaaacttctcctgcagaagagcaaaaataactgcaatatttctgaaatatttaatctaacaattgctttttgagtaaacccaaaatgtgcaatgaaacatccttcatatggagaaggaaagtaaatgaaaagttaaactgatttttaaaagtggtttgagattaatattggctgattcagaaactagattttgggtctgaatttcttgtaagacatttaatcttgctcctccaagcagtctagaatttgtttcagttatcatttagaaaaaaaaacaaacaaacccaaacttcaaatgaagaagctacttctactacttatagtagaagtaaccagaaagaggaaaagaaacatggtattccaaagattatgcttagtgattataaaaaagtaagatacatactcaaattcctggctcccggtggtgatatggaaaaccattttcctcttttcactatactcaaatgcagtcaagaatcctggttcctacagaaagataaaaggaaatgttcaaaaagagtttaaagatcatggttgtattttcaaatgttgcccaaaatgatatactcagttattaagatcatcatttggtataagctacagttcacttgtccttgaaggcagtacaagattatggttaggaacacaggctttagagctgccctttctaggttcaaatcatgtctctaatagttattagttctatgatatggagtaaactacttaatcttgctatacatcagcttcctcttttgggtcaaacatgcaacagtgtttcttcaaggagtagctgtgaaaattaaattatatatatatacacacacacacatatgtatacacacatatacatgtacacatatatacacacgttatatacacatatatacatatatgtgtatacatatacatatatacacatatacatatacatatatacacacatatatacatatacacatatatatacacatattcctggattcaagtgattctcctgcctcagcctcccaagtagctgggattacaggcacttgccaccatgcccggctaattttttgtatttttagtagagatgggatttcacaatgttggccaggatggtctcaaactcctgacctcaggtgatccacctgccttggcctcccaaagtgctgggattacaggcgtgagccaccgtgcccagccaaatgagatataattatggcataaagcagagggtattttactaacaattcactttttttcattcaacagcatcattttttttccagctgtagaagtttcaaggggcacagaaattccagttttcattattcttgagacaacatttttcacatggtagatatactacttattgactgattaaaaaggtacagctgatgcagtggaggactagtgaaaatgggccccaatgtagtctaatgggtgtccctctttgttgttttatactatgactgtggttcttaaactttggagaacttggagaatggggacagccaagcccaggtcctatcctacttgagtgagccaagtctgggcttctgttttctttattagccacaccaggtgattctgatacacatcagtgtttagaaccaccgtattatgaaattaacttcctttctttctctcctctctctctgtctctctctctctctcaatcactttctctatctctaagaataaacaactgggtgcagtagctcacacctgtaatcccagcactttgagaggctgaggcgggaggactgcttgatgccagcagttcaagaccagcctggccaatatagtaagaccacccctcccccatctccacaaatttttttttttttttgagatggagtctcgctctgtcgcccaggctggagtgcagtggcgcgatctcagctcactgcaagctccacctcctgggttcacgccattctcctgactcagcctcccgagtagctgggactacaggcgcctgccaccacacccggctaatatttttgtatttttagtagagacagggtttcactgtgttagccaggatggtctcgatctcctgacctcatgatccgcctgcctcggcctcccaaagtgctgggattacaggcgtgagccaccaggcccggcctccacaaaaatttttaaaaattagctggacatggtagcatatgcctgtagtcctagctactgaggaggctgaggtgggaggatcgcttgagcctgggaggtcaaggccacagtgaactgtgattgagccactgtactccagccagggtgatagagtgagaccttgtctcaaaaataaatgaataaataaaactgggcacagtggcatattcctgtagtcccatgtacttcagaagcagaggcaggaggatcacttgaacccaggagttcaagcccagactgggcaacatagtgagatacccttctctctctctctttttttttcttttgagacagagtctcgctgtgtcacccaggctggagcgtagtggcgtgatcttgcctcactgcaacctctgcctctcagtttcaagtgattctcctgtctcagcctcccaagtagctgggactacaggcacctgccaccatgcctggctaatttttgtatttttagtagagacagggtttcactatgttggccactatgttggtcttgaactcctgacctcatgatccgcccgcctcagcctcccaaagtgctgggattacaggcgtaagccactgcacctggcctgatacccgtctcttaaaaaatacaaataaaaaagaataaacagtttaagctaagaaaggagaagattcttggtgcagtagtgggtgcttgagaaagagagaggttcttttctttggtaataagatttaatttccaaagaaaacaactctaatgtcatagagcagtttcccaaaccctgagtactgctccagggctttcttcaacaccctggcagttgtggaattgacttgtgggtacactgcctgagtgtactcagaagctagagcaactgagctgggttcagagtgattcagttcggttgagtcccctccaagttcaggatcacactgccacttgcatcactctcctgccttggctgcctctgaagaaggaaaccaaatggccgttggtgaagagagcttctcagactcactgggaatgagaccctcacataccaatagagaaatggagaggcctgctattaaatgaagaggaagacttagtgactacctttctttgctttcctatttcaagagctggtacctctagtgattcccaaaagctctacataaaagcttgggtcaaaggtatataggcttttgtctggcagcctggcagttgcaaaggcccctcacagtcagtgggccctgctagaaagtagtaaggtaggagaggggatttgactccagaggtggggctcagacaccagaccaaattgagaactagctaaaacagggtccagggcagaagcaactttccataagacatggcccaccaatgtgccatgtcagtttaccattgctatggcaacacctggaagttactgcccctttccattgcaatgacccaatgacccagaaattaccactttttctagaaatttatgcataaactgccccttaatttgcacgtaattaaaagtgggtataactataatggcaaaactgcctctgagctgctacttctgggcatactgcctatgaggtagccctgctctgcaaggagcagtacctctgctgcactgtactgggctgcttcaacaaaagttgctgtccaacaccactggctcacctttgggcaaagccaagaaccctcccaggttaagcctcaatttgggggctcacctgccctgcatcagtatgggttagcttagctcagctgcttcagtgagcacatgcttggtcatatctatctcaactgcacatatgtagacccaaccactgttggtctttttctaatccagtgctctcttatcaattggctatatcaattggctatatatcaatctcctataccaggagagagcaacttctttggtactcagtgcttcacaacagccataggtatgatatttgaggagacaagacaaaactgaggaggagaaaggtaaaaaataaaaatgaaggccgagcatggtggctcatgcctgtaatcccagcactttgggaggccagggcaggcagatcacgaggtcaggaaattgagaccatcttggccaacatggtgaaacctcgtctctactaaaaatacaaaattagctgggcgtggtgctgtgtgcctgtagtcccagctactcaggaggctgaggcaggagactcgcttgaaccccggaggtggaggttgcagtgagctgagatcacgccactgcactctggcctggcgacagagcaagactctgtctcagaaaaaaaaaaaaaaaaggaaaggagaaggaaaggcagagacagccagaaaaagtaatataaagagagacaaaaagttttggcaaaaataattaccttcattagtgttccaggtctcttaatccctaccttcatctttcagaaatcaattgctgttgctttgaaactgaagtgataaaaagttaacatggggagtataatatactgtgatctacaggaactcagttcccacaataatttctagttttcatgagaaagcctataaagattcacaaggccctgccaagctaaaacagcaaagaatggattttgcttacaattagtttgttcgctgcctctttaatcttgtctactttggcttctgagagtcctttgacattgcatagagctcttcttgttgtcatctgtatacctttgatggtacagattcctactgatttcagtttcttaatgtcagccacgttctgtaaattaaagaatgggcacagcagactgataagatgccagcctgcaaggctcccatactatgtcatgtgtttctgtgtccatctccttccaccatgatgccaattttatacaagctgccaggtggaacccacccaccatgtagccaaatgttctggaaatatctgagtagaacatactcagcaggctgccaaatgttctgactgtgccctgatttcccaagaatgttagtgagaccatggcaatgtaacaaggaattcaaaagaaaagcctgttggtggaaaagctaacaaatttatcacacattcaccccctcagttcagctccttccttctacagaacttcattaccaacatgttcttttaaatttgtaaagattttttttttcctctgcccctggagaatgcaaataactacatcaccaaaggaccaggattttctcttgcttctattttctaaaaccactgaaagagattaaatgttagggctacaacagataatgtcagcacagttttactatcaactgattgctgttgaaatccacccaggtcattattcaaaggctggatttctgccaacatcatttattccagtcgcctgacatatagaacttaattttgtcctctggatacacttgacaatgtctggagacattttgattgtcacagctgcaggggtgctactgacatgcagtgagtgagtagaggccaaggatgttgcaaacaccctacaatgcacaggacgtccccttgcaacaaagaattatccaggcccaaatgtccataaggttgatgctgagaaatcctgaatcagacaatttaacacagcattgaaaaactacttacaattccatgtttctgtaacaggtcaatatcttgaaacaaagattcctaaaggagatgaaacagaaaaaatgaagttttgattcttcatatccagctatttcacatcttttaaagaggtaattcaatactatgagtcactccaaaatgcctcaaattccgcttctctagagattgaggaaggatcaataccgtttttcaaacacagaagaagcaccaacattgaaagggctgggaagccagttacctttgtcatgtcctccctaaaattttaaaacctttacccaaaggactggaacaacatttgaactattttaaatatgttttctcaaccctcttcccctccagatcctaaactccttcctctaggaccaggctgctattcggtacccgtgtgtgtaggtaccagtatggccataccagctgttaagtcattaaaatactttcataccagttgctaagtagctaatcttagcatccttgccaaacaagttgttacatatttgcaatatataactatgtgttatttctactttcagcttctaaaaatagtagctaacagggaaggaacttgatttttgcggaatgatcgaatgtctatatatctttcaacattttagtcatacctcttcatcttggaatcctggttcttccgccacaacttgatcctccttcatattgaaaagtgggcaacagaaaaataatcacttctgggaaaataagaaatattatgtaagaagtagtcctttgtccaggggcctctgatttcatttcaaagtcaacaaggactagaaggacagtaagagaagcatttagcttggaaagatgaggccagcctatcttctttctgcgagacatgtgacattatttcttgtgtgtgtgtgtgtgtgtgtgcatgtgtgtgtgtgtccccacatgcacacagatgcctgaggggcaaattggggggtgcttatttagtttcttctctttccccaacagtgatcacttatcatctggtttccattgcacagctaatcatgactttattactgccttgaatgttatttagaattgcatattgcttttaacctttcttgtttatgtttaacaacaatactctaggaaccttgacattatatcattcttccttgtgtcctccctgacacctccaactttgtcctcaataaatggattctatttttctcatctatgatgaatgccttcctgcctgctgattatgaatgggtactcctgtaacatccacctttttgtttcatagaacattagctatactttctttcacagtatttactagtttcatgatttttttaagatttaaaaatatggtggtccgggtgtggaggctcatgcctgtaatcccagcactttgggaggccgagacaggcagatcacgaggtcaggagttcgagaccagcctggccaatccccgtctctactaaaaatacaaaaaaattagccgggcgtggtggtgggcgcccgtaatcccacctacttgggaggctgaggcaggagaatcgcttgaacctgggaggcggaggttgcactgagccgagatcatgccactgcactccagcctgggcgacagtgcgagactcagtctcaaaaaaaaaaaaaaaaattggtggatcataatattatattaaggctgataagcagttaaagtttttaacattgtagactcaaaaagaaatctcaggaatccacaaggcgtgattgtgtttatttattacaataaaatgcggtccaaatcatcatttttcttggtcgattccatttcctcatttgataccaaagtcaggggttggaccctagaacaaagggaacgaaccattaatactaaggcaggagcagggtcctaccacccagcacctcaaacggcaaaggatggaaggcaaccgagaccgttcggatgggatcttcggggacactgtccttcagatggctagctatgagtaccccaattccacatttactgtccccatcgaagagaaaaacagcattcatttcttctccccgtgatgaaatgaaaagattgtcccccatctctcaaggagccgttgatagactgaaccgttggattgaaagtagggctccccaatcccccggtttaagacgacccagctgtcccctctggtgggggcagcagcgcggtcgggtcgccctcgacgcctccctcagcaggaggcctgggcagaccccctgcggccgccggacattttcctgacaccggattccctggtcaggaggatgaggcgggctctcctagactcaggtccgattcgattgaaaatgaggttggaaatccctcaagatcactaaaattcctccccaaaggtcggagcggaacgctcaaagtcactagcccagggaccccaaaaaaggagcgagaaagggaagcgcgccttctcaaaacgagcgtcccctcagagtcttcgcacgctgttcgtttttgccacttacccccctcgtacccacagtctccccgagattttcaaggtgaagcccctctgccccgcccgacctcctcagctgacaggattctaactcgggcctagaacacggagcctggagacccgcgcgccgttgaccacagggtttggcgccaaacgaggagggcggggcgaggaccaaggggccggggcggggcgcagggtgagggtggaagggcggggagggagcaggcctacagagggcgacgaggggc

SEQ ID NO: 97 - DNA, 29668 bp, Homo Sapiens
ttttttagagatggagtcgcccaggcgggagtgcaatggcgcgatctcagctcactgcaacctccacctcctgggttccagcaattctcctgcctcggcctcctgagtagctggcactacaggcacgcaccaccatgcccagctaattttttgtattttaatagagatggggtttcaccgtgttgcccaggctggtcttgacctcctgagcgcgggcaatccacccacctcggcctcgcaaagtgctaggatcacaggcatgagccaccacgcccagtcagtcttgttcctttttatggctgtatagtattccctggtgtgtatgtaccacatttttttaatccagtctgtcactgatgggcagtgctgcaacgaacatacgcgtgcatgtgtctttataacaatgatttctattcctttgggtatatacccagtaatgagattgctgggttgaatggtatctctgtctttatccccacactgtcttccacaatggctgaactaatttaatttacatttccaccaacagtgtataagcatatctttttctccacaacctcaccagcatctgttattttctgacatttttataatagccatttggactggtgtgagatggtatctcgttgttgtttcgatttgcatttctctaatgatcagtgatgctgggcttttttccataggattgttggccacagatgtcttcttttgaaaagtgtctgttcatgtcctttgcccactttttaatggggtggttttttcttctaaatttgtttaaattacgtatagatgctggatttcagacctttctcagatgcatagtttgcaacaattttctcccattctgtaagctgtctgtttactctcttgatagtttcttttgctgtgcagctctttagtttaattagatcccatttgtgaatttttgcttctgttgcaattgtttttggcgtcttcgtcatgaaatctttgcctgtgcctatgtcctgaatggtactgcctgggttgtcttccaggatttttactgttttgggttttacattaagtctttaatccatcttgagttaatttttgtatatggcataaggaaggcgtccattttcaatcttttccatatggctggccagttatcccagcacgatttattgaatagagaatccattgcccattgcttgtttttgtcaggttcatcgaagatcaaaaaaattataggtgtgtggtctcatttctaaattctctattctgttccatcagtctacgtgtgtttttgtgccagtactatgctgttttggttactgtagccttgtagtatagtttgaagctgggtagcgtgatgcctccagctttgttctttttgcttaggattgccttactatcaatatttctttagatttactcaagtacttaccatttactcattattacttcttacctctcagatttactttctgagataatcttttaaaagttcctttgtgaagaaatattggtggtaaattaatacaaagtttaattgctaaaatcactttgattcaacagcctagaaacagaatagtctttacttttactgtgctagtttaacaaatccattctgtaaagaaatactgttaattcccctagagtttaaaactttagggctgggcacgggcctgtaatcctagcactttgggaggccgaggtgggtggatcacttgaggtcaggagttcgagaccagcctggccaacatggtgaaaccccgtctctattaaaaatacaaaaattagccaggcgtggtggtgggtgcctgtaatcccagctacctgggaggctgaggtggaagaatcacttgaacccaagaggcagaggctgcagcgggccgagattgtgccactgcactccagcagcctgggagacagagtaagactgtttcaaaaagaaaaaaaaaaaaaaagaaaacttttggccacgagcagtggctcacgcctgtaatccctgcactctaggaggcacacataggaggatcccttgaggccaggagttcaaggctgcagtgagccatgattgtgccactgcactccagcctgggagacagagcaagactctgtcttaagaaaaattttaaggcttgcgtagtaccctgcaaaagactattttatgatgtatatcaacaaaattcaaccccactttctccaataataaaaaaatgtttttttaaactgttactttttaaacaacgtgaaactaatgaaaattggttgctgctttgagaatcatcttgtttggagaaaaacatcctgtgcttcaccagttgctgccatgccttacagagataaggtctgtagtctatgtccacatcacacagtcgtcgagaggcatgagaaggttcttctgatgagctcgaggctttctgcattatagtttgtgtcgttgcaaaaagaaccaggcgatagtcatttacaagcttctctaagcactgagaacatttcctcagagtagactcctgtaagttcacactttctcctccattgacgcggtctatccagtaaaaagctgacaggctatccaaaatcaaaaggcagagagatgggtgactacaaaacatactttctagtgagtaaagtgtaagaagtaagtgggtgctactactgcagtacaccaaaaaaaatcttcccaggcagtatttgattatttcttcagagctttgggatagtctgtgctcaagaattgtaactagccggagcatatcaaagtggtaatctgtatcaataaataagacttctacttccaggccaccttctgatttgggaagtatacatcgtgctgttaggtgataaagcatttctgtttttcctgttccttctgggccatgaaattcaagaatatcacctgtgtaaaatttaaaaatctcagtcaaaatgcagtagctcaagggtaggttacaaaatgcaaagtctgcaaaaaagtttaaaaagacacttactggaatgtgaaagaaaatctaaattcacttttgccaaaatggagctgtacaagcaaatacaataaataaggaaattagagcctggtgggaaggttggaagaggctaggggactctcctccggccaggctcacatgcactcccacttcaatttgtaagattcaaaaataaagagccacagatctagggcctttccaaaatctgatgactacagtacacaccctttctggtagttgattacactatatccattcttcccttcttcctaaagtataaaacccaatttgatggggagggaaatgtgtccactttaaaactatttttcatagtctcctttgaaaagcaaggttaccaggtaacacagctgtcgccagtgagatgcaggctgctctctgttgatgattctttcctatccagggaccccttctgccctgccgcaccctcctgtgggggtggagcagccatctggaagcagtgaggatgaaacccacccttaggatggtggcgtggaagacagaaggtacccaggactctgggcacacggagcccccaccagccacgcacagcctgcctctgtgccactcaggatgtgaggaaaacaagcctccacctgggcaagccactaagttggacttctatgacacgcaggtgaaggcactccctaattaggtttctcagtgttattgatgttatggggggaacaattctggattttgtggtttcacacattattgaggcaagagcccatggctctcagaccctaaatgccaacagcatccttcaactgaaaacaaccttacacgttcccaaactgccttcagttattctttgctatttgaattatctctggaaaccatgtccagctgcattagaaattattttcctagcattaaaaatcaaagtcaactactctgaacgttaaagactccaactctccttctatctaggctcgaataactaaggacagcacaagttaaatcaaacaacactggggaagttgccttgcttccagagcttttcaaaatgcactcacagtggcattcaactcttgcttgtcattattaatttacggctgaactacctgattggaaacactatgttaaaatgccaattattagccccaaccaaatgatggtctaaatacggattcaagggctgggcgcagtggctcacgcctgtaatcccagcactttgggaggcagaggcgggaggatcacctgaggtcaggaattcaagaccagcctggccaacatactgaaaccctactaaaaatacaaaaaattagctgggcatggtggtgggcacctgtaatcccagctacttgagaggctgaggcaggagaatcacttgaacctgggagacagaggttgcagtgagctgagatcacgccattggactccagcctgggcgacaagagcgaaactccgtctcaaaaaacaaaaacaaaaacacaaaaaaatgcaattactttatttcttattatttaattttaatttttttttgagatggagtcttgttctgttgcctaggctggagtgcagtggttcaatcttggcttactgcaactttcgcctcctgggttcaagcaattctcctgcctcagcctcccgagtagctgggattacaggcgtgcgctaccgcgcccagctaatttttgtatttttggtagagatggggttttgccatgttggccaggctggtctcgaactcctgacctcaggtgatctacccacctcggcctcccaaagtgctgggattacaggtgtgaaccaccgcacctggcctttcttattattatcaacaaaccgttgtatattggagtattcacaaataatgtataagaaatctaggctgggtacagtagctcatgcctgtaactcccagcactttgggaggtcaaggcaggaggatcacttgagcccaagagttcaatatcagcctggtcaatatagtgagaccccaactctacaattaaaaaaaaaaaaaaaaagccacccatggtggtgtgcatcagtagtcccagctaattgggaagctgaggttggagaatcagttgaacccaggaggtagaggctgcagtgagccaagactgcaccaaatttccaccataatcttacatacaacttgcaattctaaatttaccttaagaagaaatttaaaaaatgattccacctcagcctctcaagtagttgggactacaggcatgtgtcatcatgcctggctaatttttgtatttcttgtaaagactgggttccaccatgttgcccaggctggtcttgaactcctgggctcaagtggtctgcctgcctcagcctcccaaagtgctgggattacaggcatgagccaccatgcctggcttcagctttcttatagcatagtatgttatcagttctcatagacttctcttttgtatttaagaattctacacatggctgggcatagtggctcacatctgtaatccagcactttggaagctgaagtgggaggatcacttgagcccaggagttcatgacgagcctgggcaacatagggagaccctgcctttacaaaaaattaaaaaaaagaaatagccgggcgtggtagcatgtgcctacagtcccagtctcagctactcagggtgaagtgggagcctgtgaggttgaggctacggtgagccatgatcatgccactgcactctagcccagacaacagagggagaccctgtctctaaaaagaaaagaaaagaaaaaaaaaaagattctaggctcaaggagtaaaactattttcatattaacaattgtccatctaattaaaagttaacatagcaactaaacctgtattccacccagatgttcagtgtgccctctcttactatgttactgaggagctatgctgaacccgccactcctgccaagcatcttttactgccctatgtgatagagaacaagggaccatgcagaagcgcagacggggaaaccaagaagcagaccacagcaaatcctccctctcctgctcccatagaggcagccagagaggccgacccacagctactcacctttctagagtactgcatgccttaaagaggctgcttcagacatatcctgtttgctcctaataacactgaggtagggaaagcaaactctatcatctcccatcatcacacagatcacactatataatcactatttacttgattacatttcctgctagcttctctaaggttgggacttgagtattctgtccccagcacaaaacccaggatcttctgaatgtgcttcatcagttaccttcttctcaagatcctcttgagagacatctaaagaataaaaatataagtcttggtttgtgagggttaagggcctaaaagccaattgtgaaactggcattttaaatggaagcgggtctggtagggaatgacaggtggagtgtgtggctttggtggcagagttcagcaggtaagaaagtcctagaccagggttgacacagggaccaacataggaggcaaagcaagaggagcaaactgccaggtgtggagcctgctgcccagagaccacagggtgctcacacttagcgtggtgagggcctcagttctgcaggtgatatggttaggctgtgtccccacccaaatctcatttgaaatcccacgtattgtgggagggacccagtgggggtaattgaatcatgggggcgggtctttcctgtgctgttctcgtgatagtgagtaagtctcatgggatctgatgcttattataagggagaattttcctgtacaagctctctttgcttgctgccatccacgtaggatgggacttgttcctccttgccttctgcaatgattgtgaggcttccccagccacatggaactgtaagtccaattaaacctctttcttttgtaaattgcccagtcttgggtatgtctttatcagcagcgtaaaaatggactaatacagcaggtaaacctaatgtggtgacttaaaagttctcaaagataggcttggaagtacctgcacaaatcaaatacagacataaagtagactttttttgagacagggtctcattctgtcgcccaggcaagagtgtagtggcgtgacctcagctcactgcaacctccgcctcccaggctcaagccatcctcccacctccgcctcctgagtagctgggaccacaggtgtgtgccaccacacctgggtaatttttgtattttttttgtagagatggagtcttgctgagttgcccagggtggtctcaaacccctgggttcaagtgatccacctacctcagcctcccaaagtgctagacttataggcatgcaccaccacacccaacccaaagtagaaatttttagttcacataattcacattgagtattccagcaaaaatttagctttcaaaatggtatgggttttttaaaatgttatctctaggtgtcacaaaatgaaaatgtcctacagccactaaaatttaagattcaagatggtaagccgggcgcggtggctcacgcctgtaatcccagtactttgggaggctgaggcaggtggatcacctgaggtcaggagttcaagaccagcctggccaacatgaagaaaccctgcttctactaaaaatataaaaattagctgggcatggtggcacgtgcctgtaatcccagctacttgggaggctgaggcaggagaactgcttgaacctgggaggcagagggttgcagtgagcccagattgcgccattgcacttcagcctgggcaacaggagtgaaactccatctcaaaaaaaaaaaaaaaaaaagattcaagatggtaggtaataaggggctggttatagcagactgggagtaatccacacagaaataatagagaaaaaacaaaaatctctttgatgggtgggtattatggacctaaaattaaggccaaaactaaatttttgagatatatccacagttagaagacgcattagaagacagctaaaacagaaatttaataggaaaaccaggaagaaaaacattacagggcaaaagagaatgtttcaagaaaatgaaactactaaataataaatatagcagaaaagtcatgacaatgaaaaacagcagggaaaagatcactgagtttgtccaaaatagtgaccttggagcattaattgtgtagtccgcaaaagcacatttaacatctcattttgtgaaccaaacttttaaaactgagatactcagaagacaggagacaacggcactagcctaggcattcactgcttctagagtaacagcaaggacagagtggattcccgacgagtgaaactgaggcaaagaagttgaaggttaaatccctgcctaagagatactctttttcttttacacattaatagcaaagcaggtataaaaaaggcttttataacaaccgggaagacactgcaaacttgcaagagacacatgaattatcattaaggtccttgaactaaattcctcacaaatatgtttaatgatgaactgaaatcagttttactgattttataaacatttactgtttgatcctcaagatcaaaacctgtaatcaaatattatgtcctacagaagggacatcatccttttcaatgtacttgaagtcaccgtctcatatgtttctgtggctgctacagcatccttgtccagccaaattatggaacgtgacaactcgcagtaaaaaaatccctaaggtttggcacttgaagatattaaactaaatcagaaaatctggatgatttggccttgacagttcctcttacaaatagaacgctgtaaggagtttgggtaacagattgtcagaaagagttctgaatctaaagatccttcaaaataaggaaaagaaaggaaaagccaaaaaagctatcatcttggtaccagcctaccaattatataacaaatatgttgaatttgcagattataatcattatagaagtaaagaagtaatgaattggtacatggtactgaataactcctatccaaaaaagcattaaaaatatgtttacaggttgggcgtggtggttcacgcccataatcccagcactttgggaggctgaggtgggcagatggcttgagcccaggagttcaagaccatcctgggcaacatggcaaaactccatctctacaaaatacacaaaaattagtctggtgtggtggcacacatctgtggtcccagctattcaggaggcagaggtgcgaggatcacctgagcccgggggttggtcgaggctgcagcgagccgtcacggcgccactgcactccagcctgggcaacaagagtgagaccctgtctcaaaaagaaaagtttggcactgggcacaatggctcatgcctgtaatctcagcactttgggaggctgacacaggtggatcacttgaggtcaggagttcaagaccagcctggccaacatgttggaaccctgtctctactaaaaatacaaaaaatttgctgggcatggtagcatctgcctgtaattccagctatttgggaggctgaggttgcagtgagccgagatcgagctgcactccagcctgggtgacagagtgagactctgtgtcaaaacaaaacaaaacaaaaataaaaataaatgtttggatgagaacacatggacacagggaggggaacaacagacaccggggcctgctgaaggcatgaggggagggagcgcgtcaggacaaatagccaggacaagtaacctaggtgatgggttgataggcgcagccaaccaccatggcacgcgtttatctatataacaaaccttcacgttctacacatgtatcctagaatttaaaattaaattaaaataaattttaaaaaatgttcggatgggtgcagtggctcacacctgtaatcccagcattttgggaggccaaggtgggtggattccctgaggttgggtgttcgagaccagcctggccaatatggtgaaaccccatctctactaaaaatacagatgagacagagcaagactctatctcaaaaaaaaagtttacaatggcattgagactctataacccctaaatcttactacttcaacttaagcttttctgtaacaagctctgataaacttctattgttgataaataatctttataatcccagtcttctatctgctattgttccaatggaatactcatctaactagttttacagctataggatcttcagtagttttcagtaaacttttttgttagttactgaacatgatggtgtttttcaacgtttctataatataatattctaatgtagaagttgttccacaaacccattttaacatattgtcagtttcataaggctcaccttaataatatccttccttacagagagagtacaaagaccattctgttttttgtcttacatatttgatcaaaatttgtgttttattatggagaattttggttagcaaatctgctgtacaaaaaatactaaagggagtcctgcaggctgaatgaaaggacacagttcctgaaatccaaatgagaaaataaagagcacagggaaatgtaactatctaggcaaatataaaagacagtacaggccaggtatggtggctcacctctgtaatcccaacactttgggaggccaaggtgggcgaatcacctgaggtcaggagttcaagagcagcctggccaacgtggtgaaaccccgtctctactaaaaacaaaaaattagccaggtgtggtagcacacacctgtagtcccaggtactggggaggctgaggcaggagaatcacttgaacccaggaggaggaggttgcagtgagccgagatcacaccacttcactccatcctgggcgacagagtgagactccatctaaaaaaaaaaaaaagatagtataaacgtgtttttgtatttgtaactgttttttcatctatctgatttaagaaggaagttgtttttgcgacagtcttgctctgttgcccaggctggagtgcagtggtgcaatctcggctcactgcaacctctgcctcccaggtccaagcaattctcctgtctcagccccccgagtagctgggattacaggcacccgccatcatgcccagctaatttttgtagagatgaggtttcaccatgttggccaggctggccttgaacttctgacctcaggtgatccacagacctcagcctcccaaagtgctggattacaggtgtgagccaccgcacctggccagaaagtattcttaagtgatcattttaattactttaattcagtaataatattaaatgtgctgatgaccatacaatgtataaagatgtagggaatacctatacagtaaacaaagctttttacaaaatatggaaattaagtttgtattaatccaactagactgttagaaattatgatcttacttgtaatcccagggcaatcactagaaaaataattcagaaaaatatagtgaaaacaatgacaagggaattaaaatggtacattagaaaatatttaacacaaaagaaaacagtaaaggagaaagaaacagaaaagacataagacatatataaaaaacagacagcaaaatgcaatcataaactttttgtctttgtttttttttttctttttctttttgagacggagtcttgctctgtcacccaggctggagtgaagtggcgcaatctcggctcattgcaacttccacctcccaggttcaagtgattctcctgtcttgacctctcaagtagctgggattacaggcatgagccatcacacctgggtaatttttctttttctttttcttttttttttttgaggcggagtctcactctgtcgcccaggctggagtgcagtggcacaatcttggctcactgcaagctcactgaatccctcccgggttcatgccattctcctgcctcagcctcccgagtagctgggactgcaggcgcctgccaccacgcctggctaattttttctatttttagtagagacggggtttcaccatgtcggccaggctggtctccaactccagacctcaggtgatccacctaccttggcctcccaaagtgctgggattacaggtgtgagccaccgtgcctggtccctactttaaccatttttaagtgtacagctcagcagtgtgaagtacattgacattgctgcaaagcaatgaagcagaactccacaacttttccatcttgcaaaactcccattttgcacccattaaacaatgactcccttcccccgcctccccagctcctggtaactaccattttactttcttttctgtgaatttaactaccttagaaactgcatataagtggaatcaagcagtttgtctttttgtgtctggcctatttcatttaccaatgtcctcaaggttcatccacgttgtagcacgtgacagaattctcttcctttgtaaggctgaataatatcaactgcatgtatatatcacattttgtatacaccactcaaccattgatggatacttttccccccagggattcattataagcacattgatggacatttaggttggttttacctcttagctattgtgaatagtgctgctataaacaagagtgtgcaaatatttctccaagatcctactttcaattcttttggatgaatacccagaagtgagattatgtgatcatatggtagctctatttttaattgtttgaggaacctccatactgttttccataatggtcgcaccattttacaatcttaccaacagtgcaaaagggttacaatttctccacatccttgctaacacttgctatttcctgttttttttttgatagtagccttcctaatggatgtgaggtgacaaagaagaacattttataatgataaatgggtcagccagcaataagacaaaataaaaagttatatgtgcttaacaatacatgaagccccaaaatacaaaagcaaaaaatgataaaactcaggagagaaacagacaattcaacaataacagttggatacttcatttttagtagagatgggggtttcaccatattggccaggctggtctcaaactcctgacctcgtgatctgcctgcctaagactcctaaagtgctgggattacaggtgtgagccactgcgctcggctataacctgattttttaaatgagcaaaggatctgacgtttcttcaaagatatacaatttgccaataagcctgtgcaaagatacccaacatcattggccgtgaggacaatgtaaatcaaaaaccacaaagagataacacttcatactgactaggatggctattatcaaaaagacagacaataacaattattcccagaatatgggaattgctggcaatgcaatgatggtgcaagtaaaatgtgaagctcctttggaaaacagtctggcagtttctcaaaaggttaaatgtagaattgccatatgacctagcaatgcctatcctaggtattatccgatagaactgaagacatctatccacagaaaaacatgtacacagataaccacagcagcattatgcacaacagccagcaaatggaaacaacccaaatgtccatcagctaacaaatggataagcaacatgtacactcatgcaatgaaatatttaacaaagaatgaactactgatacgtgttatgaaatggtgacactgaattatacaattcagtgcaaattattcaaagtaaaagaggccagtcacagaagatcacatattacatgattccaattatatgaaatgtccagaaaaggcaaatccatagttagaaagtagattagtagttgcctagagctggggaacatgggagatgatgattactagaaatgagcttctttacggggagataaaatgctctaaagtcagctgtggtaacggttgcacaactgtgtaataacctaaaaatcacttaactgcacacttcggtgggtgaattttatctctatgaagccgccacattaaaagaaaaaaaatcaacctaagcgcacgcccttagtaagttttccctgttgtagaaatactaacaagtgggtacccaaggacttccctacaactccgcaagcttctaaagaaaaggaatttcaacataaactataataacaggacttgcataaatattgtgtgttgagaataagacagaggtcaaggcatattctgaagatttactgcagagaagcaaacttgtctgacaccgatgaggaaagcttaaaagctttctgtcacaacctgtgtctcattttccaattgtacagtttaacctgtataaactcttgtgaggagtatgtgtatacatgtgagcttatgtgaaaaatccttttataaagatttgcatttatttatataaaggttgtattttttaccatgcacaggtgaatcttcatcagcaaacagatttggttctatttctttcaaggaacttctaccttcaagtcgggcaaggagcttataaaagaagagagaaggaaaactcattatttaaaaatataaaatcctagacatctatatttataccattttccgaaagtctgtaagatttcataactttaggctgggtgctgtggctcacacctgtaatcccaatactttgggaggccaaggtgggcagatcgcttgagtccagtttcagaccagcctgggcgacatggtgaaacctgactctacaaaaaatacaaaaattatctgggcatggtggcacacactgtaatcccagctactgaggaggctgaggtgggaagatcacttgagtcaaagaggcagaggttgcagcctgggtgacagagtgaggccctatctcaaaaaaaatttttttcataattttgtggatttggaagaaaatatgaaataggaaatatagtttaggagaaatgttgtgtttacttatttttcagatattttactttttgtttatctaccaaatactgacagtataaaatgagtctgtaccctcaaaggaatggatagtctagtttaggatataagacaaactgctatggcaaaatttttaccttccttgtaattaactttcacacagttaattcttaccacacttgttacacagttatctgccttcatttgtctgccccattcattgtgagctctttatttcactggggaaggggacaaaggagaaaggtggaggagaacttccttgaggagccaccacctgggctctctcctaagtaagactgccaggtgaatggggcacaggcaggcctagtagacctgctaacagaaacaggagcagccacagtgcagaggttataaatagcattgtgcatagggacactgtgagcagctttgaactcctagatactgtaacagcaccaaacaggcaggacccagggaagccctacaagagagcagaagtcagagcatggaagggctcagacgccatgtttgggagcttatctttggcttgtagacaacagccaacaggtgtgacactaagcactgagaagtatttagaacatagttaagagtagacatttgggaccccagagccagacctgctaggtcactgaggtccttaggcttctcatctgtcaagtgaggataacaaacagcaccctccctcataaggctgatgaggattaaatatgtgaaaagagtacctggcatattatccacttctttttcttttttgaggcggagtcttgccctgtcgcccaggctggagttcagtggtgcgatctctgctcactgtaacctctgccttctgggctcaagtgattctcctgcctcagcctcctgagtagctgggattacaggcacccaccaccacgcccggctaatttttgtatttttagtagagacaaggtttcaccatgttggggcaggctggtttcaaactcctgacctcaaatgatccgctcccatcggcctcccaatctgctgggattacaggcgtgagccaccgcgcccagcctatctgcatttcaaacagatcatcttggtggttactaggggacagatgtgaggagagttaaaaccatacgtggagagagggctggggtttgtcaccctagtctggaggaggagtgtctgcaccatgacggaagtcattaggatcacagggggcaatctcggtgaaggatttaactgtcacaagggagacaaaactgattctcaagtttcttgggaatcagcacagatttgacaacccttctatatgacaaaagaaaaaaaaatctatcacaaatgggaagaaagtcaccttttatttgcatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccattttagccgggatggtctcgatctcctgacctcgtgatccgcccgcctcggcctcccaaagtgctgggattacaggcgtgagccaccgcgcccggccttatttgcatttttttaaaccaaatcaagttgtggaaagacttcctcaagtgatgaaaaagttctatgcattaatttaacaggcgttcgttgaatttctgttgcgtatgaagcactgtgctaggtaaaatgttgactacaaagatgaagatgacaacctaccctcaaagaatgtgcagtctcagtcctctagatgagattatgtcataatacaaggtaaagttacagggtgcttaattagagcagaggttctgagggcatacccatggccaaaactattttcgtaaacagaaaaagtaaaaattaagatgttatttgcctagtttgatactaaggtcctaaaagcaatagtgggtacctgctgacagctagcgtaatcaaggcagtggtgtggaaatgtattagcacacatcgccaagcactacctgcactcaggcagaacaaaaccagctttacgtaagaatgtctttgaagtaaaaaaaaaaaaaaaaaaaaaaaaaaagactgcttttactaaatcatgacccttgagtacactttaaaaaatattctttgtgatgacatgagaaacatactgtgtagtgaataatttaaccttgcccaaagggaggtctggtttttgtccttggctcctgagaggtaattctaaacccttggaatgtcttgcctgataaaagtgtctttgggccgggcacagtggctcgcgcctgtaatcctagtccctcgggaggacaaggcaggaggctcgcttgagcccgggagtttaagaccagcctgggaaacatggcgaaaccctgtctctacaaaaaatacaaaaattggctgggcatggtggcatacacctgtagtcccagctactcagaaggctgacagaaaagaatcgcttgagtccaggaggtcgaggctgcagtgagtcaagattatgccactgcactccagcctgggccacagagcaagaccctgtccccctgccccccccccccaaaaatagtctctgtttacaagagaactttgagccacacagcaatgtgatttatggtgggggctttgggtcatgcagtgttaggccaacctggaagtgctggaagctaaggtcagctatgcaggcggttgactatgtccacatggcagagccccaataaaaccttcggacaccagagtctagctgagattccctgcttgccaatattctattgtcacacattgttgctgggagaatttagcactgttgatgactccactggaagaggacagctggaagctctgtacttggaacttcctgaactttgtcctattgtgtctcttcccttggctgattttaatctatatccttttgctgttgcaaaccataaccatgagcataacagctttcactgagttctgagttcttctagagacttattaagcctgaaggtggctgtgatagttaattgtatgtgtcaactagattaagttaagagatgcccaaatagctggtaaagcattatttctgggtgtgtcatgagggtgtttctggaggacacgagcatcatcagtagactgattaaaaaggatccatcctcactaatgcagacgggcatcctccaatccctcttttcttgaactgggacacccatcttctcctgccctcagatattggagcccctgattctgggacttaccccagtgccgcctgtcccccaaccctacaccattctcgagcctttaaagccctggactgggagttccaccacgggctctcctggctctcagcccttcagactcagactgaattacaccacaggctttctggttctccagcttgcagatggtgtgtctgggatttcctggcctccatcatcacgctattagagtaggtagacagacaggtgtgagtggggcaagacaggccccaaggaatgtccaggtggcctcttcaggaatgataactggttgcagctggcaccagggaggggaaaatttcctaacaggaaacatcttgggcttacgggcaacaacttcctgataagatcctaggaattgagcaaacatgtccaggaatgtgcagtagggagcaaaatggtggagtgtgaccagtatatgacctttctctgggagcactagaccagtacgggaaaattgccctacacgagcatgcacagaactccaaacaccaaatggcagtcgtggcccctttcagatgctggcaagtcactgcacatgaggcaattagccagcagcccatccaaggagaaggatgagaggagaccaggaaggatcaggaaataggggcattcaatatttcaagttgcccatttggtcccttccaagtgaacgttacttcaaaaacccttcagtcctgccttgaatctacttctgtcttggctgaattctttcttccaagaagacaagaactaaggactgtggaccccaaccagacttgctgccctggtaacaatgtgagccaatttccataataaatttcctcttatatatctacatgtatcctattggttgttggttgtgtttctcctctggaaaactgtgcctaacacataactcagtgaaccatccaaaagatgcatggtgtgaaatcattcctgggtaaaagatttcactccaactgtaagacaaacctttttttttttttttttttttttagacagggtcttactcccgtcacccaggttggagtacaatggcacgatgagactcaacctcccaggctcaagtgatcctcccacctcggcctcccaagtagctggactacaggctcgtgccactatgtccagctaattttttttgttatttttaggagacagggtctcactatgttgcccaggctggtctcgaactcctgggctcaagtgatccacctgccttggcctcccaaagtgctggaattacaggtgtgagctactgcacctggccaaggtcttaagattttatatcccacattgtagttagcctttaggaaaactactacttgtcaagctttggtaacagtaaccaagaagaatatctataattctgtgaaaaggtcttaaaatactcctccctttcccaacgtgactttctctgagaggatggatgttcttcatatactttaacccaaccaacatatgataacagactgcataagaacccagttccattaagccagatattaaaaagatttgcaaatatgtaaaacaacatcatttttctcagttttttcttagaaaaatacagcttttttcataaaaatatgttttataaaaatattcaatgtgtgtgtcactgtacatgaatgtaaatattttaaaattttaaatttgtttcatggacacatataacataaagaaaagctctttagattcttcaataattttttttttgagacagggtcttgctttgtcacccaggctggagtgtgcagtgatgacatcatggctctctgcagccttgacctcttgggcccatgcaatccttgcatatcagcctcctgagtagctgggaccacaggtgtgtgccaccaaacccagctaatttttttactttttgcagagacagggtctccctatgttgtccaggctggtctcgaactcctggactcaagcagttctcccaccttagcctcccaaagtgctgggattacaagcatgagccaccatgcccagtggaatctcccacttttaaatgtgttacatagtcctaagactaaaacctataagaaccactgggctacaagactgaaagagtataactcaaagaaaaatacagattctttatttttttttttttttgagacagagtctcgctttgtcaccaaggctggagtgcagtggcacaagttcagctcactgcaacctctacctcctgggttgaagcgattcttctgcctcagcctcctaagtagctggaattacaggcgtgtgccaccatgcctggctaatttttgtatttttagtagagatggggtttcgccatgttggtcaggctggtctcaaactcctgacctcaggtgatccacccgcctcagcctcccaaagtgctgggattacaggcatgagccactgcgcccagcaagacagagagactttcatggacaagaaagagcacgtggaaacaactataaaatatcttcaaaggcatgtatacgaatgaataacatcctcattagattaacttgggaagacactccaattgtttactcttactgtcatttctcaaaacactgtagaatcctcacccctgagaaatcctggcaaaatagtactcaagaaagtattataggccaggtgcggtggctcacgcctgtaatcccagcactttgggagtgccaaggtgggcagatcacctgagattgggagttcgagaccagcctgaccaacatggtgaaaccctgtctctactaaaaatactaaattagccaggcgtggtggcacatgcctgtaatcccagctactggggaggctgagacggaagaatcgcttgagtctgaggcagaggttgcggtgagccgagattacgccattgcactccagcctgggcaacaagagcaaaactccgtctcaaaaaaaaaaaaaaaaaaaaagaaaaaaagtattataattttattgacgggactcttttgggcgaagatggtattactcctcttagttacccacaaggattaggcaatctgcatcagactttccactgttacttagaaaatcaaatttaatttcaaaggagaaaaactgtccaccactgagaatatccaaagcaacgttttacaacgtcaaagcagagtatactgaattataaagggggtgaaagaacctcccagaaataggaaatagatttaaatttacaagtaatggataatattaacaattcacaagccaagcaaattgttaatattacaattaacaattgtaattgttgctcacacccataatcccagcactttgggagtctgaggcaggtggatcacctgaggtcaggagttccagaccagcctggctgacatggtgaaacccccatctctatgaaaaatacaaaaaattagctaggcatggtggtgggcgcctgtaatcctagctactcgggaggctgaggcaggagaatcacttgaacccagaaggtggaggttgcagtgagccgagatcacaccactgcactctagcctaggagacagaacgagactccatctcaaaaaaaaaaaaaaagaaacttctaaacataggcagaaaatacactggtccccccttatctgcagtttcattttctgtggtttcagttatagccaaccacagttcggaactattaaacagaaacttctagaaataaatacacaagttttcaataattgcatgtcattctgagttgcataataaaatatcgtaccatcctgttctgtcccacgtgggacatgaatcatccctttgtccagcatatccatgctgtacacactacctgttcattactgtatgggaaaaaacatagtgtatatagggttcactactatctgtggtttcagcatccattgggggtcttggaacatatcctccatggataagaaaagaggtactccaaaaatctgacataggcctattacagaaaattaaaattaatgatgtccagattcaaggaaagagtcaatagaagcaaggtatggtcaacctgcagtttcagaagcgaaagaagagtttgttaagtgtccagggtaaagggaacccaagtaaattctgcttgacatgacagtttaatcctcttagggaagactaatacatcaggcatcagagcttggtgatgatagccattatgacaaactgtttctcttaattctctaagcaacctttccgaggcaaaatttcctaactagaaaagaatacacagtggacataataattttaatctatttgacagtttcactaatattgtgagtcaatagatttgatacttggattgtaaatcagcatctgctaagttctattatcgtaacaatagctatctaataatagttatttgagcttactgtgggatcagcagtacattctttatattatgtcctttaattgttacatcaaccctatttgttactattgtatttttcacatgagaaaactagtaaatgtcagggccaggatttaatcaagatctctgtgattctcaaagcctggaatttttctactatgctatacaacctcagtatcactgagactaatcaaatatgagtacaaggactaaactgagtttttggacctattaaactgaaaatcaggccaggtgcagtggttcacacctgtcatccaagcactttgagaggctgaggcaggagtacttgaggccaagagttcaagactagcctgggcaacatagtgagatcccacctctacagaaaaataaaagttaaaaattaaaaaacaggaggaaagccatctgaggtcctgtctgggcgattatctgacttctttcaaccattcctttagttgaaacttgaacactaacaaggtgtcccaaatgtcttcagcagcagcagcattgctggagcaagcatttagtctgcaaaagagataatgctcaattatacagacatttaatggtaaacattttacagagtctcactctgtcgcccaggctggagtgcagaggcacaatctcggctcactgcaagcccctgggttcaagcgattctcctgcctcagcctcctgagtagctgggattacaggcgcccaccaccaaacccggctattttttctatttttagtagagacggagtttcaccatgttggccaggctggtctcaaactcctgacctcaagtgatctgcctgcaccgacctcccaaagtgctgggattagaggcatgagccaccatgcctggccacttaccggtgaacatttcatgcaagtcaagtatgttccaggaactgaggtaagtgctagggatataaagatgtagccaacacagttgctgttttcaacaaaactgatggggaggccaggcatcgtggctcatgcctgtaatcccagcacttcgggaggccgaggtgaaaggatgcttgggccaaggctagcaacatagtgtaacctatttaaactaaacagtcaaaaggctgtaaaaaaaaaaaaaagtacaataaagttaggcaggtgctgtaacagaaatacacatggggcattgtgagggcataaaagagagttggccaattctaatctgcgtgagagtgacttttaattttgagtgacagattttagtacatagttctttcaggtaaatataaattgtgtactgagagagaaatgccttttttccttctacctggaatatctttagcctatttcctccaactaaattccctactgaatgaatgaaaattctgggcattcttcaaggttccttccctccatgaagctattactgtccttaagaacacattgctagccactctccctcatctggatataaacatttaaaaggaaagagatcaatattggctttgttaccaattccaaaatgcaatgctttatgcttggcagaaacttaatagctgcctagtaaactacaggcaaacaaggcatgcacaggcagaactgggagaagaatggggagtgtaaagaacctccaactatttagaagttcaggtttggataattgatgcaaacctctattacacagaagtccgtgagtacacatccttatgactaccatcaaggtacaaacaaaacattgccctgttttagggcatcagtatatcgcctatttagtagaatacatattatataggctttttttttttgagaccaagtctcactctgtcacccaggctggagtgcagtggtgtgatctcagctcactgcaacctctgtcttcccgggttcaagcaattatcctgcctcagcctcctgagttgctgggattacaggtgtgtgccaccatgcccggtaatttttgtatttttagtagagacagggttttgccatgttggtcaggctggtctcgaactcaggtaatccgcccacctcagcctcccaaagtgctgggattacaggtgtgagccaccacgcccagcccatacagatgtttttaaacatcatttagaaaagcttacactagtctgggtgtgatggctcatgccagtaattccagcactttgggtggccaaggcgggcagatcacctgaggtcaggagttcgagaccagcctggccaatatggtgaaaccccatctctactaaaaatacaacaattagctagctatggtggcacctgcctgtaatcccagctactagggagactgaggcagcagaatcacttggatatgggaggcggaggctgcagtgagctgagatcatgcccctgcactccagcctgggcgacagagtaagactgtctcaaaaaaaattaaaattaaaattaaaaaatggaaaaatttaaaacctccagagaaagcgtaagaatagtacagtgaaccaataccttcacctagatccaccattgctaacattttgccaaattgagttaacttttgttgaacagcttcccctcatatactttaatatgtatctcctaagcaaaaagatattcctaacaaagaaacagaaacaaaaaataaaaccaaaataaactcaaaaaagaggtaaaaggtattctgcatagtcacattacaatcacaatcataaatttaacattgatacatacaatactcttctcttatacctatactctttattatattttccctggatctagacgcaattgaggataaatatgttaaatctgggatgcctattaaacatacacatagtgatgtcaagatgatagaacatgagtctggaattccaggataaggttggatgttttgtagtgagaaagtgaattactagagaaatatagttagaccgggtgcccatttgagaatgatgattataaatttaaaatggagccaggcacagtggctcatgcctgtaatctcaacactttgggaggccaaggcaggtgaatcacttgagcccaggagttgagaccagcctgggaaacatggcgaaaccccatcactacaaaaaatacaaaaattagccaggcgtagtggtgtgtccctttagtcccagctactcgggaggctgaggtgggagaatcacttgagcccaggaggtcaaggctgcagggagctgtaatcgtgccactgctgtccagcctgggtgacagagtgagaccccttctctaaaacatgaaaataaatatataaatttaaaataaaatcaagtcagcctagttgtgattttctctagtaatattcagctgagtggaagtagacagttggttttcaccatgcgtaggtaaatagcttagaggtgttaagaggcaagtaatttgatggcaatgataatggaataattataatgaaggaacatgggattctattctgggtaaaagggaagcaaagacaaaaggtgataagcattattctaaaactctgtgattatacaacaccaattattattttacaagaaacattaaatatttgtcttatgtaatatttgcctctagcaaagaccaccctgtagcttttctttttaagaaaatcaacctttattatcagtaaatatttacatttactatgcagacactgtgtttagttcaaaggatacaaagaagtatatgagctgtaagggaactgagaaatcagtctaccaccttcatttcacaaaagtacagcaaaggttaaatgacttatccaaaatcacaatgcttgctcctggcagaaccaaggtttctgaacttccagtccaatattctctagatctcagcctccaaaatacgtcattagaaaattcctggaagaatgtgcagatattcacagggctatccttgggtaatgataatgggagtggagacatttcctacttttcacttcagtgctattggaattttctgccatgtacatgaactgctttaataataaatataatggagttagttttttaaagaaaaaaaacatggtatgctgtgcatagcaaccaaaactggacagacacttccaattttttatttaccaattattttaaaattcaaggcatattagcattcttgaaaaaatgcaaagtacaccattatttaacaactgtattcaaatgaagccatttggtggatgataccaaaatactgcccaaatcactggatcttttctcacaatctcagtgagatataaaagtaaaaatcctattgctactgtgcaaagggaaaaatggattgttctattgtaaactgtagtcaaatgcttgtcttttttaaatcaagggcacatatgttttccactctccacctggcttaccataaacttcatccctagaatctgctaaaaaaatatatattcttttttttgagacagagttttgctctgtcacccaggctggagtgcagtggcgtgatgtcggctcactgaaacccccgcctcccgggttcaagcagttctcttccttcaccctcccaagtagctgggattacaggcgcccaccaccacacccagctaattttttttatttttagtagagacagggtttctctctaactcctgacctcaggtgatctgcccacctcaacctcccaaagtgttgggattacgggcatgagccactgcacccagcctaaaaaaatattcttacaactttattttcttgaagacccccatatgaaatgtcttttccttgatactcacaagaaagattaactattttattaggttctaattctagtgaattttaaagcaggccaggcgtggtggctcatgcctgtaatcccagcactttgggaggcttaggcaggcggatcatgaggtcaggagtttaagaccagcctggccaacatagtgaaacccggtctctgctaaaaaataaaaataaaaaataaattagccgggcatggtggcgtgcacctgtagtcccagctactcgggaggctgaggcaggagaattgctggaacccgggaggcagaggttacagtgagccaagatcgcgccactgcactccagcctgggcgacagagtgagactcttgtctcaaaaaaaaccaaaaatttaaagtagtttatttcagtttcttgggttagcttatggcttcagatatattcctcaacacaatccctccaagtaaattcaaagtagatgaatgtgcaaagaagctagagttcaaacaaatttggcagtggccacatagttcccaagacacttaaagggaaagagactggcttaactggttttgttaataaaaaggaaaatagagcagcgccaattgcctagcttcctattcaccattccaccccactccactccagagtagtatgagctaggcttaggattgccacacagacaaggcaggcaaaggatatgatgttaaattctttgttccatgacttaactgtgctagactctcattttttggatacaaggcttgttctgattgcaaaaatcatcggaccttaacctgggtttcaaataatcatttaaatataaggttttggccgggcgcagtggctcacacctgtaatcccagcactctgggaggctgaggcggatcacctgaggtcaggagttcgaaactagcctcgccaacacggcgaaaccctgtctctactaaaaatacaaaagttagctgggtgtggtggcgtgtgcctgtaatcccagctacttgggaggctgaggcaggacaatcgcttgaacccgggaggcggaagttgcagtgagctgagatggcaccattgcactccagcctgggcaacagagcgagagttcatctcaaaaaaatatatatttatatataaaaaatatgtttatatgtattatatactttctatataatctatattataaatatatttttaaatatatatttatataatatatttttaaatatatattatatataaatatatttttaaatatatattatatataaatatatttttaaatatatatatatctatggtttataactgtagccgttcttatactaagcagtggttctactctttaggaacagggattatcaaactatggccagcaggctaaatccaaaaaacaaagctttattggaacgctgccatgtgcctttatttatctatgactgccttcccattagaacagcagagttgagtggctgtgacagaaacggcatggcctgcaaagcctaaatatttaccacatggccctccacaaaaatgtttgctgactcttttgagattgcttcctctctcatctgcataaaagatccttcataccctgcccactgctcagcgcttacttcccaacctattgtccctcactccctttgttccaattttacagaaatacttgcagttatctaaattagccatgctcttgcttaattcagaatccatgtactcccgactgtctccgctctgaatgtcatcctctccttgccaaaccatttcaaatggtccttgaaacttcagtcatctcctcctgcatcttccatgatgcccgcccctctaatggacaacaaacttttgtgcaatactgtaattcttacagcagcctcccttactagttctttaatggcagaagttatgtcttttgttgcttactcctatcccttaacacgtagttgacacacagtaagtgctggacacttggttcaattcttgaggggcatccaccggcttgtgtggctctggagctacctgggctggaaacgaatactagggggtggcgagggccagctgccctaagcagagacacgtgggctacagggaggtgaggcaacctccgcaaacaccacctgttccagaaaagctccaaatgctccaacgggcgacccctccccttttctagcttttcttgcatagcttgacatttccaacggtagttaatttgtgaggggtttttagaccataactcttgggaggagagacctcgtatgttatatcgatctgggcaggcagcaagtcttccaaagaaagacttcctccacctccgcccggtcctcccacctcggaggactccaggctgcccaggggcggacccctggggcccaggtgagaggtggcagagggtgccagcatcgcgggcgtctaggccgagaggccggtcccagcccggccaggccgcgccgccccaagcctcccaatcccccgggttccctcggctcccctcgcccaccggcggccttgttcccatctccctcactcccaacccggcggctctcacctcggtcccagactcagccctatggaaggcactacacatcgccccgaaggctcggcgcaggagagactcaactttcccgccaccaacgccattcaccaactgcgcagactctacggccagtcaaa

SEQ ID NO: 98 - DNA, 17876 bp, Homo Sapiens
tggaactgcatccattgaacatttatttgtcaaaggcctggtctgtgccaggcagcatgtggaggcactgagtggggggtggagggggttgtacggtgggaatcaagggggtcaccactgtgcccatggggaggccacgccactctgcctgctgggtggatatttcagcctgtgcagccagatgtgttcccaggaggctctgctttccagccagatgtaaggcctggccacagtgtgggactgggtctgcacagtgtgggactgcaggacagggtcctgcaggtggccctgccaggagtcctgccatatccctaccagaataccacccagccaggccagggctgagctggacgcccagacccccagggccaggatacaccgggaccctccttcctctcaacctcggatcctctttgcccagaactgtgttcccaggtggctgacgagcctgtcacgtgccagccctgcgctgcctgcgctcctctgaccggctgtggtgctggcacaggccacactactagagacaaggcagtccccccacccccaggctctcctggaccctgacactggaggttggtgggatatgctttctccaccttgtaccacactgaagttttgtggggcacagtgtgtgccgaggtggggcccccgggagccaaggacccagaggtgggtgaggaggagccgcctgcctgcagccccactgtggcctgagtggtgggggagtaaggactgccctgtgtgcaggaggggagaccctcgtgggcacggtcccaaggctgagggggtctgaggccccagcccagggggcaggcctcagacgcaaccccagttgggcttccatgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctgtggccaccatcttcggatgagaaagtggagccgctgccctggaagagctgtgtctgaaccaggctcccagctgtgccacggcccaggcagacgcgttttaaaggcccgagccccgtgtgtcggggcttctcaggcagggctgttgtgcagccgccaccgtgtcagtgggactgggtcccaggtgtccctcgcaccccttcggcactgatcgtgtaggaacaggaggaggggggcaggtggggggcagagagcacccgcagggtccgggctgggcagccgagggcagcctcttcctcgcggagccggtcagccagcagtctcaccaggagctggttagcccaggttatgccaagggctggggaaacacgttcgtcccagaacctgagaaacaggaagcaggcaagctggcgctcaggcttggtggccccgcccacttcggcccagctgtgcccctggcacctgcacagaggtgcacacaccacatggctgcactcaccccagcggcccgtgtgctgcgccctgctcctccatggcctctgtcacctggaagagcacagtccaggtcagctgcaacggctgagggtcttctcgatggttaggcacaggctgctacccgcaggagccggaggccacctcactgccacccgccccacctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcctggctgtcaaattcacagcggaatggggctgccaccgagtcgatgaccaccaggcgagccatgccccgagacagcagtacggggaccttcttattcacacactccaacaaggtgtcctgtggggacagctgtcattgtctatgctggtcagcaagtccccgccccaggtgaccagaccccgtttggactgtcactcgaccgtctgaaaaccttcctacccacctggggctcacagtgcccatactctgtagtccccatactctgagcccaattctgtatttttctcaaagaggccccaactatagaagcttcaggctcacacaactggttcccttggccccatgtccttcctctggcccccccaggcagtcaccccttggctgtgccaacaccgtcctctgtagaggtgtcctttgcgcaggctcctgagtccttgcgggggtctgctctccttctgccatggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctccaagaggggcttggctcagggtccccatcctcatgcaagcccaagggccacagagtgggggggtgggaatggcaccaggctctgcttatgcaagagaaggctctgtgtccacacccctggcttcccccgtgccagacgcaggcctttggtgctccagggagcagagaccaaagacgcaccagtcccccatgacccctcggccccagggaggctcacaaccagcaacaccctcttctctaggcagacttggggtgggggttccccagagagctgtttccagaacagaacttagtaacactgtcaggttttggcggcccagccctgaccttctatcttctcttgcagtgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgctttacttgaaagtttttataagacctcttagaagtgggggaaggctggcgggcgcggtggctcacgcctgtaatcccagcactttgggaggccgaggtgggcggatcaccaggtcaggagatcgagaccatcctggctaacatggtgaaaccccgtctctattaaagatacaaagaattagctgggcgtgttggtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgcgtcttttctacttcatcacttctccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggagcccctgtgcccctagtgagggccgtcttcccctcaggggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttccccactccgtcttcatgggcaaggttgacagatggtgtacaggcgcccagttacatctgagtttcagatcatgaagaaagttgatctgaatatgggcatcctcattctagaacacgcttcaaagctgcctgagattcagatgtaactgggtgtcgcagcctgccgccctgcctgcctggcccacagccactcctggccaggattctgtttggccaaactgccgtcaggctcctgagcctcctcctaggcccatctgtgcacgtcctcatgaaatccagttttggcaatccctgctgagattgtagcaggacccctgctctccgtatccagtcgccctcagtagctgactggtccatcctccacagtccccagaggccgtctgatccccaaggcacaccttcagcaagggtcctggcaggatgctttagccagaattccctcccctgccagttcctctcagtcactctccatcctctgaccccacctgctcctcgggcgtaaacccccatgacccatgctgtgttcagagctgagccccaactctccctgccctgctgtgagaccccattgccgtggtggctacacctgccccaatggtcctgaatagcttgccttgggggtgtcatggggcttctcccacactcaccacatcggccacgtgctcgatgaagatctggctgccaaatcggagcttctgaagcagctctcctggaacgtcagtgcgcagccgcggctgctgggccatgagctgctgcaggcgcttgtgcgggaaggcgtcttccgtgcagatgtagacggctcctgggaagcaagagtgcctgatgtgcccaggggactccagacgggcctgtgactgccacacaaatcaagtgcagatgtctcccgccatttctaactctctgcccctcacaggttctttgcccctcgcctggggagggaggaggctggtgctttttctcaccctcccactggcagccacctccggggccaggtgacccctcaggaggaatatgggctgggtctccacttctgacacccaggcaaggacttcccctgtcctgggccctgggctggaatggccacagatgggaggcctctcctgctccaccctgcccctccttccccctgtgaacctccgttccccactgcagggcagggagcaagtggcagcatcagggcaacgccttctggaaatggcccctgagccccgacacatggccaccctcaaggcccccactgagcaagcgtttcctctcttcaaagctcctgcaatctgggctccatggtgaaattcaaaaagccagcttgaaaagacacgtgttggtgaggatgtgtaggaggcagacccctgacccctgtgcactgccgctaggaatgtaaaatggtgcagctcggaaaacaatcggtacttccttaaaaagttaaacaaatcacatgactcagcagccccactcctaggtagatacccaagagaaagaacgtccaccgtagcacgtttcatgacagcccggggggagacggcccaaaggccatcaactgaggagtggacgaatgaagtgcggcccatccttacagtgggatgatcgaatcttaaaagggaaggcagttctgacacctgctccagcacggatgaacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgagagacaagagactcactctgtcgcccaggctggagtgcagtggtgcgatctcggctcactgcaacctctgcctcccgggttcaagtgattctcctgcctcagccttctgagtagctgggattacaaggcgtgcgctaccacgcccagctaatttttgtatttttagtagagactgggtttcaccatgttggtcaggctgctctcgaactcctgacttcatgatccgcctgcctcagcctcggcctcccaaagtgctgggattacaggcatgaggtactgcgcctatcaggccgaactgtacacttttagagggaattttatggcatgtaaattacatctcaatttaaaaaacaggaaggcttagggggactgatttgagtaataataaaactccagtttcctgcaaaacaaaaacaaaaagacaaggccggcgagctctctaagcactgactatgccaggaaggctgcccagccaggaccccgtggcccacggggcgtcgtcctgttcctgcagtggcacatgcagttgtgggagagccagtgcccccacgccgtgtcatgcagcctgtttgtgagtgtccgcgtaacctttaattctgagctgattttgctttgacagaatttcaaacgtaaagaagagttgcaaaaatgggtcaggaaccccccgccccattctgtgtcagaactaagcttctgagaagcatctggcccgcttgaggccaggaacgtataaatactgccttgggaggccacatcccttttgtggctggttcccttccccaccagtgtccccagcagtgactgtgcccctagtcaggagccacaggaaggtcggggccctgggcttcctccgtcctgttggctggagagaggctgggctggaaggctcggaagcaggtggaaccggtcaagcagcgtgtttttgttggggtgacgttatgtaggggctgcacagtcatggggacatcgtgaagctggcaggagggtggctgtggacagcccagcggtgggcggggccccagcaggcctgggagagcctcacgcggcttaagcacgggagtcggaatcacttcagagcccgcctgccgctttcttttcaaaattcgggcctttagattggatccaggaaaggaagtcatttccccaggaaagcacatctgacccctaaccttgcatgtggtcacggtggccgtggggccccctcccttcccctggcccgcaaggctggactgtgctgtcatcccgcagcagtcactgggctgggcacagctgggggattcagggagggtgtcctaaggcttctgtgtccctgggtatcggggagtgtgggcttcactgaaaaggccaacggggtggaagctgagggggagtcattgcacaaatcagatttgcacgaagcctggcacggaggacgctggagaatgagggcggctcccgtcccgttcctgagcacgctcgagtcccgcctccacctcacagcagctcttccgtgcggtaagcgggagactcccattttcaaggccaactcctgtcctcccggcttctggctgtctccaggctcatccccaagaccagccgcagggactcaggcacctgacaagagggtgccctcccctgggctgcagggacaaaaatgcctgtggcgtgagcagaccccagctgggctctcaggagacccctcaccctccacccgacacggaggctcaggagacccctcaccctccacccagcactgaagctcaggcaggcacagcacaccctgggtcctggggatgacgctgacctgagggtggcagaggtgaggttcccagccacaccgctgctggcaggtcaggcccgtgaggaggtggctggctgggcctgtgggtccagggcctggggtccggccctgtgtgggaagtgagcctagcagatgtgctcggaggtgccaccgatgaaaaaatactgccactctgttcacgtggagtttaagacaacgtgggaatcgcatgttgacaccagggaattagtttaaaagttaaggagctactgagaaacatctctcctcctcacagctcacagtttaaaactacgtgaacttttaacacctgagagacccaggcaggcatgctctgaacgctttagtccaatgcagggaaccctcgtttcacagacagagcgtacaggctcacggggccgcgccaggagcatacctggcctggcggcggggcacccggggaaaggctgtgctgccctccctgcgttgctggctctgtggactctgggcttggcagctgtgcggaacgtgggccggcatcgctgtgctcagccagcgacccctgggggcctagctctgctgagggccggctgcctggtggtggggttcgtaccctcccacccctcctgctgtcagctgagcccagcctcacttccccctccctgttctggaaggagcgagggcaatcagggtgagaaggagggagacgcaatggtaggaacagcgcaagaggcggccactgccccacctcaacggaaagctgtcccacacaaagcaggggccgcccacctgcccagaccccacggaaggggtggccactcaccagcctccaggcctccgtgctgccgcgggaactgcacagccaggcagagctgcagcgccagctgggtcttccctgccgagctgcgtccggccagctcagtgatgccgtccaggggcaggccaccgcggagcagcgcgtccagcaccgggcagcccaggctcaggcgctggtgctgcgtggggaaccgctccttctgctggtgcagctgcagtgctaaagggcagggatagtgtcaggcctgactctcctgggcctgcgggcagggctggggactgcgggaggcatggtcagcctgcctgtgccaggtgcagtgtggctggagcacaggtgcctgcggtcatgggggtgagcaaggtgctgagggcagggaggggggcccagccgggaagggcgggtgcacctgagatgcagagtcagggggagccccagggccaccatcacatgcccgcagggatccccctatggggcaattgcagcaccagacgccttcagccaaagcttccagagagccccgaggcgctccctaacagcctccatgtgaagaaaaaggcacagctctgtccagctgggatgccctggggtgctgaacagttctcaagcggctttaatgggctcccgcaggcgcgcacacatgcacaccacatgccgtcagttctctgtgacagataccattctggagcaatgctggtctcagcctcttggctaaagggccttggatgagccatttgacacagcctcctccacgacaccgaagcccctcagggcaaggctcaaggtgggacatgcggtgcaggctgcgctcttggcctggggcctgggccgggaggagcagcccctcccttggagtctgcacactgccttgggcaccccgtccaggtggagcaggccaccctgactgtgaggcctgcccagagccctgcccacagcaccgtgtgtgtggccgtggcacctgcccaccacggcagccccaagttcagcacgttcctcggggcctgggccactgagccacctgcaggggagagagggccctgctcatgccaggaccccgctgcctactagggcctgctgagatgcagggatggaaaccttgtccgtccaggcgcatggggttccctgggtacctccttcccctgctgagacctggtttcccacacgtggtggtgggaccgtggccagggccccatctcacaccgttcccaccctgccagagcctgaagggctctgggtgctgactgccaaatccacccctgcttcctgcaccccctcctctggtccatggagcaaggtccccaggaggtcccacagcccgtgtccacctcacgcatcttctgacccgatgctgtgaccacagccccatgggtgtaggacaagcaagatgggaactctggggctggagcagctgccacacgccctgaggctggtccctgggtgaagtctgcacagcccctgccctgcaccactgggaccatgatgctggagccacatgtcacccctggcagagatgccagggcccacctacctgtaaggatgctgcttccccgcaagtgtaaggaggccgttctcagcaagtgccagacctcggggctggagaggttggtcagtctcttcaagtctggtccagaaaagtgtaaaacctcctttaccgatttcagtttggctgaaataacacagataaattacaggaaaatgtcagactgtcacaacgcagggcaacacagtgacaaaaggtgctttgttaagagcactgtgagagcaccgtgcttccgattctggggacaaggtgggtagggaccggatcccctgctccctggaaaccctggacacagtgtggccgatgcacaggcacgaggaaagggctgctggacactgcgccctgagtcctggcactcggacagataccagcctcgtgagctggggcagaagccagaagacagggctgggcaggtcccggtgctgagagcaggttccggtactgagaagaaacgacaggcacccagttccatgccagctggagacagtgctccagaagggggcaggaaaaaaccagcaccgagctttccaccacccgcccaccaggcatggatctgggctgagccgcgggagaggacatgtgccctggggaggggagcgctgggagggtagcagagcccaggtccaaacgccagctgcgcagggcagtcagggcagggggcagagcatgtgcgaatcagaacggcggtggcagcagttacaggggtgcagatccccaggacctgccatctggggaggagggcaaggaagttaattttggactcagataagtgcatcactttctaatttcaaacttgtagaaagacgacaaatgctgcagactgatcagccgatcagggaagtgcgaggaagcgcacacgagagggagcagtggtggacgaagcgccccacccggccacggggacttacacccaccacatcagaaaccccctcaacacgggtgcgctgaacgctgcagtgaaaagacaaccattgtgcggctggaaaacagtaagcactggtgtgatcttcagaaaagccacacagaaaacacaaggagatggaagggtgggaatgaagaaagcgcccctgggtttcaccagatccagcggagggggcttcccgcagacaggctgctccagaaggctctgtgggccctgaggactcaccgggatcggggctgtggcagggcgctccccctggtaagcctcacagccccagcccccttcacagccgtgaagtctgcagggacttctggaaacattggtttttggataagagacacaggtgagaaaggaactccctggctgagcccttctctgtccctggtctgcaagcgtcgtgtctgcagctgtggcagcagctgtgatcacaaggccaccaacaggaggataaaaaccaacagccaaggatggagggtcaggacagcgaggccctgccctgtcaccaggctgctgcggcagctccatgagcactccggcttctcgccacagacagcgtgctgaggttcacgtagctgaggcccggggagacgggggaggatggaagctggcaggagggtccccggatgacagccaggcggctggcatggggagcagggggcaggggctgcacgtggggcctgagttttgagcatttactaactcgggcgaaaaaagatgctgtaagaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacacctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctgggattcaggtccagtagatccaaatccattttgtcggtgggctggccaccaggatgaataacttcccaggaaagacagaacaatggatgcaaattctgaggcactcgccttcaattcaaagcctgtgggaggcccgaaccagggaagtgacagcagccgaggtgtccgtgtcatcggggctctgtcactgagggtggaggagacttcactgtagagggaaggctgtctagctacatctagggcaacatgtctgtcatttacctctaagaattatttagcagcttagaacccattccagacactgatgcatttgaaaaaccccccaaacccaccacatttacctcctgtggaaagtgctagaaataagaccatcctcctgcagcagttgagtgccctgcccgactcacctctctggggcttggggatgacccgcgtgtttttggctgacttgactgaggcatctcttgcactctgcagtttaatttcccttaagtgtctccctggggactctggaaagagtgggaaggtgagtctgggattggcagggtgctcagggatccaaacatcagtcgcccccagcagccaacagcagaagacagcttcctgtgggacgggaggaaggtgctgtggaccccacccagcctctcccaggaagggagctggcagccattccacagcccgagcctggcccagcaagggagaagctcagctcttctcccctccggcctcagcaggctgctcagggactcagcctggggtcacataaggcctttccaacaggccactctgcatcccctgtcggcctcccaaatggtgagaccaagagtgtccaggacatggggaaactggaaggcagcagcctcgagggccgggtccaggatccatgtcctccagtgaggcctggcgcccttggccgtaacccagcagaggaaagggcgggccgtggacttggagaaggttttcccttggaccacacagaatgcggcactggcctggacacgatcacgctggtcactcgtatgcccatgttcagcctgctcagggagacaggaacagactacaggagcagcaggctgaggcacgcccccaggcaccccgtgaggcgggcagggcagggaagctggtgctccaggatgcgtttcctgcccgcgcaccaggcttggctcccgggcccccacagcctgtgggttttctgagcaagggacagggaggtgcccaggcctggttgcccaggcaggcctgacaggaactggcgagaagccaccctggagggccgggcgcaggccaaggcagggcggtggggcgctgaaccagctccaaactgctggcagagctggccagagtgaggaagtgaggttcccaagcacagaaggcaaatcaaaaaggaatgccacctccagggaagacactacactgccaaaggagatgcggccttgcccggctcgaaaagaggtcattttcagaacatgggactctccaagccctgaggacaggaggcagcctggggagtatgaacctcgcacctggtaggggaccccacacccgaggtaccacccaaaacacagcccagatctgcacggagggatggttccctgagcaggcgtgactgtcacagacaggctgggcctgggggctgtcgggaggctgctgtcccaggctgggtctggatacaaaacttggactgtgtcaagcagcgggacgctggcaggagcaccgggaaggccagcacgtggctgcaacgtctcccgccttcaggacgcgggccgaggccaaggcacctggaagcagagtgtccactgacggataacagactcaccggttggccaacggcagtccggctcctgaggctcctcctgggccctctgtgcacatcctgctgagaacttggtttaacaggcctggctcaaagtctgtttagtgacgacctcctcccgtgtcccatcacccttgacagctgattaggcgcctcatcttccactgtcccccgggcggcctgatctggcaggtcagttgaacctgcatccccttcgcccctgggggttcctcttagcaaccttccatcctctgcccctgcccagctctggagctgtaagccgccaccagcccatggcctgttcagagctgagcccagcctctctcccactgcaagaccgcagtgtggtggttcccacatctctcaaaggttctgaatgaaagcctggtctctgcctaacgtgctttcacagatatcctggaatattttccctttaacaccaagcacctgccgcatcccagacactggcctgggagctccacagacagcccggcacatgcctctgtcctctcgccgctgtgaggggcaggggtgtgaccagcccatctctctacaccggggtgaaggccacacacagggagcagcccacagcaggcaaggggctggcccaagacagacctgtatgtcttcctgcagcacccgagctgagcaatgacttcagggggagagctgatgtcacgtgctgctaggtgagtacggacggtcacaccagagctgttaggctcacacaccagactctggaaatgccgtggttactgcctggagctgctctgagccttccgaggtggactcactcctctgccttgggccctgggacctgctgtgtagctttgaagtgattcacagcacttacatagtctgatgttttggggtgacctgacccccctgcaagagtgtgatgtcttatcagaccacatatgtgaggacttgagtgaactccgcaaccttgggaatgccacttaaaccttgtcagacactcccttatgtgagttactgaccctgactgctggactgcaaaaacagacatcagcttgaaggttgtgcagatgctttgaggcaagctatacgctgctggcctgggagctggacctcggtcccagcttctcagagagctcccgctctcacgctctccactgctaccaaggcaaacctcgaactctcaccagatctcactctccaggggcccgctccatcccagcagagcaaccggaccctggccgttctgccactcacctccctgccgtgaatgcaccccatccatggaggccctgcttccctgccaggtgtcttcacctcctcccctctcctcccctctgagcactgtgaacccgagaacaaatcttctttgacaataaaccgtgtgattcgtggaatcatactttgatcatctccttatttcctccacacacaaggacccctgcactgccaatggccccaggagagggcagagtcagccacagggaccccacctcacaggcttcaacactgctgatgcctgtcatcccagcaccgtgggaggccaaggcggccaaggtcgcctgagcccaggagttcaagaccagcctgggcaacacagcaagacctactctctaccgaaaaaaaaaaaaaaaaagaaaaatagctggccagtgtagtggcgcttgcggtcccagctacttgagagcctgggaggtcgaggttgtgcctagctgtgaagacgccactgcactccaccccggatgacagagccagactgtctcaaaaaaaacaataaaaattcacgccttgtaataaggaattaaaggcaggatgaacaaacattttcttcttttttttgtgtgctttctgagatggagtctttttctgtagcccaggctggagtgcagtaatgtgatctcggctcactgcaacctccgcctcccgggtcctggttcaaacaattctcctgcctcagcctcccaagcagctgggattacaggcacgtgccaccacacccagctaatttttgtatttttagtagagacggggtttcaccatgttggccaggctggtcttgaactcctgacctcgtgatccgcccgcctcggcctcccaaagtgctcggattacaggcgtgagccaccgcgcccggcctaaaggattttctttccaaatcaaagtattaaaataactgttcagacctctcccacttcgatgcgaagccagcgcggtcccaggcggacgagcgaaggcatcgaaggccgggggcgcagccgcgggcccacctcggcctcccctgagcggacgcctccccgcgcgcaccgggggccccggagaccgccttccccgctccgaacgcacgcggcccggccccggcgaggtgcctgaacgctacccgagctgcggcggggctcccggggtgagtgctgcagccccaggcccgcctgctcccacaggctcgggcaatggagacccgcggccgcccccgccccttgaccctgcctcacccctcacgcccgctgccgcccacgacctccgaccccgctgccgcccggctcgcagcccggctcgcagcccggctcggcgggcctcacctcccgcgggttccgcactcctcttcccgccgtcctgctcctctcggccttctcctccaatag

SEQ ID NO: 99 - DNA, 80168 bp, Homo Sapiens
tttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttgagctgtggggtttcatttccagaagattccttcacattctcactggcactattttgagttaagtgcaatttataactggatccctaattcctgggagctcctttgctgtctccttaacttcgaaaggaatagaaacggtcggctgccggctagtactttcagacttccttatctcaggttcacagcttcccaaatgggtctgagccaaaaaataggaagtcactgcttcaagattagccacagcccagcccaaaataatacgtctaaaaaaattattaaattggctgggcgcaatggctcatgcctataattctagtactttttactttgggaggccgaggtgggcagatcacttgaggtcagtttgagaccagcctggccaacatggagaaaccccgtctcctctactaaaaatacaaaaattagtcgggcgtcgtggtgggtgtctgtaatcccagctactcgggagcctgaggcaggagaattgcttgaatcctggcaggcggaggctgcaatgagtcaagatggcaccgctgcactccagcctgcgctacagagccagaccccccctctcaaaaaaaaagttgttaaactgcaaacttcattattttgggggaagaattatgaaacatctgagcactatgaaaagccaatttatggtcaaggtgggttacatctcacacctgaaatggggaagtagaaacagttgcgtttgagcatccctaattgaaatgctctgagatcagaaaatttctgagcactgacgtgatgccagaagtggaaaattccacacgtgacctcgtgtgacaagtcgcaaagcaccaggcatacaacagtttatgcagcgaccctaagagaaaaaaaaacccagccctcttcagctgcagtgtatcttcttatacaaaaactctgtttcatgcacaaaattatgtgtatgaggcatatacacgaaacacaggtgaattccacgttcagacttgggtcccatccccaaggtctcattatgtgtatacaaatattcaaaaaatgcaaaacaattctggtttcaagcatttcagataagcaatatatatatattctattttgttaataaggtatacgatttgctttctcaaaaatgccttttctggccagacacagtggctcacaccagtaatccctgtattttgtaaggcagaggtgggagtatcacttgggcccaagaggttgtggagagagctgtgtttgcaccactgaactccagtcagggcaacacagccagaccccgtctcaaaaaaaaaaaaaaaaaaaaaaacaaaaaacagccttttttcgtggtcttagatgattatttccttccttaggaaaaaatgtcagtcttgaaacaatgcaggattgtaatgtcataaatccataaattatttatattaaatgaagattgtagcctggattgatacaaagtagtgaaaagcactgctccaacctttttcctgtcgtgatccacagtgcttaatgtgggcaacattaaaggcatggaccgtaaaggaaagaaggcagacgttatgcaaaacaactgaatgtagacaattgctgaggcaggtgcttaggaccaagtctggcctatattgcttgagggcaaggagccattggtgattcctaaaatgtccatcttcattaacataatagttcagtaataaatagtgggaagcctcacaagccgaagaaaaggtattcatctgtccagagcctctccctactagagtgatggacaagcttttcaaaagtgctcagctctaactgcagtgggctctcagtcagatcctcttgataaggttcagaatgaagcaagataaatcgcaatgacgttcattctccagcagcgatgaacaatttcatgaccaaaaagtagttttccaaagtccctttgtgacagagtccaattatgtggcctgagcctcagttaagatggatcatatttccttttcttcatgtcctggctcttcctatgagattcccagtttcctatggaagacaaaatggcttaaatgtagctgccataattttaaaataaactgacagctaatgatttctggattatattaatgatcctaatttagactaagcccaagaatgagaattactgttaggaggaaggcagatgattctcctagaccaagtggcctcgtgctcatgacagacctgctgctgggagggacagctctccatgcagtcgtttccgcttcctgctattatcaggagctgaaaagggctgcacctgaagtcaggagcccaaaggaaacgttctggctcttaaatcaattctgttctacttgcagtaccattccctaatagaagttcccgattctatcaaactttaaatgaaatgtcatccttcctcaaaaattcccagaattaaagctaggatctccccttaatttttgtgcctaaacacctctctgctacctgttgtgcgttggtcagcgctataagtttggaggtcccaagatccagattttgcttgtggtttctggtggcaaacgctgtgtggagtcctgttctgggtcaccatctggttgttcaaggctaatgtgtcagaggtctgggctgggtctgctctagacgagggcttgaccacaccatcccctgcatcgggagtcacagcccacttttcagagttgtcttcaagagtctctacagaggtcaaggaaaagtgcgtcatcagcaaataatgaagtattctcacagaaagcactggaaaaactggccctcagaaattccatgtcttcagtaccttctgaaagtttttggaatttctctcccctccccctaaaagtacacttccctttggttaggaccaaagaggaactggacatatgctatcagccagaaccccctcaacaaaaccacacgaaaatgaggatttttatgtcgcctaaaaggtattctgtggctactagaaacatacagcacagtagcttacaagcatttcaaggtatttactgattaattcttgagtcactcctgcaaggaagtctttctccaggagtggttctgagacagttacaggagtgctgtgcgtcacaggaggggccggaggcgctgctacggttcacagaggagagaaaggacaagtcatcatcacatcactgcatgggatttcagagcgtgggtccactcccctcttgttagagggaacactctccgaagcacaacaccgcttagggctgcgctgcttctgccagtaaaaagaacttcagcttcccgagtcccagtcctacctacagatctgtctgtggtttgaattcttctcaccagtgggaaaaacaagtttctttctcctttcacagcaaaagtaaaaggtttctcacaggccatctaatccagtgtctggctcgcttgttaacagccataacccttgctcaaacaaaatcttaaactaaaatctgaccaggcacagtggctcacacctgtaaccccagcactttgggaggccaaggtgggaggatcgcttgaaaccaggaattcgagacgccacctctacaaaaaataaaatatcagcgggtgtggtagcatgcacttgtagtcccagccactcaggaggctgaggaaggaggatcacttgagctcaggaaggtcaaagctgcagtgaaccctgatcccgccactgcactccaggctgggtgacagagcaagaccctgtctgaaaacaaaccaacaaacaaaatcttcagccaaaatctgatgtgtgaaatggattaaaataacaatggctcgggttgtctgccaaggggcaggaaaggcctggagggcagcttcctccacaatctacccgggagcttctgcaatggttaagaagctaaacacctgcaataactcaacagtaaggatatccacaggacaggaagtggttctgttttggtttttatgttaatttcagcctgtcggtgctgaggggcatatgaatgaaccaaccatgaagcaagtcctctgtgaatctgcttcacaatttgtagggaaaaactgggcaaaagctcgatgggtctgagacaagccctttctctgtttccactctctgagtaaggactacctaccgctggatgggcaggagagaacaggtggggagacagagaagaaagaaagaaggcatctgtatcactattcccactcaatctggactctgaaataaactaaagttgataaataatctgccaaaagttcccgttattctcaatcccaattttgccttgtattcgaagatatctcagaaacacaaggcttgttttttttttgttttgtttttgttttgagacagggtctcactctgttgcccaggctggagtgcagtggcacgatcttggttcactgcaacctctgccttctggattcaagcaattctgcctcagcctcccgagtaggggggaccacaggcatgcaccaccacacctggctaatttttatgtatttttaatagagacggggtttcgccatgatggccaggctggtctcaaactcctgacctcacgtgatccgcccaccttggcctcccaaagtgctgggattacggacatgagccaccgtgcccggccaaggctttctaatgtagagatggccaaagcattcgaagcaaaaaaaagttctttaccctgaaatttctaattctagaagattttatcaaggcccacttagttccacgggggaaaaaagaaatcattgtctttagaaacgggaaaatgtacagcagatttaaatatctgaatttcctgggctcatctctcctgcgtgtagcttgagagaagtcccagcgaggcctggtttggagccggcccagggttaccgcagagaatcagaagaccctgcggctacacttcctcctgcagacgcctcccagggccctgctcccacccctcgctcaccctcactcttctcagctgacggcgtggagactcgaacctgctgcttctccatccgctcccggaactgctgctgcagctgcttctgccggagcttccgctggtgcgtggcctcgctctccacggcggatgagctcaggcttctgcatgagagggcggcggcgaggacgggctcctgagcaacagccgcggctgctgggaggacacgcacggctggctggctctggaggcctgagtggaggcagccccgtgacacaggaggggccgcagaggaaaggaggggacttaggccgcataccgggagctgcagtcctggtccgccggtatcacagcatggctgggtctggaaggggaggtcacctgctgcagctgtgggtgtcccagggccatgttcggtcggcagctgttgtatcttgcctcctccacagacggttcaagatcttgtctcttcgctttagttaaatccacttcaagaggcaactagaaggaaagaagaaaaacaaattccttcaactggctcttgccctccgctgcttctccctgactcacagattgcgattcctggaaaatcgcatttgacatcctccatccatcacgccttctaggtcctgtaactccatgagcaggaggagccaaacaatttcatgttctgtgttagtgaagttttgataaaaaggaatccttctttggttttgacttagggcagatgttctgtaaaatcgcatttgaatctttcctgggctgctgggtctgtctttgctgcctccttgtcctttttccacggaaatgagcacacacagtctctgtggaggtctgtaccttcccaaccctttctgccagggccacccctgcaaatcgcgctcgtcactgagggagcctcgggcacgctgtggcatcacgaagaacccttcaaacgacagagggaagaacccttgggaggcacggacgccggctgccagccaaggctgcaaggaatcttccagaacggggctgctctgcatctcatcaacatgagaagggacagtcctgtgctgcgtggcacagggcaaatggtttcatttccacacggattcctacagaaatccagaacatttttacttgggaaaacatctctcaattcataaaactgatgctgatggaataattgtttgaatatgagggattaagatgattacattttgacctgaaaatgaaaattatagtgcagatttcatgtctacattgaaagataaatgagtagtttaaaaagaaatgagctttggccaggcacgttgactcatgcctgtaatcccagcactttggcaagccgaagcagatcacttgagtccaggggttcaagaccagcctggccaaaatggcaaaaatacaaaaatacaaaaaaaaaaaatcgaaggaactcctgagtaacagcctgtctctactaaaaatacaaaaaaaaaaaaaaaaaaattagctgggcatggtggcacacaccaacaatcccagctactcgggaggctgaggcagggagaatcacttaaacctgggagacagaggttgcagtgggcggagatcgcaccaccgcactccagcctgggcgacagagcaagactgtgtctcaaaaaaaagaaacgagctttgaaaaatatgaaagactggcgataccaagtgctgtcaaagatacagaacaattggaacttacgcaatgccacgtggggtgtgaattaatacaaccatacaggaaaacgggaagaacctactaaaactaaacacgtacctatcttctcccccaataattcccaacaaaaatgagtgcaactgtacagcaaaagaatgctaacagcatctctaatcgaaacagccacaagctacaaaaaccaaaatgtctactaagaaaagactagaaaaataaattgccacatactcatgcaaaagaaaattatacagcaatgaaactgctgctcgtaccatgaatgaatctcacaaccatgctgaattcaagtaagatacaaagagttcaaactgtaggattccaaaaaagtacataacaataaaaacaaattggtggctttctttgttttttgttttgttttttgagagagggtctcgctctgtggcccaggctggagtgcagtggcgtaatcacagctcactgcagcctgggcctcctaggctcaaatgattctcccagcccagcctcccaagcagctgggactacaggcgccaccaccaggcccagctaatttttatttttatttttatttttatttcgtacagacagggtcccactatgttgtcctggctggtctccaactcttgggctcaagcaatccttcttccttggcctctcaagtggtgggattacaggagtgagccaccacacccggccaatctgtgttgttaaaagcggtttgctcagagtgggaaggagggcaggggatggcagtgactgcaaggaacacagctgggccttctcggtactggcagtgtcttgattcagatgttggctgtgtggatgtgtttggttggaaaattcatcaagctgagcatggatgatacgtgcactcgtctaacctgtctatatgttctttttcatacttcggtcaattttcttaaaatatgaactgtacaattccacttacagtacaattccatttgtgaactttacatatataaagttcaaaaacaggaaaaaataatccatggaagtcagaatagaagacaggatagtagttacttttgaaaaaaggaaagcaaggcagtgactggaagagggcaaaatggggcttctgggctgctggtaaaggtctgattctctatctgggaggtgaacagctgtgctcacttaggaaatggtggctcatgcctgtaatcccaacactttgggaggctgaggcaggtggatcacttgaggtcaggagtttgagatcaccctggccaacatggcgaaaccccatttctactaaaagtataaaaattagccgggcatggtggcgggcgcctgtaatcccagttacttgggaggctgaggctggagaatcgcttgaacccacgaggcagaggttgcagtgatcacaacattgcactccagcctcggtgacaagagtgaaattccgtctcaacaacaaaaaaagagaaatttggggccaggctcagtggctcacacctgtaatcccagaactttgggaggccaaggcaggtggattgatcacttgagcccaggagtttgagaccagcctggccaacacagcaaaaccccgctctactaaaaaatacgaaacattagttgggtgtggtggtgggcgcctgtagtcccagctactcaggaggctgaggcacgagaatcgcttgaacccgggaggcggaggttgcagtgagccaagatagcgccactgcactccagcctgggcgacagagcaagactctgtctaaaaaaaaaaaaaaaaatctgggctcagcgtggtggctcacgcctgtaatcccaacaccttgggaggccgaggtgggcggatcatctgaggttaagagtccaagatcagcctgaccaacatggtgaaaccccctctctacaaaatacaaaaaattagctgggtgtggtggcacacacctgtagtcctagctagttgggaggctgaggtagaagaattgcctgaacctgggaggcagagatggcagtgagccgagatcacacaattgcaccccagcctgggcaacaagagcaaaaactctgtctcaaaaaaaaaaaaaattagccgggcatggtagcacgcacctgtagttccagctactcaggaggctgaggcaggagaactgcttgaacccaggaggcaaaggatgcagtgagccaagatcgcaccactgcactctagcctgggcggcagagcaagactccgtctcaaaaaaaaaaaaaaaattgttataggagacgagagtattatataatgataagaatgtcagccaggtgcagtggctcacacctataatcccagcattttgggaggccgaggtgggcagatcacgaggtcaggatatcgagaccatcctggctaacatggtgaaaccccgtctctactaaaaatacaaaaaattagccgggcgtaggtggcgggcgcctgtagtcccagctactcaggaggctgaggcaggagaatggtgtgaacccaggaggcagagcctgcagtgagctgagatcgcaccgccactgcactccagcctgggcgacagagtgagactccgtctcaaaaaaaaaaaaaagaatgtcaattcaccaagaagatataacaattataaatatttatgcaccaaacaccagaggtcctaaatatatgaagcaaactttgagaggattgtaaggtgaaataaaagcaacacaataatagtaggagacttcactactcaactttcaataatagataaaacaaccaaacaaaagatgaataaggcgatagagtatttgaacaatactataggccaactggacctaacagtcatatacataacattccacccaccaatagcagaaaatacattcttctcaagtacacatggaacattctccaagacagactacatgttaggccacaaaacaagtcctaacaaattcaagattgaaatcatataaagtatcttttcaatcacaatggaatgaaactagaaatcaacagcaaaaagaaaactggaaaatccacaaatcagtagaaattaaacaccacactcttaaagtcaaaggaaatgtaacaagccaacttagaagaattcccagagacaaatgatactacaacacaacctaccaaacttctggggtgcagggaaagaagtcgtaagagggaagttacacacatagttaaaaaaaaaagatctcaaatctacgctatacctcaaagaactagaaaaaaaaagttacacccaaagctagaagaaaggaaattctaaaaagatgacagcaaacataagtgaaagagagaatacaaaaacaatacgaaaaagctcaataaaagtaggagttgggccatatgggtttctcacgcctgttatcccagcattttgggaggccaaggcaggtggatcacttgaggccaggagtttgagaccagcctgggcaacacggtaaaattttttgtattctgtacaaaaaataaaaaaattagcctggcatggtggcaaatgcctgtagtcccagctacttgggaggctaaggcaggaggatcatttgagtctgggatatagaggctgcagtgagccgagatcacacgactgccctccagcctgcgtgggaggatcactcaagcccaggatgtcgaggctccagggagccaagccatgatcagaccactgcattccagcctgggtgacagggcgagatcttgtcatgagatgagatgagatgagatgaataaaagaaattaaattaaaataataaaacaaaataaaatgacaaaggacttgaatagacatctctccaaagacgataaacagatggccaacaagcatatgaaaatatggttggctgggtgcgggggctcacacctgtaatcccatcactttgggaggccaaggcgggcggatcacctgaggtcaggagttcgagaccagcctgaccaacatggtgaaaccccatctctactaaaaatacaaaaattagcccggcatggtggcaggcgcctatagtcccagctacttgggaggctgagacaggagaattgtttgaacccagaggcagaggttgcagtgaaccaagattgtgccactgcactccagcctgggtaacagagtgagattctgtctcaaaaaagaaaatatggtcaacatcactaatcatcaggggtatgcaaatcataaccccaataaaatatcacgcccattaggttggcttaaaaaaaaaaaaaaaaaaaaaaccaaaaactcagaaaataacaagtgctggttaggatttagaaaaatctgaactcatgtgccctgttggtggaatggtaaaatggggcaactgtatgaaaatcagtgtggcagctcctcgaaaaattaaaaataggattaccatgacccagcaatccccttcagaatatgtctaaaagaattgaaagcaagatctcaaagagagttacacaccctcgttcatagcagcattattcacaatagccaagaggttgaaagcaacccaaatccccatcaccaaatgaatgcataaacaaaatgtggtctatatatacaacagaatattcagccacaaaaagaagggaattctgatacacactactacatggatgaatcttaaaggcattaatgctagctaagtgaaataagccagtcacaaaaagcaaaaattatgtgattccatttatatgaggtatccagagtagacaaattcacagaaacagaaagtagacacatatacctataatctcagcacttaaggaggctgagtgggaggatcgcttgtagccaggagtttgagactagcctgggcaatagcaaaactccatgaccacacacaaaaaagtattttatttttatattttattattattattttgagacagaatctcactctgtctcccaggctggagtgcagtagtgcaatcttggctcactgcagcctccacctcccaggttcaagcgattctcatgcctcagcctccagaagagctgggattacaggcaggctgaccaccgggattacaggcaggctgaccaccatgcccagctgatttttgtattttttagtagagacagggtttcaccatgttggccagggtggtctcaaactcctaggctcaagtgatctaaccacctcggcctcccaaagtgctaggattataggcaggagccacagcgcctaacctaattttttaaaaaagaaaaaaagatcaagaccagcctcagcaacatagcaagaactcacctcttaaaaaaaaaagcccccaaaaaaagttaattagctggctccaggtacagtggcccacgctgcaatcccagcgctttgggaggccgaggcaggaggatcacatgagcccagcagttcatgaccagccctgagaaattctgtctctacaaaaaaaatagtaataattgtttaaaaaataaattagctaggtgcactggcacatacctgtagtcccagccacctgagaggctgaggcaggaggatccaggaggatcccttgggcccaggagtgcaaggatgcagtgaattatgatggcactcctgcattccagcctggctgacagagcaagacctcatctttcataaaataaattaaaaaaaaaaaaaaaggaaagaaagtggaagtagttacaagggtctgggaaagggggaaatgcggagttcttgttttacgggtgcagggtcttagttctgcagatcaatttcacaacaatgggaatacacttaacactactcgaccacacactaaaaatagttaaaatgtgatgtgttttactacaatttaaaaaaagaaaaggccgggtgcggtggctcacgcctgtcatcccaaaactttcggaggccgaggcaggcggattacttgaggtcaggagttcaagaccagcctggccaacaggacgaaaccccatctactaaaaataaaaaaattagctgggcatggtggtggctggcacctgtagtcccagcgacttgggaggctgaggcaggagaatggcatgaacccgggaggcagaggttgcagtgagctgagatcacactactgcactccagcctgggcgacagagtgagactatctcaaaaaaaaaaaaagaaaaagaaaacttgactaatatctctcataaacatagatgcaaaaatgcctaacaaaggccgggcgcgggggctcacgcctgtaatctcagcactttgggaggccgaggcaggcgaatcatgaggtcaggaattcgagaccagcctgaccaagatggtgaaaccccgtctctactaaaaaaatacaaaaattagccaggcgtggtggtacacacctgtaatcccagctactcaggaggctgaggcaggagcatcgctggaacccaggaggcagaggttgcagtgagccaagatcacaccactgcacttcagcctgggcgacagagcgagactccgtctcaaaaaaaaaagtctaacaaaatattagcaaactgaatccaataatgtttaaaaatgatttttttaaaggagtttttacagatgcccagtgacacacaccttgtggggctccatgaggacaagaatccctcaggcacaggatgggaatgctgccctggggagcgacatggcagggacctcggagagcagatgaggcaggaggaacactccagaagccactcatggcaaggcagtgtgactccagggctgccccaccacagaccccattctccaaaggcaaaggctcagatcacgttataggtattgacagaaataatggacatgtaaatgacattgtaatgacatcagacatgtaatgacaccagaactaaggaaaagaaagaaggctcaacagcgaggctgggagtgtctgggaaggacagtggtgctgcagagggctgtgtgcttgctttgaggcttcacagactacccccaaccacagttcactacctacacgtacacaaattctctagacctcacattcttgtcaaatggtgtgattttttttttttttttttttggagacggagtctggctctgtcgcccaggttggagtgcagtggtgccatctcggctcactgcaagctctgcctcccgggttcacgccattctcctgcctcagcctcccgagtagctgggactacaggcgcccaccacctcgcccggctaattttttgtatttttagtagagacagggtttcaccgtgttagccaggatggtctcgatctcctgaccttgtgatccacctgcctccacctcccaaagtgctgggattccaggcgtgagccacggtccccggcccacatgatgtactttagaaaaaaggaaaatgttgggattagttcctgctgtctctaacattcgaaatctgaaatcaacattcccgaccctctaaagagctgagtcctcactttttctccttgcatcctccaaatactcaacccatgacacacaagagtttgccgcattatcttcactccactcatccatgtctgatatacctggcgtggaagcttatttagtgatctcaggtagtctttgtccagaatacagtttccaagtgcattcccaaaactcctaagggcaagagaaaaaaaggtgaaacagggttaagaattgttacacatgaatatcagagaatagaattacaacttttgtacaggttgcttctcaggagcagcagaggaagtggaccctaacatgcattccccattgatgtctggtaagcatctagcatgttcctgcactgtgttagtttctgagaatactgcagtgaggacaagacacaagtccctgccctcacagagaagatgagtatgaaaagattacggcgccattcacaaaacccaccagccacctcctgacatggagaacaaactgcagagagtttttcttttttttccccccaaaggctgctccaatttcccagcaggagtaggcaacacacacttggggaccgggggctcaagggcacaacctcccatgaccagagttcttaacttgggatctacggactcccccacagaactcataggtttttctggttcaattcacttcaattctcaaagacacggatatggtttggatgtttatcccctccaaatttcatgttgaaacgtgacctccaatgccggggggtgcggcctggtgggaggtactggatcctggggctggattcctcataaacagcttagtgccatccccttggtgttgagtgagttctcactcagctcatgagagatctggtggttttgagtgtgggggctgggcatgatggctcatgcctgtgatcccggcactttgggaggcacaaggcaggaggatgacttgagcccaggagtttgagaccagcctaggcaacaaagggagaccctgtctctccaaaaaaaaaaaaatttttttttaattaactgggggtggtgttatgtgcctgtgatcccagctactcgggaggctgaggcgggaagatcacttcagcccaggagttcaaggctgcactgagcgatgacggcaccactgcaccccagcctgtgcaacagagcaagaccctgtctcaaaaaatgaaaaacaacaataaaataaataaataagcctgggactccttccttctctctcttgctccctctctctccacgttccctcttcaccttctgccatgattagaagcttcctgaggcctcagcagaagtggatgctggcaccaggcttccagtacagtccacagaatcataagccaatcaaacctcctttatttataaattacccagcctctggtattcctgtatagcaacataaatggactaacacggacatctgcgtgactgtgtaactacgttaactatgctacctgtgcgtagcggaggactgctgaggagcacggagaggagggtgctgtctgtgcactcgcagtaggagtgggaaggcctccggcacacatgactgagtgcacggagaagagagagtacaggattctaccacttactcccagcaagggaagcctgaaacagaaacattgaaaaaatactaacgaaagtgggaaaacggcagacaggaaccagggcaggggtgagaattaccttccacgctgcttggatttttgaaccatgtggatgtgttacctcttccaaaaaaaatcgaaatctgctctgaagcaagagctgaaatgacgcaggttagactcccagccccgcgctcacctgagggctcgcttcagcccgtctgtcaccgcctccttccttgccttctccaaagataaagccttggacttgaggccctcactaacaccataaccaacatcttcatgatatgaaccatcctgggggcagaaaaggagtttgaactcaaacacgagagcggcaggcgtgccacaactcccctgttcctcaagcagcagggttcaaagccggactctcccacctggcggccttgctacaggggcacgggcagaaggctgggtgagaatccatcgcgagtgctgcttcctagacctgggctgcctggacatgtgcctgcggtcaaggtgtcaagacgatcctcccttcccaacttcccaacacacaaagggcacattagaaactcaccccaaatcctatcagtgtgcatcaccctaaggtaaaaaaaacctctgggatggccgggccgggcgtggtggctcacgctgtaatcccagccctttgggaggtcaagggaggtggatcacttgaggtcaggagttcaagaccagcctggtcaacatggtgaaaccctatctctactaaaaatacaaaaattagccgggtgtggtggtgggcacctgtaatcccagctactcaggagactgaggcaggagaatcacttgaacctgggaggcagaggttgcagtgagccgagattgcaccactgcactccagcctgggtgatagagtgagactacgtcttggaaaaaaaaaaacctctgggatatgaaacaaagggatgatttgaacactggatctaatggtctgtaaggacgggagagcaaaccctttgtaaatcaggtggcgtccagctcctgcctctcaccaaaagagaaggtggacctgagcacatcattcgctgattgagaattaaatacaatgtttgatgacagcgctctgtgatttttaaaaaataactcagaaagcactcaaataaatgagtgacactataacacaattctttccattctcagctactcactcatagatacaagattttttagtactatttagaaaaataagtcagaatagaattaatgctgaattgttcattcaagaaataagtaggccgggtgcggtggctcacgcctgtaatcccagcacttttggaggccaaggcgggtggatcacctgaggttgtgagttccagaccagcctgaccaacatggagaaaccgcgtctctactgaaaacacacacaaaaaattaggcgggcggggtggcgcatgcctgtaatcccagctacttgggaggctgaggcaggagaatcgcttgaacccaggaggtggaggttgcggtgagctgagattgaaccattgccctccagcctgggcaacaagagcaaaactccatctcaaaaaaaaaaaagaagtaagtaatattcagttatggatatatggatatataaactaactgaaaagaaaaaacagcaccatccatctcattaagatatacattttccataaattttatattttaaattttttatttttgtggcaagatttcatatctttaatttttctaagtatcaaaattttgctgtatttatgttttctcttcaccataaacacaattgtctggtcaattgtgtgttaacagtagctataatataactaaatccaaaagaaatattttaatatttagagccttaagtgcactgaaaatttaccaaaaatttttatttttatacacaggcaaaggcagagaagcacagtaaggctaccgataaaacttttctttttttccacccaggagttcagtggcgcaatcacagctcaccacagcctcgacttcctgggctcaggtgatcctcccacctcagcctcttgagtagctaggactacaagcatacaccaccatgcccagctaattttttgtatttttagtagagacgggctttcgctatgttgcccaggctggtctcaaatccctgggctcaagcagtccttccacctgggcctcccaaagtgctggggttacacgaatgagccaccccgcctagccaaactttcaaccataaatatgtattaggattaaaaccagtggggaaatagaatagaaatatgagttcagataaagaaagaacaatgtaaaatttctaatgattaaaaaaaagcttgttcattgtatttcttcaaataaatgatagatcttatcctctatagtatttagagtccactggaatatttaacaagattcaacagatttacggtaagtgctcacttaacaccttaaataactgtgacttgaagtgaaacaacttattaacaaaacatatttttgttttcatcaatgttataacaaaaggacctgctttgcctaaagttgagtttccaaacacttatcagtgatggtaaaattattgtattttaaaatgtcagattttaccatatgccaaaaaatacatcctttgcaacaatttttatatatggtgaaaacttttaggtgtcagcttgaacatgtgcaagagaacagtttttccattcttttagggagcacatgagcaagagtatttgaattccaccactctagggaacgctggctgagacacaactctggagcctgggtccccgtccagctacctacttccctacctgctcaccttctcctaccacccactgatccttccgggcagcaggtctactccatcccctcaccttcagctggaccctcacaaatgcacagactcccacgtagaacttgccattgttgaggtcaacaaaatctaggagtgggaaagagagcaagttgaagaggacactgaccgctgggccacaaccattcctcctgctggcagctgagtccacctaccttacctcctcacccacagcagactttcagcaggagctggacagtgcagaagtccccactgctggagagcatactcacccacattctgctgcgtgatggagtgtgcccagccattgtaaccaaacatctcattggccagattaattacccgatgaccctcaatgtagcacacctagaaaaacaaatgtttttaaggaaaagctgtgttaattccttaccacacttaaatgtgaatcaaaattgacataatttattcctcatctacttttttcgataaactgtccttaaacattcttctcgggaggctgaggtgggaggatcacttgagcccaggagctcaaggctgcagtaagctaggatcgtgccactgcactccagcctaagtgacagagtgagaaccagtctgttaaaaaaaatttttttttcaagaaaattctcaatgaatttatttcaaaaatcttctagatggagcccgcgagaacgaatggtctgttgggaggaggaactcacccagcagttgctaaaattcagtttgcaaaaagtacaaatctgtttgacatattttatggaagaccaaaaatatacacagaagttaaaattagaagcaaatgatatgcaattattatgtgtcaatcataagttctttaaaaagtgtttaattaaaaaaaaaaagcaaatggcaaaaggaacattttttttttaatggtgtaaaggctgggcatggtggcccacacctgtaatcccagcactttgggaggccgaggtgggaggatcacttgagcccagcagttcgagatcagcctgggcaacatggcgagatgtcgtctctacagaacattaaaaaattaaccaggtgtggtggcgtgtgcctgtagtcccagctagtcaggaagctgaggcaggaggatcgcttgagcctgggaggtggaggctgcagtgagctgagatgacaccactggtcggactccagcctaggtgacagagcaagaccctgtctttaaaaataaaaaaaaaaaaagatgatgtaaaaatcttaagacggcggttatgcgagtgtcaagaccatgcccaggccccttcggatgagaatgaagtctggaacccatcccctcccaggggcactgggagacctccaggaacagttaacagcagacttccgaatccctgaggacccagagagggaactggcaagaccatcggagtctgcggtatggatgcctgctttccaggcacatgaattctcctaccttctggcctccgccagccatgcggctacttatgtattctgggcccagcctctgcctcagggccttctggatggcctggtactcttctgctgtgtactggcactgcaaccccaaaaaagaaaattaaattcacacttccaccattcctcacatcattgagtctccatcctttatggagactttatactcttaaaaagaccccccagaacctttgtttatgtgggttctatgtatcctattaggaatcaaaactgagaaacttttaaggcatgcatgccattaggcatcatagcagtgacatcaccacatatcatgcactctctgaaaactctaccattcactcatgagacaatgagtgtgaaagaggcaaatagtattattatgaagataattttgaccttctggactctgaaagatcttcagaaaccccagggtttttgagaactgcattttgagaactgctgccttagctgctgctaccatccttataaatgtttctgaagcttaggaagctaaaatgttctgcctccagatctgtaaatgacgtcagcacaggaagcaagtacggaaagagcacgggggtaggaagccttgcttccatttgtcctttccagagattgacgccttctccaatacaacaatttcccatcctgcacaaacagaaacacactactgcttgctgatttgggttttgtcccccttgccctgctcagatgagatgaatactcacaactctctgctaaagacaaagatggagtttgggtggacaaagcaagaaactcttttctgtgcacacaatgtccctacaaggaataggacccccagtaactttccatgcctccaagaaagacaactggagccaggcgcggtggctcatgcctgtaattccagcatttaggaggccgaggcaggcagatcacgaggtcaggagttcaagactaccctggccaacatggtgaaaccacatctctactaaaaatacaaaaaaattaagcccgggcgtggtggctcacgcctgtaatccaaacactttgggaggccgaggcaggcggatcacctgaggtcaggagttcgagaccagcctggccaacatggttaaaccccatctctactaaaaatataaaaattagctggccatggtggtgcatgcctgttatcccagctacttgggaggctgaggcaggagaattgcttgaatccagagggtggaagttgcagtgagctgagatcgcaccactgcactgcagcctgggtgacaaagcaagactcagtctcgaaaaaaaaaagaaatagaactgggtggcatgcacacaggggcaataggaaatagggagattttcacagtttcattttgaatttgatgtcatacaaatatgttatctatccccccccacaaaaaatttaaaatctaaatctaatccccagtactatcagtcttttgatagctaacattccaaaatgccctccagagttcacaagactcccaaaaaatgcatctaaaggaaaaaccaataacaaatagctcacacatgtactatgtaaacgtactaggtactgcccccgcacgcaccgcgtcaacgtactaggtactgctcacacacgtactaggtaaacgtactaggtactgctcacacacgtactaggtaaacgtactaggtactgctcacacatgtactacgatgctctacaaactgccttgccctaactttactcacttcacctcattctttcccggcatgaaggaaccacagttacctgtccaaagcataacactgagccgccgccagcagcaggatggctgtcacgtcctccaagaattgcttcctcagtcccagacatcttgattctggttgacctctatataaataaaaagcggaaaaaaaaaacaaccctcaaagaatgtttaaagtaaaaggcaagagcctctactgaaaaatcacataaagaatccttatgcggccaggcacagtggctcatgcctgtaatcccagcactttgggaggccgaggtgggtggatcacaaggtcaggagatggagaccatcctggctaacatggtgaaaccccctctctactaaaaatccaaaaaaattagctgggcatggtggcaggcgcctgtaatcccagctactcgggaggctgaggcaaagaattgcttgaacccaggaggcggaggttgcagtgatctgagatcacaccctgcactccagcctgggcgacagagcgagactccatttcaggaaaaaaaaaaaaaaagaatccctatgcaataccctaagagttatttataagcttctaagcactgctccaatccagaacagagttcctcagtggttagctgtggtctctcaagctgctgaagattctttaaggtctacttctacctttctgttaacatgtttgctattctggcggtgctattaaaggtgatttttacaataagaatatattacatttagaactataaaatcaaaattacaaaaaattctttatgggaaagcaaacaaaaaatgtactataggtggaacattgctaatccaaaaatccaaaattcaaaatgctccaaaatccaaaacgttttgagtgccaacatgatgtgttatagtcaaaacacaggtaatggccaggcatggtggctcaaacctataatcctaccaccttgggaggccaaggcagaaggactgcttgagcccaggagtttgagactagcctagacaacaaaaccccatcactacaaaaaatttaaaaattagccaggcgtggtgctatgctacttaggaggctgatgtgggaggatcgcttgagctcaggagtttgaggctgcagtgagctatgaccaccccatcgcactccagcctgggtgacagagtgtctgactctgtctcaaaaaaaaaaaaaaacaaaaaaaaaggcaggcacacaacacacagtttattcagcttctccaagagaaaaattcaattatcagccagacgcagtcactgacacctataatcccagcactttgggaggctgaggcgggcggatcacctgaggtcaggagtttgagaccagcctggccaacatggtgaaatgtctttataaaaatacaaaaattagccgggtgtggtagtgcgagcctgtaattccagctacttgggaggctgaggtaggagaatcgcttgaacctgggaggcagaggttgcagtgagctgagattgtgccacggcactccagcctgggcgagagtgagactccatctcaaaaaaaaaaaaaaaaaaaaatcatctttaggctctgaaaacaaatgaatttcatgtttagacttgggtccccttcccaagatatctgattatatatattcaaatattccaaaatctgaagtccaaaacacttctggtcccaaagcatttcagagaagcaatacccaacctgtactagctaagagggtaactgggaggtggtggatatgtgaattaccttgactgtggtaatcatttcacagtgcattcacatatcaaatcatcacattgtacaccctaaatatatacaatttttgtcagtcatacctcaaaaaagctggggggtagggaagaaaaatcaagtgaatctgttttaaagtttaaaaaaaccggccaggtgtggtggctcacacctgtaaccctaacactttgggaggccaaagcaggcggatcacctgaggtcaggagttcgagatcagcctgaccaacatagtgaaaccccatctgtactaaaaatacaaaaaaattagccggatgtggtggcaggcgcctgtagtcccagctactcgggaggctgaggcaggagaatcacttgaacttgggaggcagaggttgcagtgaactgagattgtgccactgcactccagcctgggtgacagaacaagactccatctcaaaaataataataataaagtttttaaaaacctcaacttactgctcactactatataggcagcatgaccctggacactgtggggtcaaaaagaaatagaagccacaatcactgaaatgctttccaggagctaacaagatagctggagggaggagacttaatagaaatgaaacaaatgaagagcaggaggccccaacattcaggaaggctacagagcaaaaagccacttcacttccttaaccagcagcatcaccatcacctgtgaatctttttttttttttttttttgtaagcgtttcgctcttgtcgcctaggctgccctgcagtggtgtggtctcagctcactgcaaccttcacctcctgggttcaagcgaatctgctgcttcagtctcctgagtagctgagattacaggtgtgcgccaccatgcccggctaaattttgcatttttagtagagacagggccgggcgtggtggctcacgcctgtaatcccaacacttcgggaggctgaggagggcagatcacctgaggtcaggaattcgagaccagcctgaccaacatggaaaaaccccgtctctactaaaaatacaaaattagccgggtgtggtggtgcatgcctgtaatcccagctactcaggaggctgaggcaagagaatcgcttgaacccggaaggcggaggttgcagtgagccgagattgcgccattgcactcccgcctgggaaacaagagtgaaactccgtctcaaaaaaataaataaataaataaataaataaataaataaataaataactagagacggggtttcaccatgttggccagcctgatctcgaactcctgacctcaagtgatccacccgcctcaggtgtgagccaccatgccagaacacttctcacatttaaagagcaacttgtggccgggcacggtggctcacacttgtaatcccagcactttgggaggcccaggcaggtggataacctgaggtcaggagttcaagacgagcctggtcaacatggtgaaaccccatctctactaaaaatacaaaacttagccagatgcagtggcgcgtgcctgtagtcccagctactcggggggctgaggctggagaattgcttgtacccgggaggcggaggttgcagtgagccgagaccacaccactgcattccagcctgggcaatggagcaagactctttctcaaaaaacaaaacaaaacaaacaaaaaaaattcagtcttttattgaaggacaatcttatctttgtccataaagtaaatgtgaaatattttttgccttttttgctcttttactttgaaaaagatgtcttactattctgctttccttcctaaaactgtctacaatggtttttccattataaaagtaaaaaaaaaaaaaaaaaaaatttaagagacagcgtcttgctctgttacccaggctggaatgcagtggtgcaatcatagcatactgtaaccttgacctccagggctcaggtgatcctcccactgcggcctccagagtagacaggactacaggtgagtgctatcatgccaggttaattttttttaaaatttttttagagatgagtgtctcactatgttgcccaggttggtcttgaactcctgggctcaaggagttcaagtgttttttatgtgtgcatattcgttaaacaaaggtagaatccaaatgcattaggcatatcttacacagcacttcaaatcttcttggccttgtgtgtccttgaggcccttggtcactttgtccactccagctgtcactgggctgatcaaacacgtctgggttataaccaactgcccacaggcacaaccccacggtcccttacctcctgctcatactgggtacctatcacttcccacccgtggcttgctgcttgccttggaggtgtaagggtctgtgggacccacctggtacccacacatgcacaacctagaagtctatgggaattaatgtgccatgaagcaaacctttttccagtgagatacagaagctgaggggtccgtccacccttcctttagatggattgccctggaatgcagttatgtatacatcctcctgggagacagctttaggagaacaagcaaccaactgtacttgcaccaagggcaaccaacttcaaaatgcacccttgaactgacttaatcttccttctcccttcactcacctttcccctacctctgcttcctgagagcacacttcttgaaaaaataatagcacatacgctcttgcctcaagctgtaggttctccaggttctagggtacccaggtatagcagacactacggatgctctactcagcatcccttcagcttttttttttttctgagacagagtctcgctctgtcacccaggctggagtgcagagtggtgtgatctcagctcactgcaacctacacctcccagattcaagcaattctcctgcctcagcctactgaatagctgggattacaggcatccaccaccacgcctggctaatttttgtatttttagtagagacggggtttcgtcatgttggccaggctgctctcgaacttctgacctcaggtgatccgcctgcctcatcctcccaaagtgctgggactacaggtgtgagccaccgcgcccagccatcccttcagctcttaccacaatagtgcaccctattctgacttccaaatgccaacatctgcatcttgttacctgagagctttctttggtatccagactactttgcacctgtttatggcaagctgtaagcaccagaaaattgaaccaccctggcagcagccctcaaatggtgcctgacaggagctggtgttgaaatacgctaaatttctgacccctctgtggaacatcaccaagccatgagcttctccagtggaattaggttcccccgtggcaacaggcttgaaaactcaccctttgttgtcaaactttcctttcctgtctcccttccccgctcctctactgtgtaaaggactaatctccaaataaactacttgggaataaaaaggagggcggcaaaagatgcctttacaatgtagaaacctgggagttaccaccttaattattaaggaatcaaacttaatgtcaccaattacagtcacatcatgtgcttcctgatggacgcactaagaaggtcccatcattgaggtagtatttctaccaacctaatcatcaggaaacaatcaaacaagttgaaatctacaaagcaactggcctggactctccaaagcatcagtgtctcaaaaagcaaaacaaaatagaatggctggtgaactcttttatgttaaaagaggcttaaggctgggtgtggtggcccacgcctgtaatcccagcactttgggaggccaaggcgggtggatcatctgagctcaggagttcaagaccagcctggccaacatggtacaattcccgtctctactaaaaatataaaaagtagctgggcatggtggcacacacctgtagtcccagcaacacgggaggctgaagcaggataatcacttgaacccagcgggtggaggttgcatgagccaagatcatgccactgcactccagtttgggtaacagagcaagactccatctcaaaaaataaataataaataaataaagacttaagaggcatgacaactaaatgcactgtgtgatcttcaatgaaatttcggatcagggataaagaaaagctataaagaatattattaggacaatgggagaaatctgatgatgggatgaatatgagactgcagccacaacctcctgggctcaggtgatccttctgcctcagcctcccgagtagcttagactacaggtgtgcaccaccacagctggttagtgtgataattatatcgtgattctgtaggacaatggcctatcactagatgtatgattttgtatgatgcaatattggagtaaagtgtcatgttttctgcaacttactctcaattcattcaactaattgtgtgtgtgtgtgtgtgtgtgtgtgtgtgtgtagagagagagaaaaaggcaagtagataaagcaaaagtacaaatttatgaacctaggtgaaggatatgcagacattaattgtaaattttttttttgagacagtctcgctgtgccacccagtgcagtgaggcgatcatggctcaccgtaccctcaaactccttggctcgtgatcttcccacctcagcctcctaagtagctgggactacagttgtataacgccacacacggcatattttttattttttgtagagacacgggtctcactatgttgtccaggctggtctcaaactcctgggctcaagcaatcttcctgcccagcctcccaaagcactgggattacagacgtgagccactgcacccagcccactgtaaaatttgtccaaaggcttcaaatctttcaggatgaagtgtcaggaaagactacctgcatagccaagattatggcagctatataaatccaaatatccaaacacatgtccaaaaactacacagaccaaccaaccggagaaacaaagaaaatcaccaacgtctcatatcttcaacatacttagaagactgaaaatactacaagcttctaattacccataagtagaaaaacgtcaatttcttgtagagatgtttctcaatctctcatctcagctctttaaggacagcaaagagggatccagataggaagagagatgcaaagaagagagaagagggctgggcgcaccgggcgcggtggctcatgcctgtaatcccagcactctgggaagctgaggcaggcggatcacgaggtcaggagtttgagaccagcctggccaagatggtgaaaccccgtctctactgaaaatacaaaaattaggtgggcgtggttgtgtgcgcctgtaatcccagctattcgggaggctgaggcaggagaatcacttgaacctgggaggcagaggttgcagtgagcagagatcacaccactgcactccagcctgggtgacagaatgagactctgtctcaaaaaaaaaaagaagagagaagaggacaatggagagcctaagatggaactaaaatatcaccctgaaaaagaaaactcacggtaagtatgaaaacaccaacaaagaattccgttaaatcgggagggaggaagggaaggtcgggtagagacacttttaaacacatgcagaacttgatgaggtagtcttgaaaacgcaagccttctgggaagaaggagaaaaagaatgaaagggtaccctctgttggccgggcgcggtggctcacgcctgtaatcctagcactttgggaggccaaggcgggcggatcacgaggtcaagagatggagaacagccttgccaacatgatgaaacccagtctctactaaaaatacaaaaattagttgggtgtggtggcgcgtgcctgtagtcccagctactcaggaagctgaggcaggagaattgcttgaacccgggaggcagaggtagcagtgagcagaggttgcagtgagccaagattgcgccactgcactccagcctggagacagagcaagactccgtctaaaacaaaacaaaacaaaacaaaaccaaagagaaagggtaccctctgaaaactgtgctgtgaaagacacaaagaaaatgtaagagccaaaggacatagaaccacctccccgacaaaaaagccttctagtagaattagaagccatacttgactacacctagaaaagaataggaactactcttgaactaggaatctcaaaaatcatcctgaatgactgtcactcctgctcacgaaatgcaaacttcgagaaaaaaaaaagattgaaaagaatgaaagaacctcaggatcctgtgggctaatatcaaaatgtctaactcacatacaattgaagtgaaattgaactcacatacagaagaagtgaaagagaatggaacagaagaaatatttttaaaactaatagctccaaatttcccaaattggccgacagacataaatttacagatttaagaagctctgcaaatctcaagaataaatctccggataaatacaaataaaatgacacctagatacaccacagacaaactgctaaaaaacaaaaataaagagaaaatcttgaaagcaggtagagaatgataacacattacatacagagtaatgaatgatgcaaatgatggctccattttacaataaaggtaagaaacatatctagaaatcaatttaacaaaatatgtataagacttctgaactgaaaaccataaaacagaactaaaagaattttttttttttgagacagagtttcactcttgttgcccaggctggagtgcaatggcaccatctcggctcactgcaacctctgcctcccaggttcaagtgattctcctgcctcagcctccagagtagctgggattacaggcatgcgccaccatgcctggcaaattttgtatttttcgtagagacagggtttctccatgttggtcaggctggtctcaaactcctgacctcaggtgatccacccggctcagcctcccaaattgctgggattacaggtgtgagccgccacacctggcccaaaatttttatttttattattattattttttgagacagagttttgctcttgttgcccaggctggagtgcaatggcactatctcagctcactgcaacctccacctcctgagcaagttcaagcagttctcctgcctcagcctcccaagtagctgagactacaggcacctgccaccacacctggctaatttttgtatttttagtagagacggggtttcaccatgttggccaggctggtctcgaactcctgacctcagctgatctgcccgctgcagactcccaaagtgctgggattacaggcataagccactgcacccggcctaaaaagaaattttaaaaggcttaaataagaaggaaaatgcaccaagttcatatatttgaagactcaatactgtttaggtgtcatttctttccaaattgatccatagattcaatgcaatcccaatcacaactttaccagacttttctgtaaaactggtaaagataattctgatatttatatggaaatgcagaggatttagaatattcacatcaagcttgaaaacaacaaaattggaagacctacaactacatgacttcaagacttactaaaaagctacagtaattaaaagtgtggtactaacacaaggattgaacaatggaacagaaaagggagtgcagacatcaattaccatttgtacagtcatcttaatttccaaaacgcaatacaatagcattttcaacaaatggtgctggaatgactggatatctatatggaaaagaaattaatatttaattatatctcacaccattcacctaaactagaaatgggtgataggcttaaacataaaactaaaactataaaatttataggccgggcacggtggctcacgcctataatcccagcatgttgggagaccgaggcgggtggatcacaaggtcaagagttcaagaccaacctggccaacctggtgaaaccctgtctctaataaaaatacaaaaattagttgggcatggtggcgcatgtctgtaatcccagctactcgggaggctggggcaggagaatcgcttgaacctgggaggcagaggttgcagtgagcggagatcgccatcaccgcactccagcctggacgacagagcaagactctgtctcaaaaaaaaaaaaaacttacagaagaaaacatgaaagattatcttcacagcctgaaggtagccaagatttcctaggactcagaaagcagtaactataaaagaaaatataagagaaaactgattacatcaaaatgtaaaacttctgttcatcagacaactctaagaaaatgaataggcaaccagacagaggacaggtaaccaggatataaaggttatataaataactgctacaactcaataataaaaagacacacaacccaatgtaaaatgggcaaaagatttgagcaggcacttcacaaaggaagatgcacattgtcatgggcacaggaaaaagtgctaaacaccattagtgactgaggactaaaattaagaccatgacacaccacacccatcagaataactcaaaagactgacaacaccaaatgctggcaaggatgtaaagcaactggaactctcatacactgttggcaggaaacaggctgataaaaccactcagctgttaatgcacactactcttcatgaaaaccaaaggccgactccaaggacggagccacacgtccagggagtagagcagcagaggcccaatcccaggcctggagccctactggttttttgagacgaagtcttgttcagtcgcccaggctggagtgcagtggcacaatctcggctcactgcaacctccatcttcctgactgaagcaattctccagcctcagcctcccgagtaactgggactacaggcacgtgccatcacgcccagctaattctaattcttgtatttttagtagagatggggtttcactatattgctcaggctggtctcgaactcctgagctcaagtgatccccccgcctcggcctcccaaagtgccaggattacagacgtgagccaccgcgcctggcctattagttctttatttatcttgaatatcagtcttttgtcaaataggtccctgtgtttccccattcattttcttagagtagtctgtgattacattttgatgtaatcaatcatatttatctttgtgtgtgtggttttttttttgggttttttttgcttttttaagtgactctggcatcctgagccctaagaaacctttgcacacactcaggtcatgaagatattcttctcatcttcttccagaagcctcacggttttctaattttgaaaataggtctgggcggggcccgctgggtgcagttgctcacacctgtaatcccagcactttgggaggctgaggcaggcggattgcatgaggtgaggagttcaagaccagcctggccaacatcatgaaactccatctctacaaaaaatacaaaaattagctgggcctggtggaatgttcccgtagtcctagctactcagggggctgaggtggaaggcttgcttcagcctggaaggtagaggctgcagtgagaagagatcaccccactgcactccagcctgggtgacagaacgagactgtctcaaaaaaaaagaaagaaagaaattaagtagccaggagtggtggctcacgcctgtaatcccagcacttgaggctgaagtggaaggatcgcttgaggctcaggagttcaagacaagcctagggaacatggctgtctctacaagcagcaaaacgttagtcgggcatggtggagcatgccggcagtcccagctactcaggaagctgtggtgggaggatcacttgagcgggggcgaggaaggggtcaaggctgcagtgagccatgatcataccactacactccagcctgggcaacagaggaagaccctgtctcaaaaaagaaagaaagaaattaaatatgtatctgtcatatgatcccaaaattctgataggtgttttcccagaggaaataaaaacatggtaaaaaaaaaaaaaaaaaaaactcaggggtagaagggagagagcctggactaggatagtggctatggcaagaaatcatgaattcaagatattaaaaaggtaaagactggcaaagatgttttattcttctccatttccttatcacctaaaagcatttttctttctttttttttttttttgaggagtctcacactgttgcccaagctgcagtgcaatggcacaatctcggctcacaaaaccatttcttattatatgtggagggctgaagaagcatgtcaggtggactctggatatacagatcaagagggagatgtgacaaggtgatgggtgagattctgactgtgaaggtcaagaacggcttgatgaacaagactggagcaagtttcttttattttcatttatgaacacagtactataatgttcatgaaactttaaaaaaattagcaaaagtagaaaaaaagtggccaggcacggtggctcacatctgtaatctcagcactttggaaggccaatgcagacagatcacctgaggtcaggagttcaagaccagcccggctaacatgatgaaacctcttctctactaaagatacaaaaattagctgggcatggtggcaggtgcctgtaatctcagctcctcaggaggctaaggcacaagaatcgcttgaatccaggaggcgaaggttgcagtgagccaagatcgcaccactgcactctagcctgagcaagagtgagactctgtctcaaaaaaaaaaagtagaaaaaaaatttttaattgaaatctcaaaatgtcattacctctaaagccttatgcagctcaccacactctgaagtatgtctttttttttttgagggggagacactctgttgcccaggctggagtacagtggcgcaatctcagctcactgcaacctccacctcccaggttcaagtgattctggtgcctcagcctcctgagtagctggaactacaggcatgcgcgaccacacccagctaattttctgtacttttagtagaggcaggggtttcaccatgttggccaggctggtctcgaactcctgacctcaggtgatctgcccacctcggcctcccaaaatgctgggattacaggcataagccaccacacctggcctgaagtaagtcttaaaatttgtgggaacccagtaatcccagcactttgggaggccgaggcaggcagatcatgaggtcaggagttcgagaccagcccggccaacatggtgaaactccgtctctactaaaaatacaaaaattagctgggcacggtggcgggtacctgtaatcccagctactcgggaggttgaggcaggagaatcgcttgaacctgggagacggaggttgcagtgagccgagatcacgccaccgcactccagcctgggcgacaagagtgaaactccgtctcaaaaaaaacaaaaaaacacggtgggaacataggattaattccctcacactgatcatttctctgcactcccacactcagccattagagaactgcggggccatacactaatcactgaatccccaacactcagcacagtccccactcagcacatagtatgaagagcattttagccttattttagcttctctccacatcaaaactgccagttcaatattaaaaatgagtgccttgagtgaagaaatgctaaaagctgcagagatggaaaaatatccactaggctttctgcccttgaagcactactgagacagtcagttctcattattcagggtagttatgtcctgtaaagccatcatgaacactgaactagcaaatactgagccactgctcccaggggaaatacagggttactcaacaggccaatacataaccttgttttatgtgtgcttctgtttaaagatatcttatttaatatatattgttgatgcagtaacatgaactcacagccaacaacaaaagtgatgcctgaacaaagctaatctaaaagcttatcttttctctataagatatatcacagccttcaacttggaaatgctagacagcacttctattcttggaggcccctataaacagcaaaatcaccaaaagcacaaaaatacaaaaaaacatggcactacgtatacagccaaaataacacttatgaacagttttagagctgaaacaggaaggcagagtgtcaccttatttgaacatagctgggaaagcatacagtgggtgactcaaaatttttcacaactagtctctcccacagctagctcagttacatttttcatacactcatctccaactacaccgtttatactacaagataacacgttttggtgtacattacacaacagcaatctctgacggtttctgcctccctgagaagaccagcacacaaacatttctctgcttgataccacgataattaacggcctggtaagtggtgaactgagaatagaacactttaaaaaacactcccagaggggcgcagtggctcacgcctgtaatcccaacactttgggaggccaaggcgggaggatcacctgaggtagggagttcgagaccagcgtaaccaacatggagaaaccccttctctactaaaaatacaaaattagccgggtgtggtggtgcacacctgtaatcccagctactcgggaggctgaggcaggagaatcgcttgaatccaggaggcagaagtggcagtgagtcaagatctcgccactgcagtccagcctgggcaacaagagcgaaactctgtccccccaaaaaaacaacagacaaacaaaaaaacaaaactcccgcccaggtgtggtggctcacacctgtaatcccagcactttgggaggccgaggcgggtggatcacctgaggtcaggagtttgagaccagcattgccaacacggtgaaaccctgtctctactaaaaataccaaaaattagcctggcatagtggcatgcgcctgtaagcccagttaccgaggaggctgagagaaactctgtccccccaaaaaacaacagacaaacaaaaaaacaaaactcccacccaggcgcggtggctcacacctgtaatcccagcactttgggaggccgagatgggtggatcacctgaggtcaggagttcgagaccagcatggccaacatggtgaaaccctgtctctactaaaaataccaaaaattagccgggcatagtggcatgcgcctgtaagcccagttaccgaggaggctgagataggagaagcgcttgaacccaggaggtgaggttgcagtgagcccagatacgccattgcactccaccctgggcaacaagagtgaaacttcatctcaaaaaaaaaaaaaaaacaaaaaaaaaactgccctaaacgataccagacctgaggccactgaattacctgacccaacccaagagttaaatgctagtttccaaaaacttaagttttaaatgtctgtgcctcagactgcgagttctgtggaggactagacctagaaagcctagaaaatcaccagtatccatcaaaaatggagaaacaaaatgtggtatatccacacaataaataattcagttatttaaaaaatgaagttgatacatgctacatacaacatagatggactttgaatcatgaagtgaaataaaccaaacacaaaagaacaaatattgtataatacagtactgagaatgggtaaattcatagattagtgctgctgggagtaggaggaaataatgggtgtctgctaatggttttaaggtttcttttagggatgataaaaatgttctggaattagataatagtggtgattgcacaaccttgtgaatatattaaaaccactgaattgcacactttaaaagggtgaatttagactgggtgtggtggctcacacctgtaatccctgaactttggaagggcgaggagttcgagaccagcctaaccaacatggtgaaaaatacaaagtagctgggtgtggtggtatgcgcctgtaattccagctacttgagaggctgaagcaaagaatcgcttgaacccaggaggcggacgttgcagtgagccgagacggcgccactgtactccagcctgggcaacagagcgagactatgtctccacttttttttaaaaaagggagtgaatttaattgtacgtgaattataacttttttttttttggatggattctcgctctgtcccccaggctggagtgcagtggtgcgatgtcggcttaccggcacacctgcctactgggttcaagcgattctcatgcctccgcctcccgagtagcggggattacaggcgcccgccaccaggcctgcctagttttgtatttttagtagagacggggtttcgctatgttagccaggctggcgtagaactcctggcctcaagcgatcctcccgcatcggccttccaaagttctgggattacaggtgtgagacgccgcgccagacctctatctcaatgttataacaaggctcaatactcagctaaagtgagcgtcaaatttttatttttattttttcccccgtgacagggtctcgctctgtcgcccgggacggagtgtcgtggtacgggtgcgatctcggctcactgcaggcttgacctccagggaacatgggggcatgccgccaccatgcccggcgtcaaattccttttaaatcaatcatttcttcccagcgtcccccgctccctgcaactcaacttcgtttagctattaacacaaacttcagattccccacgcctgtctgcaggcagcatctccaaggaagcgccaccacggacacctggctgtccgcaccgcggtggggtcccggcgcgttggtgccaagtttcctgtaccccgccttcctacccacctctcgggaggcccggatactgagcccctcactgcactggtgaactagaacaggcctctggactcagcatctctacgctgagacctcaggatcaggtccaccgcagccccaggttctcgacccggaagctgagccttcccacgctccacacccacggctagaaccaccccgggggaagccgctctcctcccccacttacgcgcctcgggcagcgcgcggtgcacacagggagctcgatctaggctatggacaaggggaagagatcttagatggaggccgcgcagaggagaatgggaagggtgcgcgagcgtctctgggaagaaggtccgaacccacgcccagcgccggagggggaaaaaaaaaaacacagaccagagaaggaaccgtaaatcaagtcggaggggaaaagagccgcaaagccttctgcggcagccgtaaagcaacctggaggcgcggtgctggcttttacgttctgagccgctcgccctgccgcttccctgcgcgccctctgcctcctacttcccgccagcttccctcggtccgcggccgtcggatctctgctgccccctggtgggcctggcggtttcgtcaggccttcagcggctagttaggcccgggtggttcacacttcacatgcccagtgcccattaggatgcggggcccgcccacccatgcacaattgggaaaatctgaggatgaatggttgtcagagaccttcccagattccgcccgggccgaggcagcggtggacctggtggttctcgcggcctctcaccaccgccgcgcacatccagtcgtcaccggatggcgccttcggttagcgacgaccgcagggaaatggagaagtgcggcttggggggcgaagtcccctctagaatgtcccctggggccgggcgtggtggctcaggcctgtaatcccaccactttgggacgccgaggcgggctgatcacgaggtcaggagttcgagaccagcctgggcaacatggcgaaaccctgtctctactaaaaatacaaaaaattagccgggcgtggtggcgggcgcctgtagtcccagctactcgggaggctgaggtaggagaatggcgtgaaccccgggggacggagcctgcagtgagccgagatcgccccactgcactccagcctgggcgacagagcgaggctccgtctcaaaaaaaaaaaaaaaagtttttgtagcgacagggtcttgctatgttgcccaggctggtcttgaactcctcgcctcaagtgatcctcttgcctcagcctcccaaagtgctaggattacaggtatgagccactgcacctagcccacttatcattctttttgtggcgagatattttcaacttactctcttagaaattttgaaatatacaataaattattattaactatagtcactatgctgtgcaataaatctcaaaattgtattcctcctgtttaactgttaactttgtaccctgagaccaacatcttcatctccccattatctcccccagccccttattccccagcctctggggaatttttagtagagacagggtttctccatgttggtcaggctggtctcgaactcccaacctcaggtgatctgctcacctcagcctcccaaagtgctgggattacaggtgtgagccactgtgcccagccaatattgagcatttttatgaacctgttgatcatttgtatgtcatcttttgataaatgattttttttttaaagagtcagggtctcaagctatcaagctgttgcccagactgtactgcagtgctgcaatcatggctcactgcaacctctaactcctgggctcaagtgatcctcccacctcagcttcccaggtagctgggactacaagcatatgtcaccacacctggctaatctaaaatttttttgtagagacaaggtctttctatgttgtccaggcttttcacaactcctggcctcaagcaattctcctgtctcagccttccaaagcactgggattacaggtgtaaaccagtgcacctggtgccctttgccccctttttagtcgtgtgatctgattttgctatgagttgtttgctttcttcacatatttagaataggatagtaaccccttattggatatatggtttgcaaatattttctctcactctgttgttttctttgttgtgtcctttcatttctgattttggtaatttgtgtcctctccttttttcactagtccagctagatgtttattaattttacctgtcttttcaaagaaccagctcatggttttattaattactacaattgtttttccatttgtttgtttcactgattttcattgttatcttcatcacttcctttcttctgctcactttaggtttactttacttttctttctttttgtttcttatgattttaacctttttttgttttaagtaaaggcatttaaactattaaactataaattttcctctaagaactcctttagctgaattttataaattctgaaacataatttttggggtaaatgtattttaaagttacctacctgcatgttattgtatatattatattgttttctttttttttatgaaaaacttttttttctaagagacagcacctcactctgctgcccaggctatggtgcagtggcacggtcatagctcgctataacctcaaatgcctgggctcaagtgatcctcctgcttcagtctcctaagtagctaggattacagaggctacatgcccagctaagtaaaaaaacatttttttggtggaggcagggtcttgctatgttgctcaggctggtcttgaactcctagcctcaagcaattctcccaccttggcctcccaaagtgctggaactgcaggtgcatgacactatgcctggctaattaaaaaaattttttttagagaggggttcttactatgtttctcaggcttgtcttaaactccagggctcaagcaatcctcctgcctcagcctcctgagtagctgggactacaggtgctcaccaccatgctcagctctaaaaactacattttaaaaatagttcctgctattctttgttgtgggttgaattgtgttcctcaaaaagacaggtagaaattataacctccagtacttgtgaatgtgaccttaattagagaggggtctttgtagatgtaatcaagtaggatgaggtcatactcaattcaggatagaccctcttcaatataattgctgttataagaaaacaggctgggttcggtgcctcacacctcccaacactttgggaggtcaagacgagaggatcgccttgaccagcctggccagttcgagatcagcctggccaacacggtaaaaccccgtctctactaaaaatacaaaaattagctgggcatggtggtgggtgcctgtaatcccagctacttgggaggctgaggcaggagaattgcttgaacctggaaggtggagtttgcagtgagccgagatatagtcattgcacttgagcctgggcgacaagaacaaaactctgtctcaaaagaaagggaacggaagagaagggaagggaggggaaggggaggggaggggaggggaagggggaagggaaaaggggaaggggaagggaggggaggggggagagggggaggggagggggagggagggaagggagacgcccgggccaggtggctcacacctgtaatcccagcactttgggaggggggcggatcacttgaggtcaggagtttgagaccaccctggccagcatgttgaaaccccgtctttactaaaaatacaaacattagctggggatggtggcacatacctttaatctcagctactcgggaggctgaggcaagagaattgtttgaacccggaagtggaggttgcagtgagccaagattgtgccattgcactccagcctgagcgacagagtgagactcagtctcaaaaaaaataaaaataaaaataagaaaacagagacaaagacagaaggaaggcagccctctgaagatggaggcagagattgcagtcattatgccagaagccaaagaacatgaggccaccggaaactggaagaggcaaggaagtatcctcccctgctgtgagagcaagctgtcattacttagtcaaataaagtgtatgtctacgacccagtgattccactcctgtgtacaaaaagtcctcatacaatttacgaagggacatacatgaacatatccactgtagtattatttacttcataacatggccgtgccaagttctttaatctgggacttagagcctcaagaactgagagaagctaaatttctgatgttttaagccacccagttgtggtaatttgttacaatggctttaggaaactaacacaatgtgatttctaatccatcgtgcctgcctgccacagcatttcccatggtgtacatccaccatatttcgcccatctaccttccccactgtgaacatcataaataatactacagtgaacatattcctacatgttcctttataaactgtgtgagagcgttccgtacacacagcagtggaaccgttgggtgacagacgtctattttatttgcctgagtaatgacagcttgctctccaccgcccttgcatgagggttcctgtatgtccacacccctgccaattcttgacatcatgctgattcacaactttcggcagtgtaatgagtgtgaaatgttatcttttttaaaaaaattatatttctgattactaatgattttaagcacttcctgtgcatgctcagtttttggttttctggttttttaattggctgttcatatcattcacccatttctgtatgtagtcattacctttttcttgttgatgtgaaggtattctttgaaattctagatattaatctcttgtcagattttgactttgtaaatatcttctcttactctgttagctgcttattaactttgtccatagtgtcatttcctaaacagaaatccttaaattttttacaataacaggctgggcgcggtggctcacgcctgtaatcccagcactttgggaggccgaggtgggtggatcacttgaggtcaggagtttgagaccagcctggccaacatgacaaaaccctgtctctacaaaaaatacaaaaattagccaggtgtggtgacacgcacctgtaatcccagctactcgggaggctgagaggcatgagacttgcttgaacccgggtggtggaggttgcattgagctgagatcgtgctgctgcactacagcttgggcgacagagcaagacttcatcccccaccccccaaaaaatgtaataacagtcatagatatttttccttattgattaatccttttaaaattgtatttaaaatctctttctggttgtaggttgcaaaaatactgacttacatttttctatcaaaattctaaattaagccttgatagagtactctttttaattggatctttcatttagaattttccttgatacatggcattggttagggatacattagggacatatctaaagcattccagttatgcaactttttaattctgtgaccagtgaggaaaggggattcttttccctagatccaatttgaaaaattacagagaaagactctgactcactggattgggttgcatgcccattattatggcccaattagcaagatgccttactaagtgctaggcagacaaaacaatattcactacaggggtgataaggtaaataaacacattaattagaatttaaaggtaagtattcttaaggatttaagaggtgggacaattgcaccctattgggggaaccacataattcttcatgacagaaatgacattttcaatagactgccaagtatgggtaagatttatatgcatacaaaatcctatgtatgatgacttctaaatagaggacaaagcataagtaagaatgcaagggcaagaaattaagagtatgtttacagtataatccaatttgaatgaaccacaggatataggaaggtttagtgtgtgccgactgtgtaaagatatctgtagaagatacagtgatgcttagtcaatggccatgaccccaacccattatcttgctaacagaaccctgatttgggacagcaacgtactgttcttcttcttctttctttttttttttttgagacggagtctcactctgtcgcccaggccatagtgcagtggcgcaatctcaactcactgcaacctctgcctcccaggttcaagcagttctccagcctcagcctcccgagtaactgggactacaggcacacgccaccacgcccagctaattttttgtatttttgttagagacggggttcaccatattggccaggctggtctcgagctcctgaccttgtgatccgcctgcctcggtctcccaaagtgctggggttacaggtgtgagccactgcacctgggcatttttgttttttttgtttttttttgagatggagtcttgctctgttgcgcccaggctggagtgcagtggcaccatctcggctcactgcaaccaccacctcccaggttcaagcaattctcctgccttagcctccctagtagctgggattacaggcatgcgccaccatgcccggctaatttttgcatttttagtagagagagggtttcaccatgttggctgcccagcccaatgtactcttctgtagagcttaaatctggattgatctaagttcattgtagcaatttacttccctttgcctgctactccccttcctatactcccttgaacaaggggcagccacatgactcagctctggccaatagaatgcaagtggaagtcttctgggaacttttttgttcatcctcttctgtttagcactacgacagccatcttccaacgcaataagcagggacaagaaaatttcagaagccaacccataattctgacgtcgttagaaccaggttcagcctctgaacctgtcgtataggcctcagcacttagaacaaccctgtgcttggttcaatgttctatgctgctataagttattaatcatttttaacaaggggccctgttttattattttgcattgggccccacaaattgtatagctactcctgataggaaccacagtgcaaattctggaatctcttatttctaatccttttgttaacagtaaatatccttatggatgaaaacactgttgattgggttttctgttacttatagctaaacacattctgttttgttttgttttgagacagaatcttgctgcttgactcaggctggagtgcagtggtgtgatattggctcactgcaacctccgtctcccgggctcaagcgatcttcctgcctcagcctcccaagtagctgggattataggcacccgccaccacacctggctaatttttgtatttttagtagagacagggtttcaccatgttggccaggctggtcttgaactcctgacctcaggttatctgcctacctcggcctcccaaagtgctgggattacaggcgtgagccaccgcgcctggccccatttccatattcttaaagtgagaataaataacatctactagttagagttgtgggaagattagatgagttataagattatagttattagatgagatataaagcacacaatatctgacatttaatagatgtttctgtaatgttaattgcattctttttcacttccacaccttacaatgaacccacctgataaaaggagagaagcataaaaattccatgcagacaaaagtccttatctgggccaactaccttcagatttcagttgtttaaaaaagccaaataagaaaagaaggaaataaaattttcacttattaagaattaccattttgaggctgggtgcagtggctcatgcctatattcccagcactttgggaggccgaggcaggtggatcatctgaggtcaggagttcgagactagcctggccaacatggtgaaaccccgtctctactaaaaatacaaaaaaacaattagctgggcgtggtggtgggcgcctgtaatcccaactactcgggaggctgaggcaggagaatcgcttaagcccgggaggcggaggaggttgcagtgacccaagatcatgccattgcgctccagcctaggcaacaagagtaaaacttcgtctcaaaaaaaaaaaaaaaaaaaaaaaagaattgtcattttgtatgggcacggtggctcatgcctgtaatctcagcagtttgggaggccaaggcgggtcaatcacttgagtccaggagttcgagatcatcctgggcaacatagtgagaacccatctctgctaaaaatacaaaacaattttagctggctgtggtggcacacacctgtggtcccagctactttggaggctgaagcacaagaatcacttgagcccaggaggcggaggttgcagtgagtggagatcgcgccactgcactccagcctgggcaatagagtgaggccctatctcaaaaataaataaataataaaaaacaaaaaaagaattgccatttggcttaggcattagccaaaatgggctttacgcatattaatttcctactttgttaccaggaatatttttctggagatggaatcatcatttgttttgctgaatctcgttgtgggcagtgctcaccagggcggtctcgcccctgcacctgtggcaagagccagtggcttgactgggggctgcaggatctgttcttcaggatggctcactcgcgtggccagcaaggaggtgctgctcccagcccagaggtaagggggctccggggctgggaggaacatggggctcctctccatgtgggcctctccgcagacgggatttctcagggtgcatgactgagttctaagagtgagcattccgggagaatgtcagaaagctgtattgccttctattttattttattttttgagacagggtttcgcttttgtcgcccaggctggagtgcaatggccagatcttggctcactgcaaactcggcctcctgggttcaagccattctcctgcctcagcctcccaagtagctgggattataagcgctcgccaccatacccggttaatttttgtatttttagtagagacggggtttcaccatgttggccaggctggtctcgaactcctgacctcaagtgatccacccgccttggccttccattgtgctgggattacaggcatgagccactgtgcccacccagcctgcattgccttttatgacctagcctgagaagaaaacatagcctcacctctcactgggagactgttgaagtcatgtgaaagaagaacatgcagaaccagtgctgttgttacagccatttttggaaaatgctgctggccacagaatactgatggtctgggccaggcaatgaagtgtctggcagcctatggtgtgcttcacgtggaacacaggctgaaatgggaaggatctgggtcctgcagggtgcgtgtggcgattcagaggcccttctacaagtggcggtgggtggggcactcagctaggatggaggctggcttgaggaggttgggggcattttcctcaagcaccctatggtggtattagtaactcggccagcttccaaatttagtcataacattgtgtgtctttgaattcccctgcgatcctcaggggataaagtattctttctgtttcctgtccttggctattgtgtgatagcagctgtactactgatccaggcgctgtcactccgcccaccagagaaaggtgcatttaggcatatgacttaatactttcacaggagagttctaaaaaagtaagaataatgctaagattaactgtttactcaaccgagtgctgagggcttcctatgcattatctcatttagttctcaaaaggattctaagaaccggcactagtatcatctctatttcacagttagaaaactgcattttagagatgtgaagtaattggcaaggttagggactctcaaatccaaggctgattgcagtgcctcttagctatactaccttattatggttaaatctataattttattcacttaatgcatatttattagcccctatcaggagtgagcattgttctaagcactaagaatacatttgtgaatgaaggagataaagtctatactgtcacggagcttacaataaaatagcaggtcacaggttatggtgacgttaaatgagatgttcgacaatgactttatgtcgataactgcgtgacaagaaaaagccaatcatggctaaggctgggggaagagcagttctggcggatgttgagataaacttcgtacatttaaattttcaaaagtgtatttcagcagacagtggttcatgaatcagggggcaccagaatccaagaagtccagtgctccactagggaaatgtgcaagagcaaaaccttcataaggtgttctcagaagcaagacaaagacaacatatttgattggttacattggaaagtctctagttaaaggtgagttggaagtttctgatcagtaaagtccctagttagggttggttgctggcttctgggtggttaagctgaagtttcaccctttacatgggctttagtttgcttactgagaaacccatggccctgaagctgtttcagcctgatgttctccaaattcaattattttaacactgggcacagcaaatacaaaggtccagaggtgggaaggagtttcggtaatgggtcaaagggagatttgtacaagatgtagggagggagggcacaggccttataagccagggtaaagatttgggggtttaagtttatgggacccctataaggtggaccatccataaaggaccaagggcactttcgagatttcaagcagggaaatgccctgatctgaatagaaacatcactctggttgttgtacggagaatggattgtagggaaatgtgtggatgcaggggcaccagctaggagctgagagatggtagcttagtgaagttggaaagaaaataacagatatggaaaatgtgttcacagagaatctatagaggatccaaactgttggacttgaccatagtttggataatggtggtaaagaaaggaatcaaggataatacctgggtttttcacttgagtaaccgagtaaatgttggtgttatttactgaagtaggaaagacagaggcaggagcaggtttagaagaaatggagaggtctgattttcttggatttgtttgcttgttctgacacccaggctggagctgcactcgatcatagcaaactgcagcctcaaactcctgggctcaagcaatcctcctacctcagccttctgagtagctgggactataggcacatgccaccacaccctatttttgttgttgttgttgtttgtaaagacagggtcttgctatgttgcccaggctggtcttgaactcttgacctcaagcgatgccccccttcttagcctcccaaagtgttgggattatagatgtgagccaccttacccaaccaaagttctgtttcaaatatgttaatatgttacctgttaggcatccagatgaaaatgtcaacttaatatgtgaatcagaagtcaggacatagagcagagcagagctagaaatatacataaagaagtcattggtacacagatactatctgaagccatgggagtaggtaagagtaaagtataaagagaaggagccccaacactgagtcctgagcactccaacacatagaggcaagacagagaagaaataagcaaagaaaattgaaaaagaggggccgggtgcagtggctcacacctgtaatcccagcactttgggaggcagaggcgggccgatcacctgaggtcaggagtgaccagcctggccaatatggtgaaaccccgtactaaaagtacaaaaattagctgggcgtggtggcaggcgcctgtaatcccagctacttgggaggctgaggcaggagaatcgcttgaacctgggaggcagaggttgcagtgagccgagatagtgccattgcactccagcctgggtgacagagtgagactccatctcaaaaaaaaaaaaaaaaaaaaaaagggccagtgaggtaaagaagaaagccaggaagttacttgttatgggctgaattatgttcctcccaaattcatgtgttgaacccctaatgtccaatacctcagaatgtgaccatatttggaaatagagcatttgaagccataattaagttgaaatgttgaaatgaagcattagggtgggccctaatctaacctgactggtgtccttaaaggaggaggaaattttgtcacaaagagagacactatggctgggcacggtggtggctcatgcctgtattcccagcactttgggaggctgaggtgggtagattacttgttgccaggagttcgagaccagcatggcccacatagcgaaactctgtctttactaaaaatacaaaaaaattagcagggtttggtggcatgcacctgtaatcccagctactcgggaggttggagcagtagactcggttgagcctaggaggcagaggttgcagtaagccaagatcaatccactgcactgcagcctggatgacagagtgagaccctgtatctaaaaaagaaagaaaaaagagagagagagagacactagagggatgtgctcacacagtggaaaagccatgtgagaagccacgtgagaagccatgtgagaaggtggccatctgtaagccaaggagagatgcctcaggagaaaccaaacctgctgacaccttgatcttagactctagcctttagaacaaatttctgttcttaaagccacccagtctgtagtatttagttatggcagccctagcaaactactacagtattttactccagaagcagagagaagaaaatgtttcaagtaagataaatggtctactgtgtaggacattgacaagaggcagggaaaataaagatggagaagtgaccaccagtaaggaacaagattatcttaccaattctaataagagcagtttcctggaagcatgagtagaatcgagagaatgcacaatgaggagttagaggtggccccatctgccacgctttctttcctttttttttttttttgagacggagtcttgctctgtcgcccaggctggagtgcagtggcctgatctcggctcactgcaagctccgctcccaggttcacaccattctcctgcctcagcctcccgagtagctgggactacaggtgcccgccaccacgcctggctaattttttttttttttgtatttttagtagagatagggtttcatcttgttaggcaggatggtctcgatctcctgaccttgtgatccacccgcctcggcctcccaaagtgctgggattacaggcgtgagccactgcacctggcccaaggaagacattttttaagacagatatttgagtatgtttgcatgccttatttatttatttatctatctatttatttattttcctgaggcagggtctggctctgtcacccaggctggagtgcagtggcatgactcagtttcctgcaacttctacctccctggctctagccatcctcccacctcagcctcctgagtagctgggatcacaggcatgtgccaccatgcctaatttttttatacttttcacttttacattttaactctgttggaattttttacactttttatagagatgacgttttgccatgttgcccaggatagtcttgaactcttggcttcaaacaatccttctgccttggtctcccagagtggtgggattacaggtatgagccactgtgcctggctgcctaattcttactagatttaaggagtgtaaatgaaatactgaaacaaaagtagaagagtaatttttttttttgaagaaaagttttcatttatttagttaaaactgtcttatgcttccatgtgaaaagtatgggtggttttcgttttgcatagagtgttctatagcttactgattctcaatctttttagccaaggactcctgtagcagagtaaacagtgttaatacctctcattcattcgttcattcatccttcattaaataaatatttattaatccactcccatgtgaaaggtactgatctaggaactgagaatagagcaagaaacaaaacaagttcccggcttggagcttatattccaggagacagagacatgatagacatgataagcaagtaaacaaatttagagtgtggctggtagaagtaaatgctataaagaaaaatgcaggatatcaaattaatgatttttaattatcccatccataaatatggtatagctttccactgattcctttcaataaggatttataattttctttatgaatactttacatgtctttatattttctatcaggaatttaaaaatttttgttgatactataaatagaatttttataaaattatatattctaactgttggcttctggcatagaggaaggcaactcatttttatgtatggattatgtaccaaataattgtctgaaactttgggggttctatttatcattaaatactcttggatgttctacgtaagcaataaaattatcggcaagtaaaaaaaaaaagaaagaaaagaaaaatgcagcagaactagagtgacgagggcagcggtactctttcaaatggagcgattgcttagggaaggcctctctgatcaggtgacatttgcaaataactgaatgaaatgagtgagaagggcacagtgcaaggggggaagagtgttccagacagagggaacagcatggagcacgtctggagtgtcggaggtacaacatgagtaggaaatggcttgagtcaaaggcaccaggaggcaagcacaggtgagatcaggaaggtttggggttcagacaaggcatttaggcgatgtgactttggttttactctgagaaggaaggccactgaggggttttgagcagaagagtgatgtttatctatgtaagttttaagaggattttgctggctgctatgttgaaaagaaaggtggggggaaagatgttaaacaagaagactaattatgctgggggtggtggcttatgcctgtaatctcagcactttgggaggccgagtcaggcagatcacctgaggtcaggagtttgagaccagccaggccaatgtggcgaaaccctgtccctactaaaaatacaaaaattagccaggtgtggtggtgtgtgcctgtaatcccagctactcaggaggctgaggtaggagaatcacttgaacccaggaagtggaggtggcggtgatctgagatcgtgccactgcgctccatctcaaaacaacaacaacacaaaaaaaacaatcagattcctactgcaaaacctggatgacagacaatagcggctctgctgcccaggctggagtgcagtggcacagtcacagctcactgcagcttcaaccttctgaactcaagagatcctctcacctcagcttcccaaaaagctggaaccacaggcgcatgcactacgcccagctaatttttttatgtttatagaaatgatgtctccttatgttgcccaggctggtctcaaattcctgggctcaagtgttcctcctgcctgggactcccaacgtgctggggctacagatgtggcctacctccccagcctctatgtgctctaagttttcaatattcaatattttggatacacttcttcagaaaatgtattatactcatctttgcctgcccgcctgcctgccttccttccttcctttttgatgttttgtttttagacggagtctcactctcttgcctaggctggagtgcaatggcgccatcttggctcactgcaacctctgcctcctgggttcaagcgattctcctgcctcagcctcccaagtagctaggagtacaggtgcgcaccaccacgcccggctaatttttgtatttttagtagagatggggtttctccatgttggccaggttggtcttgatctcctgacttggtgatccgcccacctcgactcccaaagtgctgggattacaggcgtgagccactgtgcccggccacatctttgctttctttacagaagattggtacatgtaatttaatatttttcttgatgtctcagaatttgcattattaacaagtacgactgctttgtattgttatgtattagagttatgctgtactcagaacctcttgatgcgtacaggttcatctatttgcttctgatcaaattctccctgtggcagaggctaatgttgcccgccaaatctcatctgtcctcctccctgctaatgctgcctaccaaatctgatctgtcctcctccctagtgaacagaatccccagtattagctgccctgataagagactgtatttccctactttccttatatttacatttgaacaggtgactatgttctggccaataagatgtatttggggtttttttatttttgtagttgttgtttgtttgcttggtttttttttcaagacagagtctcactctattgcctaggctggagtgcactgtctcgatctcagaacactgcaacctccgccttccaggttcaagtgatttttcatgcctcagcctcctaagtagctgggattacacatatgcaccaccacacctggctaatttttgtatttttagtagagacagggtttcgcctgttggccaggctgatctcgaactgctgacctcatgatcctcccgccttggcctcccaaagtgctgggattacaggcatgaaccactgtgcctggctgtttgttttttgagtcaggatctccctctgtcacccaggctggagtgcagtggcacgatcatggctcactgcagcctcaacctcctgggctcaagccatcctcccaactcagcctctggacgggcatgtgccaccacaactggttaatttttaaaaattttttagtagagttgaggtcttgttatgttgtccagactggtcttgaactcctggcctcaagagatcctcccactccagcctccctaagtgctgggattacatgcgtgagccaccgcgatgggcccaatatgtaaataggggtgttgtatggaacttctggaaatcaccttaatatgttgtgctcccctttacttgacttccttattcctggatataataatggaatattcatggccatcttggaccctgaggtgacctcgagactagaaaccatgaactgaggatggtcaagcagaaagatgggagcctgggctcctgataatacaaaagtctgccatgccacctccatttttttatatgagaaaagataacttgtttaagccgttactccattctaatgctcatggttttctgtttgttttcgccttctattggcttttttttttccattcctgacttacagtcagtgcacttgcttacatcaactttttcccttttttcctaatttgctgtcagtcattcttgatttaatgattatggagcacttacaatcggctaagtgctagagatgctattgtaagcaaaacagacacggatctgtcctaggagctcaaataatattgaggagtttactgtctactgaggaaacagaagaccaagtatgttagacattaataaaaataaatagcctttaaataaggccggcgaggctctcctttgaacgcgtagatattataacatctattttactgttgcgtcacaaggtaaaaaaaaaaatctattttggctacacttccttatttttccctgtgctgtagttaaatatgatggcatacaactgagttctgtgtgggtggaatgtgttcacttcctgcttggtgcaaattataaatgaagtatctatttaattttaaaatgttttattgtgaaatataatacacataaagaaatgtggtctggacacagtggctcatgcctataatcccagcactttggaaggccgaggtgggcagatcatttaaggtagggagttccagaccagcctggccaacatggtgaaaccccgtttctactgaaaatataaaaattagctgggcatggtggcgcctgcctgtagtcacagctatttgggaggctgaggtgggaggatcgcttgagcccaggagacggaggttgtagtgagctgagattgtaccactgcactcatccagcctgggtgacagagcaagaccttgtctcaaaaaaaaaaaaaaagttcacaaaacatataagtacaatttaacaaataggtgtgaaattactgcccacgtaaccatcacctagctcactaggtggctagtgggtaccccttcccaattctcaagaagcaccatcctggattttacggttattgtgttcttcattttctttagcattttatcacctatatgcacatccctgcctatgtcatttagttttacctgtttttgaacttttgtgggtgtgtgacagggtctctgtcacccaggccgaagttcagtggcgcgaccaaagttcactgaagcctcgacttccctggctccaacgatcctccctcctcaacctcttgagtagctgtgactacagatgcaggccaccatgctcagctaattaaaaaaactttttgtggctgggtgtggtggtacacgtctgtagtcccagctatttgagaggctggggtgggaggatcacctgagcccaggagggggaggttgcagtgagccgagatcgcacctctgctctccagcctgggctcaagctgtcctcccacctcggcctcccaaagtgctgggattactggtgtgagccactgtgtctggcctatttttgagctttatattcatggaattatgccctatgtactattttatgcctttcccatttcattccatgacattaagtttgtaagattcatccctatgagtgttagcagtgaaaatgacaaagaaactcccacaattctttcctccataaaagcaagtacaaaactgacaaaaattgatagtattaagtttatcagaactctggaaattaaccaaaggcttgcttgcagcaatctgggaggcatttatcaagacaaatggttgaatcttagtaaaaacaaagaggtttgtggcattttaactatcctatttccatccccctttctccagctccctggcagccttggaagccaacagtccacaatcctggtgaccccaggaacctggcagccactagataaggcagaatggggttagagcaccttcaaagcttcattctcatggtactgtagttatttgtctgtctggtgcttcccgggaagaccccacttgcaaggctgcctttatttaacctaaccaggatcttatccagggctaaaaaaataaaaacccttttctccagaggcatttattgaaaatatttcaagacaattgtttgacttcattcctgcctgagtagtgggtgatattagggcaaacaaaaggctaacctaaagctcaaaaggaaaagccagagaatggtacgtccctaggagctttgaaaagcttcaactcattgtgggaatccacaaagcagcatatgcatagggctgtgtgcatgcccagcaaagatctgagaaggccctgaacctgcccttccccataagaatgtgagctcaataaggcaaggagcttgtctactatatccccaggatcgtgaactatgcttcacacatagtagaaattcaataaatatttgttgaataaataaagaattggtgagtatacacacacacacacagagtcagctctccgtatccgtggtttctgcatcaatggattcaaccaactggagataaaaaatatttggacaagaaaatggatggctgcatctgtactgaacatgtatagactgttttttcttggcattattccctaaacaatacagtataacaatatacgtagcatttactttgtattagatattacaataatctagaggtgatttaaagtatacaggaggatgtacgtagtttatatgcaaatactatgccatttcatatcagcaactgtatctgcagattttggttttgaaagggggtgctggaaccaatccaccacagatactgaggaacaactacatatatttgcatcccaggaacaccagtcaaagaattatttaacattctcacaatgagaactgattcataccaaaagtataatagtcaataattttatttagatgagactttggtggggctgcactaattgtattatatttgtcatataaattatatgaaatagacattttacttattttattatatatataatcacaatttattacatttgaccatagttgttctcattacaagaattttaagctgggcatggtggctcaagcctgtaattccaacaccttgggaggctgaggcaggaggatcacttgagcccagaagtttgagaccagcctgggcaacacagggagcccctgtctctacaaaaataaaatttaaaaattagccgggcatgctgtcatgctcctgtagtcccagctacttgggaggctgaggtgggaggatatcttgagcccaggagttgaggctacagtgagctatgatcacaccactgcactccagcctgggtgacagagcaagaccctgactcttaaaaaaaaaaaaagattttagtatgtgtatacgatattaagagtgaagtacaaaatctgggaaaagtaaaatgaagaaactatgtaaagaggtttatcagacagcattccatatatactggtgataacttaattcaggaattcttgcttctgttctgttgacagactttgcgtcagtgtgaagtgagacacattgtcttcatatatcccactccatttctggtgatataatttagggctgggcgcggtgactcatgcctataatcccagcactttgggaggcggaggtggtggatcacctgaggtcaggagttcgagaccagcctgtccaacatgcgaaaccctgtctctactaaaaatacaaaaattagccgggtgtggtggcaggtgcctgtgatcccagctacctgggtggggcaggggggtgctgaggcaggagaatcacctgaacccaggaggtgaaggctgcagtaagttgagatggcactactgcactccagcctgggcaacagaacaagacatcatctcaaaaaaaaaaaaaaaaaaaaaaagtcataatttagtcctactcacattccttttgggattgttttattatctcattttgctgattagggtggttactggatatttatgtagcacaatcttaggcagtcaagaagctatccatagtttaaaataaaaaacaaaatactaataaccaaaaataagggaacatttatttttaccaaaagacttcctaagattcttttttcagtttgaaagtttggcctattaggaatggtgtttggcaaagataattagctcttaggttaaaatgacaactgcaaagaacagtaagaaattaggacagtgaaacattgatttagaaaggcagttgggagagggcatttgggaggaggtggttacaaatggttgttcagaatggcatttgggagtaagtaggcggtccatgagacaaggaggtatctgaagaaagtgaaccaacaaccgagctattttgggtagggtatcacagcaaagggaatgttctattaattactcttctcatcaataaccaaagccaggtacatcccttgctgagactttgaaccaaatacatatattttgaaccaaatatatacgtagagagagagagacaggaaataaatcgatacttgattgtgttatatagtagctgtttctaagagtcaaaatgtatgtatatagaagtggatttatgtgcatatgtcaccatttttttccatggaattttatcattgcatatgcaaagataaaatatagataatctatatgcaaaatatagattttgaactctgagcagcaagctcctttggttggagaagaaaaggaacctatatgtctttacttccattggggcctaatatttcccttggggtgactatgatgcaaccaatatgtacgttcctttaatcaaccttttgttttgtttcatattattataggatactgaaaacattgtggggaagggcatggtatttttttttttaaagacatagtcattgagccagaaaagactgccttttcctctagtgtgagaattatataactaagatataaagataagctaatatataggacttagaatcgtgaactggggaggcaggtattgcacttaacggaggaaaataagcagcagtgtgcagagcggggttagtaagttcacctttggttacaggcagccatggtcagatcacagccaaaaaggtgaataaacctgagaaagcctttggtcaagatttccgttttttaaatactttaaaaaattaattatttattcaaaactactattattggttgtaaataaatatggaaagataataaattttgctagtcttttctataaaatttgtgaaaaagtttaaaagtacaatgcctaacaagaacgtataactcgtatgatactctccacataattgctttgtttttgaaagctatttggaattttttttttttgagacggagtctcgctgtcgcccaggctggagtgcagtggcgcgatctcggctcactgcaggctccgccccccggggttcacgccattctcctgcctcagcctcccgagtagctgggactacaggcacccgctgccttggctggctaattttttgtatttttagtagagacggggtttcaccgtgttagccaggatggtctcgatctcctgacctcgtgatccgcccgcctcggcctcccaaagtacctttaccttttgatttaataatctcattttgggagtaggtagaggggaattaatcacaaaatatgggaggaataagcacaaatcttgaggcaacgctaacatgcaatattgcttgtttatgtatacattcaggaaatgctcttcaagtgcctattacgttccaagcactaggggtgaaacaggtaatacaagaaagtcttctctcatggaacttacatttcagtgggggagactgaagataagcaagcatagtacacacacacatatatatataaatacacatatagtatatcaggtggagaaaaataaaacaggatatggggacagaaagtgcatgagaaaatggctgtttcacataggggcaccagggaaggctcaggcatggtgacatgtgagacctgaaggaagtaaggaagcaagccttgaggcaacctggcagaaaactgtgcccattagaagggtcgctcttaggccaggcgtggtggctcacgcctgtaatcccagcactttgggaggccgaggagggcggatcacgaggtcaggagatcgagaccatcctggctaacacggtgaaaccccgtctctactaaatatacaaaaaattagccgggcgtggtggcggacgcctgtagtcccagctactcggtaggctgaggcaggagaatggcgtgaacccaggaggccgaggttgcagtgagctgagatagcaccactgcactccagcctgggcgacagagcgagactccgtctcaaaaaaaaaaaaaaaaaaaaaaagggccgctcttgaggtgggggcacacctggcatggttgggggaacagtagggaaattggggcaactggagcagaatgagctaggagactagcagatgaggtcaaagagtcaatgagggggcaaattttgtaggacattataggccatcctaagaatttggattttactccgagtgagactggaagtcattggagaattttgtgcaagaaagtgacagaatataacctagcttttaaatcatggggggaaaggggaagaaaacacaaaaaccagttaggaaacttttcttttctttttttgagacggagtctcgctctgtcgcccaggctggagtgcagtggcgcgatctcggctcactgcaagctccccctcccgggttgacaccattctcctgcctcagcctcccaagtagctgggactacaggcgcccgccaccacacccggctaagtttttgtatttttagtagagacggggtttcatcatgttagccaggatggtctcgatctcctgacctcgtgatccaccctcctgggcctcccaaagtgctgggattacaggtgtgagccaccacacctggccagaaattttaaataatacaggcaagaaatgttggtggattgggtcagtgtagtaatgatacagatgatgaaagtggttgaattctggacataatctaaaggtagatctgacaggatttttttttttttaaacacagtctggctctgttgcgcaggctggagtgcagtggtgtgatcttggctcactgcaatctccaactccctggctcaagagatcctcctgccccagcctcccgagtagctgggactacaggcatgtgccaccatgcccagctaaattttgtattttttgtagagacaggggtctcaccatattgtgcagactggtctcaaactcctgggctcaagtgatctgcccgcctcggcctcccaaaatgttcggattacaggcatgagccaccacgcccagtccttcttttttttttttttttttttttaagaaatgtgctctcactgatgcccaggctggagtgcagtggtgtgatcatagctatctgtagcctcaactcctgggctcaactgatcctcagcctcagcttctcgagtaaccggggaccacaggcacgtaccaccacacctggcttatttatttattttgtgagatggattcttgccatattgcccaggctgtcaacaggatttattaataaactgaatgtgaagcatgagagagaggaaattaaggaggactctaatatttggtctcagtaaccggacaaatagagctgccacctactgagacggggaagatgtgggaagagcaggtttgggagtagaaatcagaagtttatttttgaacacataagacttccaatgcctgttagacagcagtagcagcaaattggtgcctcagccatattccttgcctgtgccacatcagtgtgctatggacagcctgatctccaactgccagcacctccatttcttggcctgaggactttctcaaatgaagacagtcatgaaaaacaagacaaaagaacccataaaaggcaggtttttttcttctctagtaagagggaggctcctgaagagaaactctccgcccttccttgttcccagctttctgccttgaatgcctttgagaatgtgatgattggtggtgtggcaaacaacaggggaggtccgagggaactgaagagtggccaactcagacccctggagctgtagaaaggaacctgttttagcagctgcctacctctgcagtgcctgctctgtgagagaaatgcaggcttctcactgaggccactgtaaatcagtattctcctccttgcagccgaaagcattcctaactgattcactgctcaataagaatagtaactaacctcatcaaatacttactacatactaagtaagtgatgacctgtgatactctaagtgtcttacatgtattttctcatttaatacttataataactttacaaatgagttactattattatctccgcattagataagaaaagtgaggcatggagagtttacatcataatatgaacctaggcagtcttcctccgcagtcctgaccctaactactctgctatgctgccttccaacacctgtggttacagtagtcccctgccttatatgcagtttcagtcacccacagacaaccatggaccaaagataggtgagtacagtaacacattttgagagggagaaaccacattcatgtagctcttattatagtatattgttacaactgttctattacattattagttgttgttcatctcttactccgcctaatttagaaattaaacatcataggtatgtatgtataggaaaaacataatatgtatatagggtttggtactatccatggtttcaatcatccactgggaggggggtcctggaactactgtagatagttccaagtgggggataaagatgagaggggactactgtaaagaacttaacataaaactacaactgtaaaccttcatgtggcaaattcttgttcaactacacaatacaaacatttatcaggtatcaaaaacttcaaatgcagaaggtaagacaatattgtatatggctaaacaatgaccaaaaaccactctcatattcctctctccaaatttgaatttaaaatgctttaagagatatttaaagcaagtttagttattgtccaattatgcaaataaaacaggtaataaaggaggatccaaaactattccttcacctatacatcccaaaccagaagtaaccagaagtggatgatatccagtggaatttgggcataagagaaagctacataggaaataatgttgacctcatttctcccattagctcctgatacatcctcctgctcccatttatagcagaaattctctgaataattgctagcactcacaaactatctttccactcattccattctctcttgaaacaatcaaagtttcaactcaaccacccccagtaaactgctcttgtcaaggtccccaattatgtctacatcactaaagccaatgtcaattcttagttatcattatcatcttattggcttatcagcagaatatgatatagttctgagtctctgttgctggttctttctctcactggtctctaaacattgaaagtttcagtgcttggacttttaatccacattcatacctctggcgttctcatcctggctcacagctttgcaatgttgtagtggattaaagacagccccagggctgggcgcagtggcttacgtctgtaatcccagcactttgggaggctgaggcaggtgaatcacaaggtcaggagttcgagaccagcctggcccatatggtgaaaccccgtctccactaaaaatacaaaaaaattagccgggtgtggtggcgcatgcctgtaatcccagctacttgggaggccaaagcaggagaattgcttgaattcgggaggcagaggttgcagtgagccgagatcttgccactgcactccagcctgggcgacagagcaagactccttctcaaaaaaaaagccccaaactctttgacatacttcccagtgagaagtgagggtctgtgtttcctcttggaaggctctgtgactgctttgaccaatggcaggaatgaaattgtaccatttctgggtcttaagaaactagcagcttctacttcctgtctcttggtagctccgagcagccatttaagaagccatgctgaagaggccatttgtaggtactatggtcagcagtcccagctgagcccaggcttccagtcatccctgccaaggtgccagatatgagcgtgaatgaatacttggatactccagatgagttcgtctggtagctgaataccatggagtgacctcaggtgatgccatggggaacagaagagttgcccagatgagacaggctctaattcccaatccacaaaattgtaagctacgataaaatagagttgttttcagccactaaattttagggtaatctgtcttcctgcagtagacaaacagaacaaatgacatctttttgatgatgacttgcaaattgcatgagcctctcctctgaattccagattcatatctaactgcattatctgacatgtctactcgcagattgtcttatctggggttcttccagtagtcaactctgagacaagggttcaagtacaagcagtttatttgggaggcgatcccaggaaacattgttagccgtggcgagtctgagttggctccacagtcctcgatccttgtcttcttgggagaatgaatttggctgagacagaagtagatttaaggcagaaacaagaattcactgaagcaaataaaagcacacatgtaaggaaccaagcaggcaactcaaaaattcagtactctgcctgattgctggctcaggactcgcagatttgctattttctgacttttcccgtctcttcctcttgtccctcccccttggcaggctgttggctaattgctgcatgtgcaatgtcttgctagtatctgggaggggcacatgtgccatactgaagttacgtgcatgctctcttagggcaattttcccttattggtctagtgcccccagaggaaggtcacatatgggtcaaacgctgccattttgcaccttaccatgcttgcctggccatgtcccctgaggaaggtcaaactccaccatttcaagttcttaccaagaagttgttgcccacaagcccaagatgtctcctgtttattaggaaaatttcccctcccctttgaccagctgcctgacatttgcctggcagtcacctgatagttgtctgacattctttgggaccctatcctgccctgctcctatctgcctatctacccactctaacaacaccagtaggtaacggggaagtgagacagggaaagaaagcagacaatagcgtgtgttatcaagccagtcaccactgaacactgctttgggaatgttggggagctcagggaactagtgtaaccatatatttcagagttatctcactcagagggtgagggagctggaatatttatacactgacttttatcagtcactaattgagggttgccccctgggagggtattaattctctgccttagacatgggtttaagcccttgagcaaagaaatgcaaaacctatgagtgggacatcagctgtgaatgggacattgaaatgatcaagttgagtgaatatgggcagaacactgacaacatttgctacaatgacagtgacattgacactgattgatatttttaatgattccaggccagttgtcttatagaatgtcccacagactggctactgagatacagttttccatggtctcatgtttcttcaatccctttgagtagaggcaccaactgtcctttcgttctggactatctttccaaagacatttagataatgccaccatgcccggctaatttttcttttttttttgtatttttagtagacacagggtttcaccatgttggtcaggctggtctcgaactcctgacctcgtgatctgcccgccttggcctcccacagtgctgggattacaggcgtgagccaccacgcccggccgtttgtagttcttaaactacatacaattaaggatgtgcagtcagaatactatgttcaaatgtaacttgaattaaaattttttcagtgtggctatagtgtcaattttatataactaggttcatttgcttcatcatttttgaattaagttcttaaaaatatataaactggccgggtgaggtggctcaggcccgtaatcctagcattttgggagtccaaggtggacagattgcctgagctcaggagtttgagaccagtctgggcaacacagtgaaaccccgtctccactaaaatacaaaagaaattagctgggcatggcggcgtgcacctgtagtcccagctactcgggaggctgaggcaggagaattactggaacccaggaggcggtggtgcacacctgtaatccaaactactcgggaggctgaggcaggagaattgcttgaacccaggaggcagaggttgcagtgagctgagattgcaccactgcactccagcctgggtgacagagactccgtctcttaaaaaaaaagtagatgataggtagatagatagatagatagatagatagacagacagacagatagatatagatataagccatgtatatgattcaaaatgtaaaactttaaaaaaaaaggtgtgctcagggaaatctcattaccattcccatcaattccacccacccccacaggtaattgttatgaactgaaattgtgctcaccccaaatttatagattttagccctaacccccaatgtgcctgtatttggagaagggcctttaaagaggtaagtaaggttaaatgatgcggccaggcatggtggctcacgcctgtaatcctagcactgtgggaggccgaggtgggtggactgtctgagcttaggagttcaagaacaaccagggcaacaaggcgaaaccccgtctctactaaacatacaaagatttagcatggcgtggtgatacacgcctctaatcccagctacttgggaggctgaggcataagaatcgcttgaacctgggaggtggaggttgcagtgagccaaaatcatgccactgcactccagcctgggcaacagtgagactctgtctcacgaaaagaaaaaaaaaaggttaattgaggacgtaagaatggggctcttaacagataagactagtgtccttgtcagaagagacaccagaccacatgtgccgtctctctctctctctctgtgcgtgtgtgtgtgtgtgtgcatacacagagaatatgccatgtgaggacacagtgagaagatggctgtctgcaatcaggaagagaggcctcacaataaaccaaatttccagcaccttgatcttggacttctagcctctaaagctgtgagaaaataaatttctgttatttaagccacccactttgcagtattttattatggcagctcttggccgggtgcggtggctcctgcctgtaatcccagcactttgggaggctgaggcaggcggatcacgaggtcagcagatcgagaccatcctggctaacacggtgaaaccccatctctactaaaaatacaaaaaattagccaggcgtggtggcaggcacctgtagtcccagctactcgggaggccgaggcaggagaatggcatgaacctgggaggcagagcttgcaatgggccgagatcgtgccgatgaaaccccgtctctattaaaaatacgaaaatttgctgggcgtggtggtgggcacctgtaatcccatctactcgggaggctaaggccaggaaaattgcttgaacctgcgaggcggaggttgcagtgagctgagattgtgccactgcactccagcctgggcgacagagtgagactccatcttggccagcggggggtggaaggggagggaagagagttatttatataggctagaaaaaaaaatatcggatatgtgatttgcaaaatgtctcctattgtgttgtctttcctttttttttttttttgagacgaagtctcactcttgtcccccaggctggagtacaatggtgcgatcttggcccactgcaacctctgcctcccgggttcaagctattctcctgcctcagcctcccgagtagctgggattacaggtgcctgccaccatgcccggctaatttttgtatttttagtagagacgaggttgcaccatgttggccaggctggtctcgaactcctgacctcaagtgatccgcctgtctcagcctcccaaagtgctgggattacaggcatgagccactgcacccagcctctttctttcttttttttttttttctgagacagagtcttgctctgttgcccaggctggagtgcagtgccacgatctcagctcactgcaaccgccgcctcctgggttcaggcctcctgcctcagcctcttgagtagctaggattacaggcatgcaccaccatgccaccgcgcctgggtgccttttcactttcttgacagtgtctgtattacttggctagggctgccataacaaaataccacagactgggtatgacctcactggggattaggacttcaacatgagttttgggggaatacaattcaatccataatattctgtcctctggacccccaaagttcatgtccttctcacatataaaatgcatttatcctgatcccaacagccgcaaaagtcttacctcatttcagcatcaactctaagtccaaaggctcatttaaatatcatctaaatcatagccaggtgtggtagctcacacctgtaatctcagcattttgggaggctgaggtgggcagatagcttgaggtcagcagttcaagaccagcctgggcaacatggtgaaacccccgtctctaccaaaaaaaaaaaaaaattagccagatgtgggggcaagtggctgtagtcccagctacttgggaagctgaggtgggaggatcacttgagccagggaggcggaggttctagtgagccaagattgtgccactgcactccagcctgggtgacagagtgcaaccctatctcaaaacaacaacaaccacaaccaccaccacaacaataataaaaacccaaaataaatattatccaaatcaggtgtgggtgatacttgagatatgagtcattctgcggcaaagttcctttctgactgtgaatgtatgaaaccaggccagttatgtacttcctgagtataatagtgggacaagcatagaacagacattcccattccaaaggcaaaaaatggaaagaagacagggacatggggacatgggtcccaagcaaattcaaaacctagtaagactttagccaggcgtggtggtgcgcgcctgtaatcccagctactcaggaggctgaggcaggataatcgctcgagcccaggaggtgaaggttgaagtgagctgaaactgagccactgcactctagcctgggcgacagaatgagtgagactctgtctcaataaataaataaataaaataaaataaaataaaataaaataaaataaaacctagcaaggcaaattctgttgaactttaaggctgaagaataattgtctttggcttgacgctctgccctcctggcccagtggattagcaggcttgccttctagggccacgggggaggcagcatcaccacgttggccctattggtcctgggtagcagccatgcctctgaggcactggatggcagcagcttgactttctggaactgaggagacatcttagctccccagacctgtatcttctgggcctgcagttcgaatggcagccttgttgctaactgaatctcctttgggatcagtcttcccttttcttaaagggtaacatgtgttcacagccagataactctgttgcctcatcctttaggatcccagaattacgacagccttctttccttctgtcctgtgtcccctttagtccaagatgacagtgtttatgctggtataatctcatctctcttcctggcttgcgctgagaaagctgaataaatttgtaaattgcacctataatctctatgaaatactgagaatttttcaaatcttcaagttttgtttttgcttaataattccctcagtttatctttcttcccacattttactaaagcaaccaaaagaagctaggccataccttcaacagtttggttagaaatctcctcagctaaataaccaaatttatcactttgaacctgcactttccacaaaacactagaacaccatttggccaaattctttgtggaagaaaggatggcctttcccgcactttccgataatatgttcctaatttccgtctgagacctccccagaatcacctttattccttactcctaccaacaatctcttcaagacaatctagacttttttttttttttttttttggcgggggggacagggtcttgttctgtcacataggctggagcgcagtggtgggatcacggctcattgcagcctcgacctcccaggctcaagtgatcttcccacctcagccccacacccccgcccgcccctgccctgagtagctaggactacaggtgcgcaccacgatgcctgctaatttttgttctgttttgagacagagtctcactccgtcaagcaggctggagtgcagtagcatgatcttggctcactgcaacctccacctcccgggttcaagcgattctcttgcctcagcctccccagtagttggggttacaggcgtgtgccaccaggcctggctaatttttgtatttttagtgaagacaaggtttcaccacgttggccaggctggtctcgaactcttgatctcaagtgatccgcccgcctcagcctcccgaagtgctgagattacaggtgtgagcagctgcacacggctcaatcaggctttttccagcacgcacctcaaaactcgttcactctctacccattatccagttcctgagttacttccacatttataaagtatttattacagcagcactccacttcttggcataaaagtctacattattctgctagggataccataataaaataatacagtttgggtggtttaagcaacagaaatttatttgccataattttggaatctggaagtccaagatcaaggtgtcagcaggttgttttttcctgaagatttttttttttttttttttttttttgagacggagcatcccttgttgcccagactggagagcaatggcgtgatctcagctcactgcaacctctgcctcccagattcaagtgatgattctcctgccccagcctctcaagtagctaggattacaggtgcccgccaccatgcccagctaatttttgtatttttagtagagacagggtttctccatgttggccaggctggtctccaactcctgacctcaggtggtccacctgccttggcctcccaaagtgctgggattacaggcatgagccaccgcacgcggccggctgcatcttcttggatctgcacaggaccttttctctgatgtttgtcactggtatctcttcctcttcttataaggacaccagtcctactgggttagataccattcttatgacttatttaaccttcattatctcttcagggcctcatctccaaatatagtcacactgggagttagggcttcaacatatgaattttggaggaatatacttcagtctttaacagtgtaatggatgcacataagttttaaaatatttatttattgtggtaaaatgtaagtaacataacactttactattttaactatttttcagtgtatagttctgtggcattaagtacattcacaatgatctgcagacatcacccttatcttctccagaaatgtttcttcttcccaaacggaaactctatacccattaaacactccctcttccccctccctctgtcctctggcagccaccattacgctttctgtctctatgaatttttttctttttgagacagagtttcgcccttttgcccaggctggagtgaagtcatgcaatctcggctcactgcaacctccgcctcccgggttcaagcgattttcctgcctcatcctcccgaatagctgggattctaggtgcctgccaccacacccagctaatttttttgtattgttagtagagatgggatttcgccatattggccaggttggtctcgaactcctgacctcaggtgatccacctgcctcaggctcccaaagtgctaggattatatgcatgtgagccaccgtgcctggccctgtctctataaatttgactactttaggtacctcatatgaatgtaatcatataagatctatacttttatgattggcttattttacttagtgtaaggtctttaaggttcatccacagtgtagcatatgtcagaatttccttcctttttaaggctgaataatacaaaagacttttttttttttttgagatggagtcttgctctgtcgcccaggctggagtgcagtggcgtgatctcggctcactgcaagctccgcctcccggcttcacgccattctcctgcctcagcctcccaagtagctaggactacaggcgcccgccaccatgcccggctaattttttgtattcttcagtagagatggagtttcaccgtgttagccaggatggtctcaatctcctgaccttgtgatctgcccgcctcagtctcccaaagtgctgggattataggcgtgagccaccgcgcctgtccacaccaggctaattttttgtatttttagtacagacagggtttcacagtattagccaggatggtctcgatctcctgaccttgtgatccgcctgcctcggccccccaaagtgctgggattacaggcgtgagccaccatgcctggccaatacaaaagttttatattttgatgaagtccaattaattttatttttttggagacaggatattggtctgtcacctaggctaaagtacagtggcacaatcatggttcaccacagccttgatctcctgggttcgaggaatccttctgtctcagcctcacaagtagctgggactatgggtgcatgccaacacacccagctaatctttcaaattttttgcagacatgggggtctctttatgttgcccaggctggtcttgaactccttggctcaagtgaccctcctgccttggccccaccaaagtgctgagattacaggcataaagccactgcacctggtctcaatttttttcttttgttacttgtcctttggtctcacagctaagaaactattgcctaatccaaagccatgaagatttatacctatattttcttctatgagtattttagcttaagctttacacttaggtctttgattcattttgaactaattttcatatatgtgaggtatgggttcaacttcattcttttgcatgtgatattcaattgttcaagcaccactttttttaaaaaacatttatttatttatttattttgagacggagtcttgctcattgcaacctccggctcccaggttcaagcgattctcctgcctcagcctcccgagtagttgggattacaggcgcccaccaccacgcccaactaatttttgtaatttttgtattttagtattccaccatcttgcgcaggctggtctcgaactcctaacctggtgatccacccgccttggcctcccaaagtgctggattataggtatgagctaacgcacctggcctttttttttttttgagacagagtttcactcttgttgcccaggatggagtgcaatggcgcaatctcagctcactgcaacctctgcctcccaggttcaagtgattctcctgcctcagcctcctgagtagctggaattacaggcatgtgccaccatgtctggctaattttgtatttttagtagagatggggtttttccatgttggtcaggctggtcttgaactcccgacctcaggtgatccacctgcctcggcctcccaaagtgctgggattacaggtgtgagccgccgcacctggccttgtttttaaaatagagacagggtctcgttatgttgcccaggttggctttgaactcctgggctgaagcaatccttctgcctcagtttcccaaagtgctgggattacaggagtgaactaccacatccagcctgcttttgtttttatttttgagacagggtctcaccctgttgcccaggctggagagtggtaccattatagtgcactgcagccttgaactcctgggctcaagggatcctcctgccttagcctcccaagtagctaagaactgcaggtgtgtgccaccattcccggctaatttttaaaatttttttgtagagacagggtctcgctgtgttgtctggggtggtctctgactcctgtcctcaagcgatcttcttgtctcagcctccagaagtgctgggattacagatgtgacctactgagcctaaactgttttaacgatagcaagactatgcttcattaataggttgggtgtaaaagttgaaacccctaaaagcagcatcttctaagctttttttttttttttttatcatagtaactgattattctgtttaattctctcttttccgggcgttttctctcccagaactcctacccttctgttccaatctaactaagttcctgggacttccctttactgttttcctgaattggatctagtgattactggatgttgtcagataccctgatttctccctcattttgcttgagcacacatttaagtaactcttttttaaaatttatttttattttttgagatggagttttgctcactgcccaggctggagcgcaatggcacaatctcggctgactgcaacctctgcctcccggattcaagcaattctcctgcctcggcctcctgagtagttgggattacaggtgcccgccatcatgcctggctaatttttgtatttttagtagagacgaggtttcaccatgttggccaggctggtctcaaactcctgacatcgtgatccacccgcctcagcctctcaaagtgctgggattacaggtgtgagccaccgtgcccagcccgccagtttgatttttgtccttttatgggctcctttttttcctctttggaaacttagaatcttctttatatttagagttcaaacatttcacatggttgaattttttttttcttttggttctgcactagtggattctttcagttctaggaaattgtcttgcattattttttcaataattttctgtccttcattaactttgttttctctttttcacataatattagtcctgttgaactaattctttatcttattttctctcacaatttccacccctttgtatatttattgttttcttttttttttttttcctgagacaggatctggctctgttgcccaggctggagtgcagtggtgttatttcagttcactgcaacctctgcctcctgggcttaagctatcctcccacctcagccacctgagtagctgggattacaggcatatgccaccatacttgacttatttttgtatttttttgtagaaaaagggttttgccatgttgcccaggctggtcttaaactcctgggctcaaacgatctgcctgccttggcctcctaaagtgttgggattataggcgcaagccactgcacccggccctattttcttttttcttttttgaaataaggtctcttgctctgtcacccagactggggtgcagcttcctaaagtgttgggattacaggcgcgagccactgcacccagccctattttcttttcttttttgaagtaaggtatcttgctctgtcacccaggctggggtgcagcaccaccatcctggctcactgctccgttgacctcccaggatgaggtaatacttacacctcagcctcctgaatagctaggaacacaggtgcgcatcaccatacctggctaagttttaaaacatttttaaagagatggggtctcattatgttgcccaggcttcttctattttctttaaaagttcagtgactttatctttcaatattttaattgaatttataatttggcaatttattttaaatttcaagatctatttttaaaccttggattgttacttcatctgagtatcctagtatactaattaggttttcctttctaaattctctgaagtttctgtttatctgcccccacagtccatgttggagacttttcttaaatacctaataacacttagttgtctgttcatacgtatgaggcagttggaatgctgatggggagtcttgtgaacttgggaggtgtcttagtctattttatgttgctataaaggcatgcctgcagctgggtaatttataaagaaaacgggtttgtttagctcacaattctgcaggctgtacaggaagcaaggcactagcatctgctcagttctggtgagggtttttgtgctgcatcaagacatggcggagaaggtcaaggaaaagtgtctgtgcacatgcaaagagaaatcaaacccgaggtgagtcctggctttacaacaaaccactctccaaggaacaaatccattctcctgataaccaacatagtttcgcaagtgtgagaactcactactgtaagaatgacaccacgtccttcatgaagaatctgcccccatgacccaaacacctcccatcaggacccacctcccaatactatcacactgggaatcaaatttcaacatgagatttggtagagacaaaaaaaccatatccaaaccatagcaggaagttcctgccaacttgcccaactacactttaaagtgggtgggtaggaaaccagctattgtgctagaataaagaatactttactcttaggcccttcaatactcagttaacccaaatctccccagattatcagagtgcttaattttagcctggataaatgcctagatattgtatctgagatatagggagggttctgctcttccttatatagacctttatttagtctccctggtctcaactctgcttctcactcttgctctgtctggtagttatctccaaatctccgtctccctaaagcacttctgggctgacaggtccccttcctttctacagcaccctctacacccattctacattatgcttttctccattttattttgtcagaccacacttactttttgcatgtcaaataaaaaaaaattatcttccgatgtcccccttctcattttctattttgtatcacttttatttatcatcattttatggggtctcaggaagaagagacagtaaatacatgtgctcggttagctagctttaatcaaaaatcctaaacgtaggttttaaaaaagataactggagcagggcaggaaataatattttttgccagtgtggtggcaaaaaataaaaaacaaaaatctgaatctgtgttaggacagtatttccgtgtataacatagcgcttagcaacttaattctccagatccacatattttaaggacatgatgtatctcagacacctacttcaaacctcactttacagttaagtaagaccacaagtagaatgaattgcctgaggccacacaagtagacagtgggagaatgagaacagaaatatctattgactcctagttgaattttctcttaccttaccacactgctagggagtaacaagatgggcagatcacgagtcagatgagaaaggtcatgaaaaatagtcaaaggatgacttttcctgggtaaatagccggatgtccaagaaatgaaaggctggtctggcagcagcacatcgtctaacagttggtagtcatatgtgggaagtactgaagggggagatgacagcaggcccagaaactgcaatgatccaagtgcatgtcgatcctgggagggaacagttaagagtccgggcaggatgaaacagtagaaactggtgagtgaatgaatgtgaaggctgaggagcgactgcaatttgttaatgggattatgaggcagtataaagtggttaattacggtggcggaggtaagcaggagtaaaatgatggcttttaactcctctcaaggacaccgaaaattattttaataaacactggaaggctgggaataaatataattcacaccattcttactttcttggtttagagatagcttatctacatccttaaattaatggctgtagctaccctctgcatggctccaaaaaaaaaacaaaaaacaaaaaacaaaaccaaagccggctgcgagtctgcacgagaaaatcgggttgcaccaggccccagccgcccgccgattcgcttagctgtcggaggctaaataaacagctcccgaagcagcgtttggcacagcgcagggtcggaacgtggacactaatttccgcccacgctccccgcgtcctggcgggatcaccacagacacgacgtccattgctggggtcctcggcgatgcccgtgtgcgcagccccgcgagtctcaggtcagaagaccactaatttcgcggccgcgttccacgaagctaaggggcaaaaaaccagctttcttgggacaaagcgtccccccagcagccagggtcgatcccggcgctgctcccgcggcgcttggctgccccgggcgtaacgggccacgagaagtagggggtggggcgccgcttaggtttgggaagacacgaagcggctcctcgggcttccagcgtccacttcctacggcaagcaggaggagacaagcgccaccctgcgctcgcggagccgaccccggctctcccctcccgtggccgcaggggtcgtgtgtgtgtgtgtgtgagtgtgtgtgtgtgtgcagggacgctccgcgcccatcactctgtttcggtgctaatcgaccgccgtggcgccgatttcccccgcttcccagttcctcacccgcgtgccccggaaggcgcccggaggcccccgggccgccgcgtcacgctcccgggaggctgagggaaagggaggcagccgagccgggagcccggggaggcgcgctgcgccccgcggcggggctgggggcggggctaggtgtctc

SEQ ID NO: 100 - DNA, 30783 bp, Homo Sapiens
gatacgacggcagcgcggcgggaggttcgattgacccggtcttggcgggtcggtgagtcttggcggctgttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcaataatgtagcagccccctctacagattagaccctggtcctacactcttagccgctgcctgcttttgacctttggctcatgggtacttgacgttttaaactcctaggcccaggatggtaagtgtgggcctaggggagactgggaatagccctgggtcagggtctagtaggcctaggctgcaggatccttgcaggcactgtttctgttctccctttacagaggaggagcttggctcccagccagctggccaagagaaaacctgaaggcaggtcctgtgatgatgaagactggcaacctggcctagtggtgagcactcaaggggacagggaaggtgggtagagctgtttggacagaaaagaagccaggatttggtttctagggttacatagccaattccagatgcctcttttgtatgttcaataaacttttagtgagtacttactatgtgccaggcattgaacaagattagtaaaatctttatcctcagggtagtcactagaagctaatatagcctcagttttcctggtgggaaaagataagcaaaagagccagttggattggaccttttgactctgcttggaaaaaagggctacacaacagcaattagcagctggctcttttgctctttgtcccctgcccagtgtcacagaacagtagagtgttctgggcctaccttggagtcctgggctcacttgggcctagatctgacaggttgtgtccttccagtccttgctcatactcaagtacagtatattctactttaggttgggccctgggctctgcttcctgttttggaggcttgttggggctggctgtgggcaggacctatgtaaaccaaaataaataggacagtgcagcatggacttcagagaataagagcagttcaagaagtgggggcttggccactggaactttgaaggaagggatcagctacgcaaggactagaaggcactttttggcaggagcagtgtgtgaataaggtgtggggtaggggtgctggtgtttgtttcaggtgtgtcttacaggatcactgaggcttcaaatatcctggcaagctggtacaagtgtgttcttgcctaatggcttgatggggcttgctcaatagttgtaccgtggtgtgcaaggggcttctctacctgtgaaggaggcacattggctgacccttgccatgtacatgggtctcagacttgaacttggggcagcattctctgcatctgggtctgctgtcagttgctggttgcttctgaagatgcttttagtgccagtgtcctcacagccatgggtggcctgagtggggagtggcctcagtggcctgggagttgaaggcagctgtattcttgcctcttggaaactcagcgaaatgtttggttgctccatcattccatggagcttttggagtgaagctttgggccaccaggactccatgctgttggtagacttgctcttcagaggcccattttatttacctcttccattgccccgctcagtttaggcaggttatttaatctcattaagctctagttttctcacctcttaaataaggataataactctacataatagagttgctatgaagatgatacactatgacatgtgtgaagaatttagcacagtgcctggcacttaataagcacttcaagtgttagttgccattatggtgatttctgtggtcttctagacttcacctttcccaattctctctcctagactcctaggaaacggaaatccagcagtgagacccagatccaggagtgtttcctgtctccttttcggaaacctttgagtcagctaaccaatcaaccaccttgtctggacagcagtcagcatgtaagccagaactgcaacctgcatgtgtatgtctgtgcccagtcactcagcctaggtagactcctgtccctgtacactccctcagtgctttctagagtggccagaagacacacatctgtaggggctttggacctgcccacagctgctggggcctgcttagagaggtgtgcctgacttgtgcctggtttatagtagctacatgggcaccagatatcagatggttcagattcctgaggaaaggagggtaaaggaactaggatcctcatgtcagctcagactctgactctgtatatgactttaaggtgtaccagagtcatgtatttcctctagtaaagtcaaacttaatcaccaccatggcaggttctgtgcattgcctcatgtaattctcacgttttaagatgagaaaacagtctcagaagggttaagtaatttgctcagagtgggtggagcagatctgtctatctccaaagcttttccactaagctttatgaggaatgttttgaaggaaaagtaggaatacataatggagattagtcatttgtgcattcagcaaacatttaaaaacggttttgtggccgggtcgggtggttcacgcctgtaatcacagcactttggaaggctgagatgggtggatcaactgaggttaggagtttgagaccagcctggccaacatggtgaaaccccgtctctactaaaaatacaaaaattaactgggcatggtgtcatacccctgtagtcccagctactcaagtgaggcatgagaatcacttgaacccgggaggccgaggttgcagtgagtcaagatcacgccactgcactccagcctgggcaagagtgagactcggtctcaaaaaaaaaaaacaaaaaacaaaaaacaaaacaaaacaactaaatgaaaacagttttgggccaggcgcagtggctcacgcctgtaatcccaacactttgggaggccgaggtggatggatcacctgaggtcaggagttcaagaccagcctggccaacatggtgaaatcccgtctctattaaaaatacagagaaaattagccaggcatggtggtgcatgcctgtaatcccagctacttgggaggctgaggcaggagaatcacttgaacccgggaggcagcggttgcagtgagccgagatcatgccattgcactccagcctgggcgacaagagtgaaaatccgtccccaaaacaacaacaaaaaaacaacagttttgtgtaatacttgataaatatagatatattacataagttataaaacacaaacacccgtgaacccatcatccaggactagaacattgtcaaacccataatcccttttcccatccccagaggtaatcactatcttgaattttatccatcatcttttgcttttatgatagttttagcatacatataaaaatcactaatacagccttggcaacagagtgagaccacctcaaaaaaaaaatcactaatacattgtttaattggttctttgaactttaaaaaatggtgttgggtgggcatgttggttcatgcctgtaatcccagcattctgggaggccaaggtaggcggatagcttgagctcaggagtttgagaccaacccaggcaacatggtgaaaccccatctctaccaaaaatacaaaaaaaattagctgggcatggtggcgtgtgcctgttgtcccagctacttgggaggctgacatgggaggatcacttgagcttaggaggtggaggttgcagtgagctgagattggcaccattgcactccagcctgggtgacagagcgagaccccgtctcaaaagaaagaaaatggtgttaaaatggtgtgtaatcctctgggactgtttcattcaggatttgttcaaagttgtcctgtgtaactacatggcataagtgcagttgtgggagtgcacaacaggagacctatgggtctggagattggggaagacctgcctctgagagatgtgctgttaagtcctgaaagatatgaggggttagacaggtgaagggagtggaaaacattctaatagaaggaacagcttattggaaagactggcagcaatagaggcaggtactgaaaagagagtgtggggagttgggggatggtggtgagagatgagagttggagagctgtgcagtggctaagagtggaaggcctttcagaagccatgctaggagagtctggactaaggtcactgaagagctttagaagtgttttaagtgggggtaggaggtaacagcagtatagaatatttgttggatggggagagactggaggtagggaaactagtgagaaagctattgcaggtggccaagcaagagaggattatggcctggacatgggttttaggggaatggggaatgggaagaagtgggtggattttgagagatacttaaaaattacaagtggaaaaacttgggattgattacatgtggggagagggaaaattgaggatgaagttgggattttaggctttggcaaggtagatggatggtggtgtcatttgctgagatagggaacacagaagaagaatggcatttggtgggagggagatggcaggcactgtaatcaggaggcccatgaagttcaatgtattatacaagagctattctcttttaatagcaaagttacaggaatagaacagaagatagacaacattaaaaatgtacttgcaggccaggtgtggtggctcacacctgtaatcccagcactttgggaggctgaggcaggaggatcacttgagcccaggagtttgagaccaacttgaacaacatagtgagaccctatttctaaaaaacaataaataaattggctggatgtggttgcacgtgactgtagtcccagctactctggaggctgaggtgggaggatcgtttgagctgaggaggtcaagggtgcagtgacccgtgatactgtcagtgcactccaccctgggtgacagagaccctgtctcaaaaggaaaaaaaatacttgcgtataggaaaattcagaaaagtatagttaatgggtagaatctgctgtatgataagaatgctactaacactgtttagttgctgtcaataagaaattgtattttaaaaaatccattgtccagaagatatgaacaggtttgtttatggttgttataaaattgaagtgctgaaacttgttcactgaaacattttgacttgtattaatgctttacatccctacatttatattaagaattcacacaaaaggccgggcacgttggctcacgcctataatcccaacactttgggaggcctaggcgggcggatcacaaggtcaggagatcggagattgagaccatcctggctaacatggtgaaactccatctctagtaaaaagtacaaaaaattagctgggtgtggtggcgggcgcctgtagtcctagctactcgagaggctgaggaatggcatgaacccgggaggtggagcttgcagtgagccaagattgtgccactgcgctccagcctggtgacagagcgagactctgtctaaaaaaaaaaaagaattcacacaaaaaatgaaaatggaaaaactgcaaactgcaataccggatttctgtcccctatttttctactcacagtgatatacttaggtactctttttttttttttttttttttgagacagagtcttgtgttctcacccaggctggagtgctgcagtggtgctgtcttggctcacctgcttacttatctccattctccttcagctggagcttggtgagctaacactgcacttagagagcgatggtgatctttaattccttttgaaatcagaagaaaaaaaatacatagtaatccagcctgattatattattatagttatctttataccaatgcagtcttttttgtttttgttttttcttttttttgatagggagtcttgctctgtcgctcagaatggagtgcggtggcgtgatcttggcgcactgcaacctctgcctcccaggttcaggcgattctcctgcctcagcttcctgagtagctgggattacaggcacccgccaccatacctggcacatttttgtgtttttagtagagacatggttttaccatgtaggccaggctggtcttgaactcttgaccttgagtgatctgcctgcctcagcctcccaaaatgctggtattacaggtgtgagctgctgcatctggcctctttttttttcttttttttttctttttttaatggaggaaggggtcccaaaggcaaaagtgcctggggcccacaagagtcatagtgtggccttggagatgaggacttcagccttagacatgatgattttgaagtccctgcaggagatctaggtctggagtcagttgtaaatgtggatgtggagtaaggtataactagaaatacacctgggactcattagcatagataaattttatacctggtaagtggattggtgaatgggtagtcagaagatctgagggctaaaccctgagccctggggagcactgacttttttttttttttttttttcctgagacagggtcttgctgtgtcacccaggctggaatgcactggtgcgatcacggctcactgcagcctcaatcttaggctcgggtattgctgccacctcagcctctggagtagctaggaccacaggcgtgtgccaccaaacctggctaatttttaaatgatatgtagagaccaggtctcactgtgttgcccaggcaggtttcaaactcctgggttctagcaatcctcctgtcttggcctcccagagtgctgggattacagacgtgagtcactgcagccggttgggagcattgagctctgggggtgggttgagggttaaaaggcagagggaaaagagctcattaggggactgaagatgagatcccagaaaggtggagagtagtgtcatggaaatcaaaggcagaaaatatttgaggagtggtcagcttcgtcaagtaagatacatgtccattggaattagggtcatgtaggccattcgtgatcttggccagagtggaaggggcagaagacaggaagagtgggaggaaagaaggggagctatataacttactagaagtttgcctgtggagaggagagataagcaatcaaatgaatatttgtttttaagataggagataattaagtccattttaaatgctggtaagagctagtagagagggagaggttgagatacaagagtgatcagtcataacagagtgattctctgcagaaatgggaagctttagccttggtggggaggagggatgctgtctctcatctatcagaaggaaagattggtatgaattatcagtaactaaatgaacagagaataagagcatgctccctcccctgccccctgctatagagactggtgagtcaccaaaccagatccctgaaggttggccattccttttttttttttttttttttttttgagacatagtcttgctctgtgacccaggctggagtgcagtggcgcgatctcggctcactgcagcctctgcctcccaggttcaagtgattcttgtgcctcagcctcccaagtagctggaattataggtgcccgcccccacacccagctcagttttttgtacttttagcagagacggggtttcaccatgttggcaaggcagatctcgaacacctgacctcaggtgacctgcccgccttggcctcccaaagtgctgggattacaggcgtgcactgtgcccagcaggccattccattttgcaggctgagccctcagacatttttggccaggggtctccacattcttccttaccagttatgcaagcctgtagttctccctgcagaacctatggttcctgtgttctattgaaagtctttttaaatttagggcataaattcttggctactcagagcctcaaatctagccttctatactgataattttgaaaatatttctgttttagaattgatgccaaattaaaaagaaaattagggtccatctccttttcctctcatttgacttaagagtagcttttttttttcctttgaggcaggtcttgctgtcacccaggctggagtgcagtggtgtagttgtagctcactgcagccttgaactcctaggccaagtgatcttcctgcctcagccttctgagtagctgggaccatgtgccacagtgcctgggtaatttttaaattttgtgtacggggtgtgtgggggggtctcactacgttgcctagggtggtctcaaaatcctgggcttaagcggtcctcccacctcagcctcccaaagcactggggttataggcatgagccactgcactggccaagggtcctttttgttagcatttttcataatgattatcattgctattcatagttacagtcatgctaattaaaaatagtaaaggctgggcataatggctcatgcctataatcccagcactttgggaggccaaggtgagaaagatcccttgagccaggacttagagaaagatcccttgagccaggacttagagactgcagtgaggtatgatcaccactactgtactccagcctgggcgacaaaatgagaccctgtcttttaaaaaaaaaaaaagtcaataaaagattttattcagatgcaaagaaatttgcaaataaacaaaagcatttgagttttttgccaactttgcctttatgttatgttatttagtgtgatgttgtcatgttatttagtgtgataaggaagttcatttctacatacttgttttctgtcttctaatatcacaaaaaaaattcattactttttttaaatttaaagtacatttgaggccaggtgtgatggctcatgcctataatcccagcactttgggaggccaaggtggacggatcacttgagggcaggagttcaagaccagcctggccaacatggtgaaaccctgtttctactaaaaatatcaaaattagctaggtgtggtggcgtgtgcctgtagtcccagctacttgggaggctgaggcaggagaattgcttgaacctgggaggtggaggttgcagtgagctgagattgtgccattgcactccagcctgggcaacagagcaagactccatctcaaaaaaaaaaaaaaaaaaaaccccaaaaaacaaataaagtacatttgaatttctagacattgatgatgtgtgaagaaatgagtcagaaaacaaaggtaaaaatatcacggcaggcttgctttttttcctattagactatgttttttgctagaagggacattttttcattactgctttttccactaatatattcccattaaaactaccttcagggtctctgctctttatttctctgctctcttggcttccacctctggttttgttgaggttcacaggctatcacagttccgcaaagggctcaggtgtgtgtggaccagaacttccatgggagctgtcagagttagctcagtgttaatttttctgccttctctgcccctgccccagccccatagcccatggaataatgctggttcaaggcagaagtgcttgtacagaggcttcttgcctttaggtggaggagtcaccagtgctacctctctaggacccacatatgtctacctgctgtcacccttgtcccacttgctttttcttagtgttgggcttagcttctctctcatgtccctttctcatgttccttctcttgtgctttacatggcaggaagctgctgggtctgggctgatctgcatggctgtactcagagtgggtgagaggccacgttgcctactgagtacaagtaaggaccctagaaccaggaaagtcctgcatttgtaatggctttgtgacttgagaaagtgacttaatcactctgagcctcagtttgctcatttgtaaaatggaaacaccagtaatatatggacctcatacagctgttaggattaaatggtaacatgaatgcaagaggcttagctctgtgtctagcatacattggtagccatcattatttttatttatatttttaaatatatatttttaaaatagagatggggtcttgctatattgcccaggctggtctcgaactcccagacctaagtgatcctcctgccttggcctcccaaagtgttaggattacaggtgtgagccaccatgcccggcctggtgttgttaatattattttattaatacgatggctcccatttctccatcactactctttgatgagctgtttagttcccaaggaggctgatgtgagtattagatatattagacataactgatgtagccaaaaaaaaaaaaaaaagaattgtgaggtgtgcttgggaaggtgtaaccctatatgacagtggttaaacccagacattagaattatccattattactcaggttggctaagtctgtggtatttgctttccaaggtgctataccctagggaagagctaggtatgctcactggcatggtttttaatgagtgaatggtttcctgggttctaagcctcgtggttgactgaggctgggcccttctgctatccctggatatttgtagaaccttacataaagcctcgaagatggatgctgttgtacaaaacctaatgtgaagcatatcatgatattgtcccataacatctccagtcagtcctgaatccttgtttctcctttctttttaggaagcatttattcgaagcattttgtcaaagcctttcaaagtccccattccaaattatcaaggtaaaatggaggtttttctgtttttgaaatcagtcatatgtacgtgtgcctgaataaattaaaaacctgcttttgtaaatacaagcttagctgggaattgaaggtgccagtccagcggtggctgtgtttggggtgaccctcctgaggcctgcatgaaaactgtgttagcctcagtaagggctgccaagactaactgcccctcatcttcttggtagaggtgtcccggtgctcagaaagctcctggtgggccaagatggctgatggacctgggcttcattcaatccaagtgcattcagtagcatcccttttatgaggctgactgtgtgggaggcctggattctataaggtttttccctgtcttatgtagggtacagcattatgctaaaactggggcttggaggaatagggaggccagctttctctctctctctttttttttttttaatttaatagagataggatttcactatgttggccaggctgatctcgaactcctgggctcaagcgatcctcccacctcgacctctcaaaaagtgttgggactacaggcttgagatactacgcttggctgtggccagctctcaggagctctcagaaagctccatgaaagtgccctttagaatttcaggccttcccaggattgtcttgagttgaaatgaaccagatctggcacctcagaagtttgtaattgaatgggagaaataaaacgggaaaagctctgattcaaagcagaaaaattctgggggctgggcatcgtggctcacgcctgtaataccagcactttgggaggccaaggcgggcagatcaccagaggtcaggagttcaagaccagcctggacaacatggtgaaaccctgtctctactaaaaaaaatacaaaaattagctgggtgtggtggtgggagcctataatcccagcttcttgggaggctgaggcaggagaattgcttgaacctgggaggcagaggttgcagtgagccgagattgtgccactgcactccagcctgggcaacaaagtgagactccatctcaaaaaaaaaaaaaagctgaatgggataatggtcatatagagatgcccaaactgagtttggaggcattctcagagagagagggtcatatgggagctcgggaaaggttatgtgaaggacaagtatttgagctgggcttgctggagctcctaaacatagattcaggtgacggaatgattattggtttgtaggtcctctgggctctcgagcattgggcctgaaaagggctggggtccgccgggccctccatgaccccctggaaaaagatgccttggttctgtatgagcctcccccgctgagcgctcatgaccagctgaagcttgacaagtatgtgcactggtatttcataagcagttttggttctctgtatatgcacgcatacttgggagggcagagggtattttggtgtgatttctttttaggattgacatatgttttcagagagtagatgattggggaaggagactgcctggggaagagcctgtggtcatgtccagtgagtgggcattcctcatcccctcctgccttcccaggatgctcactcaggaggaggagtgattgaggtgatgacacagggaacccatccctctctgagctaactttctaactcctaaagtaggaacttgctatggttttacgatttatcagccaagaaggtcttcttttaggcagctgcctctgttgcctccggatcagcaggacacagcttcctgagggtgctcccttgcccatgtctgagcacgctgttttctttgctgtgttttctcagggagaaactccctgtccatgtggttgttgaccctattctcagtaaggttttgcggcctcatcagagagaggtaaatgagggtgaggggaacgaggtatgggctatgggctgagcctgggagactaccatccctgggacagcagcagcgtaggtgccaaagtggactgaaggctgttattctctagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctgggtacggagccctaacaaagatggctgcactctcctgcacagcctgctgctttcttacgtgtatgctcatttatggccagggtggagggcaatgcaggggtagaagaaaagagaatttccattgaaaatagttgaagtggagtcagttgtttccaggctaaattaaagaactgtctaattgttttttttgtttttttttttttcaaaagattctgaattgttccctttacaccttttctgttgtagaaggattcatgaaccagcgtggagccagggtgtcttctcccatcctcatcatttcctatgagaccttccgccttcatgttggagtcctccagaaaggaagtgttggtctggtcatatgtgacgaggtacttgactctcagcagtctgggtggtaggagaaaatctgtcaaaatctcttcactgagtattgccttccaagggctgtgctagtcactggggaatgctgaagacaggatgctgccttggagacaagtgacagggagagcctgtgataccaaaatacaagatactgtctgccaaaagagggctgaaacaatgcttagaaccctgaggagagtgagatactgggggctgattggctttgttgcctccggatagtattcctagactaaagaaggaccttgaagggtgggtggcaatgtttagaggatataaatcagaaagtgtctgagacaagtctcaatttagagatttattttgccaaggttgaggatgctctggggaaaaagagacacaagccaaagtaggatctgtagcctgtactttttccaaagaggtttttgaggacttcaatatttaaaggggggctggccacgatgattcacgcctgtaatcccagcactttttgagaggctgaggtgagtggatcacttgagcccaggagtttgggaccagcctgggcaatatggtgaaaccccacctctacttaaaaaagataaaaatagtcaggtttggtggtgcacctgtagtcccagctactcaggaggctgaggtgggagaatcagctgagcccgggaagtaagctgagattgcgccactgcactccatcctgggtgatggggtgtgaaaccctgtctcaaaacacacatatgaccgggcgcggtggctcacacctgtaatcccagcactttgggaggctgaggcgggcggatcatgcggtcaggagtttgagaccagccaagatggtgaaaccgtgtctctactaaaactacaaaaattagccgagcgtggtggtgggtgcctgtaatcccagctactcaggaggctgaggcaggagaatctcttgaacccgggaggtggaggttgcaatgagcctagataatgccactgcactctagcctgggtgacagagcaagactctgtctcaaaaaaacaaaataaaaaccaaaaaacacacatatacacagacacacatgaccctttctcaaaaaacaacaccacacaaatatgcataaaggggcaagagcaggcaggagggaaagaggagccatcagttatgcattcagctcaataaatctgattttacatacagttaagtaaataaagagtagaggaagaagtcaaatacacatttgtctgggagggaggatttctagtcttgtctttgtcccctgcttgtaaagatgagctgtttttttacattgtcagggtgagggaggccacctggggagaggcatggcgttctatctgcagctatctgtttaggaacaaaaggaaagacatttttttgcttgactagttcccaagcttagcttttccctttggcatagtttggggtcctgagattttgttttcctttcacagggaacaggttctagagttagagacctttatttgtatcctggctctgccactgaccagcagtgtgaccttcaacaagttactttatcagctgaacctctgtttctacatcagtaaaatggggtgataatatctgcctcataggattattgtgaggattaaatgaaattattaagaaaaagctcttatcgcagtgcctggtatgtcataaggccttggcaaacgtaagctcttggtggttattccaggctgggggtacttgcaagaacaaaagcagagataagaaagtccatacaccttgtagtagtagtttgtgttgacttcttgtttcttgtttctggaactaagggaatatggccgtagttacttcctggccttttccagtatgtgtgaatggcaatagagaggctagtacttaggaagcagtgagggtggctgggagcttcctactatagagaatttcccaggacttcccagtgggcttggcgaccctgaggctatagtcattgtttgcaacttcttgggagagttaacctcctttgtataccccagaggttctagtggagaggtggctgaaagacttggccctatctgtcaaccagttgtcaggctaggctcagctctgggtactgtagattagcccagttgtctgaggaacttcagagaggggacagagggaaaaagcttgcttttgggtaccatgctttctagttgtgagctattttctggtcagtcattggcgggtcttcaaactcccaacttcctggtaggagtagggaacttaccaggttgaggtgaggtatgcatgttactgccctgtggttcaaggccctgacatctgcttcatcactgtggagggggactatgccaggagccaggtccaaagcattgtgggagaggaaggcaggctgtagctgttgagcctttgaggattagggagcatctaaatttttttctactttttgtttttttttgagacaagggtcttgttctgttgtccagatggagtgcagtgacgtgatcttggctcaccgcaacctctgcctcccatatttaagtaattctcctgcctcagccacccgagtagctgatattacaggcgtgcaccaccactctggctaatttttgtatttttagtagagatggggtttcaccatgttggccaggctagtctcgaactcctggccccaaataatctgcggccttggcctcccaaagtgctgggattacaggtttgagccaccgtgcccagcctttttctactccttagtgtttttttcttccccactctgtcctgttttatgagctgactctgtgcagggcacaagggatgaggctgcctcttatcacactgcagccccttggctgtttacctttctacttgtttaccttttattttgtcaactgtcagagatctgaggaaccaaaagtcctgaaaagatggtcaccttactccagggaaggagagggtttgtcctgttcagaccctggaaagggaaggtgccatttcaggctttcatgttctcagctcccacagcatcttcctcccagtaacgcttttctctggaacacagtttttcataataacttctatgtacaaaatctttgatcctcaatcaaaagacacgggatcagctctggctttgccacttacaagcgtgactttccacagatgagactgctctgagattgtttcttcatctgtagagtggatggcacatgggctacttgaaagggatatgatacagatcaagagaggatatatgggagcactttgtacaagtgtataaatagcagagggattgacgtcatcgtcatctcaatcttaaagattaggagacaaactcagggaagtgcgtagtgacttgcccaggttctcctagcgagtacatagtaagctggaatgtgaatgcaggtgtgagattccaagtcgtggctctttttcctatccctctctgccttggatgcttggtgcaggaagaagcttgccttgggtatggaagggttgtccctgtgctcctcattgagacccatgtggatccttagtgactggtccaatagggagctggggttggctttctcttttgcagagacaggatagtgtggcagcccatttcattcgctgggttatttattaagtgccttttatgtgtcaagccctggagatctcacaatgctgtccctcagggagcttcagtttagaagatctaattgttggtgcccatttcccctggacctgttgggtaatttcctctgactttcaagtctcatttccctcttcagttcagaagtctaaggctttttttagggctagtacttggagcctctaataattttttttttcttaattaaatttctaggccaaatgcggtggcttacacctgtaatcccaggactttgaaaggctgagatgggcggatcacttgaggtcaggatttcaagactagcctggccaacatggtgaaaccctgtttctactaaaaatacaaaagttagcccggcatagtaacacatgcctgtaataccagcaactcaggaagctgaggcacaagaattgcttgaactggggaggcaggcacatgccaccacacccagctaatttttgtatttttagtagagacagggtttcaccatgttggccaggctggacgcaaactcctgacctcaggtgatccacttgccttaacctcccaaagtgctaggattacaggcatgagccaccatgccccgttggtttatttaatctttaatagcaacattggtcattatttcattctttcattcaactaatattcactgagctttgtcctatacactgaaattatacaggcgaatctgacatagtctctgccttaagaaatcctagtctctgcctagttgagaagataaagtacagtagagtgtgattagtactctagtatatatattatggatgagggcagagtggtacagtgtccagactcagagtcatacagacctgagttcaaatcccagctctgctactttctaccggcatgattttggataactgtttacctctctgaatcttagtttcttcatctctaaaatggataatacaatttccattcgtgtggattacagaacagaatacaggtaaagtgtttagttagtaccatgcctaccacattaaacgggttcactaaatagtagcagccattacgtatatagtgccacaggagcacagagttgagagagacaagcagcctggagtcactgaggaaggctttgcataggaggtgacatctgaggaacttgcctgtggaaaagagctctaggcagaggggtggcatgggcaaagagacataaggaaagccagcattaggagtgacaaggtcaggattcctggaccgtgacaagcttggagagtgtcagagaagttcactggggcctcattgagaagggctttgaatgctaagctagtgagcttaaagagcttggacttgatgctatagatggaagagtcagtgaagggtctgcatttaattgcgttgtcaaagcctgacccaagggagcaagactgattgctgattcttggttgagtggttgagttttgtgtgccttccccagtatggggctggatgtagaaaaggtatgggcctaatcttgcccatgtagttcttggagaaagagggaaggttgtcctttatgattttcttgaaaaaggcttaaaagaagtagtagaggtgtggagagaatgggaggacaggacagggagaatagagattggggaagagatgtgaagggaagcagagggaagctctttagctctactagctgtgaggattctggtgggacatggagcctggtccaagtccctttaacactgatggcccagacaaggcctggagtctaatacagaaggcgtctggctcagaaggttctgagttgggtaggctgatgtggaggggaggactccctgaaagcatgggtttgtcatatgtccacatgatctctgaagagtataggtgggctgccaaggctctggaggtggggcagggaaagggatggaaaggaacagagggaatctttgctttatgggtatagcactggtctggaaacaggaagtctgtcttttgagcctaatattctccatagttaagtgggtgaaccctctctcatgctgccccctgcctagttcccaaggccctagaacctgtaatgtttttgttttttgttgagacagtttctcactatgtcactatagtggtggcatatgcctgtagtcccagctactcaggagactgaggtgggaggattgcagtgcactcacggctcactgaagcctcgacctcctggactcaagcgatcttcccatctcagcctcccaagtagctggggctatgggtgtaagctactatgcccagctaatttttgtatgttttgtagagatggggtttcaccacactggccaggctggtctggaactcctgggctcaagtgatccacctgtctcggcctcccaaagtgctgggattacaggcatgagccacggcgcccggcctggaatgtttttgactcctcttttcctgtctacatgagactttgctaccgtatagggaatgccacattgcgctctgaataaggattctcttgcagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctaggtaagaatctagccttgtttgccacatcagagaggagccctgccttgtctttgggagtataactccagctgaggagagaaagaagagaatgctagttatatgtgggtcactaggcattcttgtaggaaggcttctcttgtcagggagtagcaaagccattgggaggccttggatctgctgagcaactcagcaaagcccatgttggccatttttccattgcagaggtggcaggggctatacagggaatggtgtcatgatgagctgagggtggaattattatttttgttcctcagatcctagctcccttagaagagttttggcctcagagcaagctctgtcttgggcagacgtgtgtgttttaaaaatcattttaaccatttttaaatgtaacaattcagtggtattaagtacattcactttgtgcaaccatcaccatcatccatcttcagattttttttttctatttgctaaacttaaaatctacccaataactcctctaccctcccctcccagtgctttgagaggctggggtgggaagatcacttgaggccagttcaagaccagcctgggcaacatagtgagaccttgtctctacaaaataagaaaattagctgggtgtggtggtgtgtgctggtggtcctagctattcaggaggctgtgatcatgccactgcactctagcctgggcaacagagcaaggccctgtctctaaaatagtaataataatcaaaactcctcattcctccctcccctaatccctggcaaccacacatatatttgtgaaagggtgtgttagtgtcaccccaacttgccagtgctcaagagtaggcagagaacctgctgagtggcaagattatgaccaagtgaacacatttgtgtaaccaccatcagatgaattactaacactctctcagcagccccttttctaatcactatcctctccttttgtcccggcagcaaactccttcctgacactataggttggttttgcctatttttgaatttatgttaatgaaatcatatagtatgtattcctttacatctggtttcttttgttcaacatgtttataaagtttatccacattatgtgtagcagtagtttgttcattttcataattgcatactattgcatgttatgagtacactacaatttattctactggtttggttttgtttgttgagacagagtctctgttgcccaggctggagtacagcgttgcagtcatagctcactgtaccctcaacttcctgggctcaagcaatcctcccactttggcctcctgagtagctgggactacaggcatatgccaccactattggctaacttttaaattttttatagagatggggtctcatatgttgctcaggctggtcttgaattcctgggttcaaatgattctcttgtatcagcctcccaaactgctggaattatgggcatgagcccctatgcctggcttccatctttttctgtttggatatctggttcaccctacatcatatattgaaaaaaccgttctttcccccattgctttgcagtgctaccttcttcataaatcaaatgttcatatatgtgttgctctatttatggactctattctgttcctctggtccgtttgtctccttgtgtcagtacttctctgctttatttactgtggcctaataagtcttgatatccattagtgtgaatattccaactatagtcttttttttttttttttgacacagggtctcgctttgtcacccaggctggaatgcagtggtgagatcatggctcactgcagccttaacttccgggctctagtgatcctcctgcctcagcctcctgagtagctgggacaacaggcacacaccatcatgcctggctaatttttgtattttgggtagaggtggggttttgccatgttgcccaggctggtcttgaactcttgagctcaagcaatctgctcagcctccaactatattcttactccttaacattgtcctagatattcttggccctttgcattcccatgtaaattttagaatcaacttgtcaatttatacacctactgcctgccatacccaccaaaaaactctaactggattttaattgggctgtattgaaacagataaattctgaaagatctttcatttttataatacggaaccttccaatatattaatatgatctgtctctcaacttgtttaggtcatctttaatttctctcaatgtggccaggtgtggtggctcacaactgtaatcccagcactttgggagaccaaggcgggagggtaccttgagcccaggagttcaagaccagcctgggcaacatggcaaaatcccatctctacaaaaaaaatacaaaagttagctgagtgtggtggcatgtgcctgtagtcccagctacttgggaggttgaggctgtggtgagccatgattgccccattgcattccagcctgggcgacagggagagaacctgtctcaaaaaaaaaaaaattggccgggcacggtggctcatgcctgtaatcccagcactttgggaggctgaggcgggcagatcgcgagatcaggagttcgagaccagcgtggccaacatggtgaaaccccgtctctactagaaatacaaaaattacctgggcacggagaaggggtgcctgtaatcccaactactcgggaggctgaggcaggagaattgcctgaacctgggaggcagaggttgcagtgagccgagattgcactccagcctgggtgacagagcaagactccattgcaggaaaaaaaaaaaatccactctggccatgtttgtctttttagtggactattcaatccatttacatttactctaagtaattatatatttggattttaacctatcatctcacttttggcctttcaagtcttcactgctttgatacctctctgatctgttaaacagaaattggcctatattttgtttagccttgttcttggtaggaaggctggtttgtgagaaggtagtctgccatcactagctgtgggaaaatcattccttttccacattcttctgttttccttctctcctgtgtttagggactgcccatgaattcaagaagcattttgaattgccaattttgaagggtcgagacgctgctgctagtgaggcagacaggcagctaggagaggagcggctgcgggagctcaccagcattgtgaataggtaatgaccttaagcgaagtcattagaattgcctcccaaaccatccatggccaatcctttgggggctttgcctctctagagccctcaaaggctgggattctaggaagggagtgggttctgtgtcctaactatggccactgaataaacaagggagtcttggaggtgaagtgcctgctttctttctggcttgggctctgtggtctggttttggtctgtttatcagcctgctgaggaagcttttctctgatgctgctggacttcttgagcaaagtataccttggagcattactagtatttcagaagcttcctgtcagttggtctcagacccgaaacattaggcttctcttcccaggccccatagtcattctgtgacaggtaggagaagatctgaaaggtggttgtggctcccaggctaaggggactgactttttcatgggagttacataacccagagggtaggcacattctggactcctttgtccagaggtggtatgcacacttgataggttacattctaaagagtcctcctgcccttcccaacaactgcctggctacctggctacctctccctaccaattttagatggcaggacgggcatggtggctcacgcctataatcccaccactttgggaagctgaggcgagtggatcacttgaggtaaggagttcgagaccagcctggccaacatggggaaactcccatctctactaaatatacagaaattagctgggtgtggttggggtgcacctgtagtcccggttactctggagggagaggctggagaatcgcttgaactcgagaggcagaggttggagtgagctgagctgcgccactgcaccccagcctgggtgacagagcaagactccgtctcaaaaaaaaaaaattagatggcaggaagaagaattggtgttttcttaagatctgcttcttaggtgcctgatacctatccttcatagtcttcccaggaggtctatgcttaatttcatttagcctggggccatgtagcagcgggcatttggacaaatgcaagcagaaactcccctaaggacttagtaatttacaacttgcttttcctgttagagctcctgtatcaatgggaagcctcagtcttctcttgaagactaggcaacctattgaaggggaagagaaagtgctgcctgtctaagctagcatgtttggaaggtctctgttcccacaattgagaccctgatacagatgtgtttgacataggtctgatgacttttttttttttttttttttttttttttttttttgagatggagtcttgctcttgttgcccaagctggaatgcaatggggcgatctcggctcactgcaacctccacctcctgggttcaagtgattctcctgcctcagcttcccgagtagctgggtttacaggtgcctgccaccacacttggctaattttcgtatttttagtagagatggggtttctccattttggccaggctggtcttgaactcctgaccacaggtgatccgcccgcctcagcttcccaaagtgctgggattactggcgtgagccactgcgcctggccgagtctctgacatttaatactgtaaaagagggctagtcttggtcctttgggtggtagcttttattccagtagttagcatggcaattttaccagcctcttgcctttttatcctgttttctctagatgcctgatacggaggacttctgatatcctttctaaatatctgcctgtgaagattgagcaggtcgtttgttgtaggtactgaactcaactgaaagatgtggagtgggtcaaagcctagctcctgaagcatggctgggctctcaaggtgttctcagagggcaggagggtggtctagctttttccactgacccagctgccttttttaggctgacaccccttcagactgagttatacaagaggtttctgagacaagccaaaccggcagaagaattgcttgagggcaagatgagtgtgtcttccctttcttccatcacctcgctaaagaagctttgtaatcgtgagttgggcttgtgtcctggtgtcctctgtgagagtgagcaagggagggtaggttcctgtagtggcctggcaaccctcactaaaactcgtccagagtcatcctcatagaggccacatgtgattccaaccctacccaaggcatgaaccctgcattgtggagtctgtttaccagaccctttgctttggaaaattgaactcatcttctgtccagcccatgcttgatgacctgggatgtgtcgactgtttgtgagtgcttgcatgtacacacgctcatatacaatgttgggcaggaggaaaaataacaaagaaaccttgcctgctctgttatagctcccttcttgttgggagaacacattagtgagtgagattgtccatccatcgtcccagatggcaccgactatatcctgttggaatttggtaggatgaagatcaagcaagtctgatgttgaggaaggccttttgggctaggcttctagagggagttctagtgaacactgaagtggaaacttcagaaagcaaagtatctgggttttgttttgttttctcccagatccagctctaatctatgataagtgtgtggaagaggaggatggctttgtgggtgccttggacctcttccctcctggttacagctctaaggccctggagccccagctgtcaggtgacccttttcctaccagtatttgggcttctctaggaggagggtgggagatttttttttgtgctagggctgtcctgtttcaaggcaggatatcaagagtaagaagcctgggccattgggacagccagtaggggactgctggttgctgctcttcccaggtaagatgctggtcctggattatattctggcggtgacccgaagccgtagcagtgacaaagtagtgctggtgtcgaattacacccagactttggatctctttgagaagctgtgccgtgcccgaaggtagggaagatcctaaccaggatgccaaagggggatatacccctcccctactgtctgtctagttctgatttgtggatgtgggccaagatctgggcacataagggctttccctggagatatcttcccttattgctatgatggcctcagctctatctccaagtagaagatcccctagtccttcaggtactcccttaggaaagagtcttggcctctagctccctgcccctgcctttgggagcttagggcctcaagcatggttatttcagtcccttcagtggctctccaagggactctgctttcttgggtctttttaaaaaaatttttatttttaattttttttccccctaatcattgaagctttattttcttgggtctcgaatcccccttcaggtacttatacgtccgcctggatggcacgatgtccattaagaagcgagccaaggttgtagaacgcttcaatagtccatcggtaaatgcacatccccgtccccacaccaccaatgcagtatcatcagaattaaggaatgatagagaagctataaggggttaccttgattttttttttttttaattcccctagtggatatagtaggatttgtctggttggtgatggctgggctggaaactgactgtgtgtgttgggattggctggctggtgagcagataaactggtggttttcacaattggtactgagtagtatagaggcatgagggaggagctggttgggctgagcaggatcccagtttaggctataagaggttccttttctcctgtttcttctctttccagagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgtaaggatggtgatagtagtcatagtaggggtgggtcatggaacgagatcttcaggaccatcttgttccttagtgcctctctttggcctttctgcctctagcagtagccaagctatgggcccagaagtgagtcttttattcttctgttctccctccccttctctccaccccattccctcaaaccattcttactgtgccatctggacacctgttcagtacatccttttcacaggacacctgcttccctcatacatgatttctgctgtgtcactggccttgtagtcttctctcatcccctgtcctatttgcattctccaagttataaattatcaccttcagaccatccgtcccatagttcctttcttgcagcttatgtcgttggacttgactacactcttttcttccttgctgcagtcctctatcctctgctatattcctaattcattgatgactttggacattagctcagccttcatttctttcccaaatccagcaatcatactggctgacgttgaggaccatgtggttatccagcactctggccttcatgtttccttgacctcatctcaaccccgcttcgtctaattattcctaagatcacaccgtggaacttgttagaacccagaaccttaataactgtcattctactttcacttcttgtcctcctagctttcacatacctgctgtatctgcttcagcctaatgttcctgtagcctctccccttcccaccctcccactcatctggcttgacttccttgtttatttagcccagtcttcactgtgcatcctttcagctactcttttcccaatacccattccaattggattatttgagctgttttcagcttctacaccagctacattgcatttacatgttggtactaccacaaattcatgttctctttttgaggtgggccatatctcatttccttcaaccatttcaagcatctaccatttctctcaaatttcctacctaactcatcttctttctactcactcatcagactccttataccactgaacctaccttcaaatatactactgaattcctaattgccaaaacaggagactatgaatttttcctcttcgtgtatctcacactgttgactactaatcccttaaaaaatgctcttctaggctgggtgctggaggatcacttgaggctaagagttcgaggctatagtgagctaggattgtgccactctagcctgggtgacagaacaggatcccgtcttaaaaaaaaaaaaaattttttttctcgtctttggaaactccactctggttcttctacctctctgattactcattatactgacaaatctctaactataaaattttagcccagatctcttacctgagctctaaatccctatttctaccacttaatctacatttccacttagatttctaatgagcactttagaagtatcatgactaaactcattccccttccttctgattgattaactgattgattttgagacactttctttctgttgcctaagctggagtatagtggcacgatcatggaccactgcagcttcaacctcccacctcaaccccctgaagtagctggggctacaggtgtgtgccaccacacccggataactttttttctttattttttgtagagaaggggtcttgctatgttgcctaggctggtctcgaacatctggactcaagcgatccaccttggccttcccaagtgctgggattaacggcatgagccaccacacctggctccccttctgaatgttgttcttaatggctccattatccacccaacccaaaactgggaataatcttactggactattcttttctcctaataaccagattcccaccagttttcactgatttttaccttcttgaaatttccttaatctaaccttgctctccaagccctcctgaggtcatggtcatctgtcacttggatattgcagcagcttcctaattgtttacttctgtcttatcccaacccattgttcacatactgcttccagaaggagctttccaaaaattcagattttatttttcgtctcttcgaagacaagattaaggccttcagcatggcatccaaggtttgttttttgttttttgagatggagtcttgctcttgctgcccaggctggagtgcaatggcaccatctcagctcactgcaacctctgcttcccgggttcaagcgattctcctgcttctcctgagtagctgggattacaggtgcccaccactacccctggctaatttttgtatttttagtagagacagggttttgccatgttggtcaggctggtctcgaactcctgactttgtgatctgcctgcctcggcctccaaaattgcagggattacaggcgtgagccaccgtgcctgtccccaaggttctttaatgtggcctctgctgacttcccagtctcagctcttactatactcccaccaacctccagttagcctgaactactcacagtcctccaataggccagtagtattcctttgttcctatgctgggaatacctttctttgtgtcttttcttacaaaccatctactcattttcaagattgagctcaaggatagagtttcaagttttcaatactgttctactctaccatccttatggactcgcagttaccctgtatagatttctatcattgtatcaactgtttaaatgtttgtctaggagctaaaggataggggatatatatgattcttttttgtatgctaatgtcagcacagggtctggaatagaatagatacctaaatgatatttattgaatgagttagagttgggcttggtgcagaaatctgaagctgcagcagacaaacctcagttcaccctgacgggatttagccaggccctgggacccttcattagtatagaaagtagcctgggtgggcagactattcatgtcatgttctcaggagacagactgggaaaatggacctcagctgagtagagataatgttctgggactcatactttttattcatctcctcttctcgggtagctgtagtttcaaccctttggttttcctgctccctttttatgaggatggctaagcgctgtatcttttgacattccccacctcctcttccccaggcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggtggggaagtgccctaaccattatctctaagctacccacacagtagggagatgggatctgtagtgacttcagctgtgccttctgtccctaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggtttgag

SEQ ID NO: 101 - DNA, 103156 bp, Homo Sapiens
tacaatgatataagcacatctttatttttcatttaaacacttaatatttacaaaacattaaaccactcaattttgactattgtatcaaaagtgatatattttgcaacatatactgtaatttaaataattctattaattttcaaaaagtacatttaattaccatactaattttcaaaagaagagcaatggaatgtcagaagtaatctttcactatgtgccagtagcttgagtggttatattctgaaaaatgaatgacacattttctgttattctttcaagaaaaggatctgtaagatttaaatgatctccagaaaaatgtttccattgcttcagctgggacatagaaagaggtttcagggagttagatttctggtgatgtggaccaagctgacaatctctagagacaatgaatttttccaacgaatcacctgtaataagtaaaacaatgagaaaatccttaggcaagccaatatcctgctaaatacaatacttttttgttttatgataattagtttatgtgatttattacatttgatcaccatggttcaagttaaaacaaattcattctttttacaaacatttataagttatttactatgtactgatttaaacagcaaaggtaaaatgatgaagaaacacaggcatggtctctgacttcaaggaccttacagtctagtgggagagatatacattaaataaataatcatctgaaaaatgtattacaaattcaaaatccctttcctaaaacctgtggggccacgtttacaaattcagaatataattcgaacaatctgggtcagcattccataatgaaactcattaacattctgtagcaagtcataaatagtcttacaaaatgggttaaataaagactattgataaactcacatcaatttaggtaaggttttgccacaaataattttgtcacaaatttatgaagaaaaaaaaaccttttgagctttctagatttcagaattgaagataagggactgtggagctgaattacaaacagaggtaagggtatgaaggaaagatacagggaactatcttacatatgacaagagaggctgacttggtccggaaggtaagtgaagggcaccctgaggaaatgttctattaagatctgaaagatgagaaaagaactagatggggaaaaaagataaagcattccatgataagcacattaaaaagctatgaaaaggaagggacactggcatagtcgagcaattgatacgagcctatgcaattaaagcctatagagtaaaagcaaagaataatgcaaaagaagttaagtaatgcacagtgaagcaagtattcaagggctggattatgcaaaacatgaatggcagaggccagccgttattcaccaaatccatttctctttcctccagggcacttagtcaccttttccagcctcccttacggttagatattgccactgagtctggccttatggaatgcagctatgtcacttccaggtctgaactataaacatccttcaaactgaacaattttctactttatctcttctctcactgctggctggcagatgcagggtatcccagcagaggactctaaggtccaaatggatggaagagctccaagtgaaagaaccctggatcacgaaattaccttatgaaaggctgtccactaaatgcccacaatgacctgttacacaaatgagaaacatatttctattgtgttagaccattgtgcttttttagtttcttgttacagcaattagactgccctgactaacttatcaatttagagattttagtatctatcctaagagcaataggaagctattggaggttttatttttttaaccttttaattatgggaaatttcaaataaatataataaatatatagcatgtatcatttcacttataaatatttcattctacatttctaaaagataaacacttctttgaaattttatcacacctaaaagaaaagcctcaagtcattccttaatatcatcaaattcttgtcagtgttcataatcattgaggttttaagaaaagagatgacaaggccgggcgcagtggctcacgcctgtaatcccagcacttcgggaggccaaggcgggcagatcacgaggtcaggtgatcgagaccatcctggctaacacagtgtaaccccgtctctactaaaaacacaaaaaattagccagacgtggtggcaggcgcctgtagtcccagctactcgggaggctgaggcaggagaatggcgttaacccgggaggcggagctggcagtgagccgagatagcgccactgcacactagcctgggtgacagagcaagactccgtctcaaaaaaaaaaaagaaaagagatgacaagattgcttccaaaattagaagacaatagaataatacctgcaaagtactaaccaaaaaacctctggctaaccaagagttcgccagtattaggccctcgttaaaaaatgaaaagacagtagaaataaataaaaataccttaataatgataaatgcaaacaaactaaatgttctcactgaaacaaaatattagactggacaaaaaataaaacccagctttatgctattgacaagagatacctaaaacataagaacacagagaaatttaaggtaaacagatgggaaaagatagaccagacaaaccctaatgataagaaaactagtgtaatatgttaagacaaaatgaaagcaaaaggcattcgggataaggcgatcactacataacaataaaatagagaaaccataatgaaaaaaatatttcacaaggaagatataaaatatatgaagcagaaaatgacaaaataacaattttctctaatccactgtcacagtttcatattttaatatatttatttgaataatagatatatctaacaaaaaattaggttgttaatgttttaaatgggcaaacaatatgaagagatggttcacataaagaactatggtttttaaacttaggaaaatgctcaacttcattcgtaataagagaatagcaaattaaaactataccaatatattattttcttactatcagattggcaaatatacaaacatttgataatccactaaactggcaaggctatgggaaaatagacattctagtgtatttctgggagtgtgtaaattgacacaacatccaacaaagggcattttggcaatatctatcaaaattacaaatgtacacattctctgactcagcaatactaaaaatttaccttataggtatacttgaagatattcaaaatgatacatgaataaaatacacacttatgggaaataacctaattgtacatctatggatgatatggtttggcagtgtccccacccaaatctcatcttgcagctcccatatttcccacgtgttgtgggaaggacccggtgggagatgattgaatcatgggggcaggtctttcctgtgctgttcttgtgataatgaatgggtctcacgagatctgatggttttaaaaatgggaattgccctgcacaagctctctttttgcctgccaccatccatgtaagatctgatttgctcctccttgccttctgccattaatgtgaggcctccccagctatgtggaactgtgagtctaattaaacttcttttttttgtaaatcgcccagtctcaggtatgcctttatcagcagcgtgaaaacagactaatatagtgggggataaattatgatatatctatacactggaagattatacagctgaggaagaaaaagaatgaggaaactctgtaacaatacggaaagatctcaagatacgctactgagtgaaaaaggtacagaaatataatatgctataatttattgggaggaaaactgggcaagaatatatatctagagtggcttatatatgcatacatatatatctggaaggatacacaaaaaaactaatagtggtggtttcttttgatgtagaaggctagaaattagggagataagggtagagtaggaggtagagtaggaggtagagtaggaggaagagttttcaccatgtacattttatatttttaaataattgagtcatgtaaatatattaccgattcaaaagttaaattagtcatttttgaaatctataaaagaaaaaatggattacataacaaaatctggctaatatgacagaattctacactaggcaattaagaggatatacacgatttccatgcacaaaacaaacatttacaaaaaatgaccacacactagaccataccccaagtctctataattaccaaagaatccatatcatgtagttctatttctgactacagagcattagccagagttcagtaacaaaaactaaaatacattttaaaacatacttttaaataactcatgagacaaagaagaaatcataatgaaaaaacaaaatatttagaactgaataatgaaagactgtatatcaaaattatgggcagcttagaggaaaatgtatagtcttaaatatccacttctttgaaaagaagactgaaaaatcattaagctaagtattaaacttaaatattggaaaaagaacattagagtaaatacaaggaaaaaggagaaaagaagagaaattattaaaacaggaaaaaatttaatagggaggataaagtgttaattaatatttttaattaccaaaatggctatgaagaaaatctgaaaacatttctatgaagtttaaattctacccactaaaaaataaaaatatatacatattttaactaccataaatattatatattgttataattatatattgtgcatgattatatttattatatttagttattagttatatatttatatatgacatataactaataaatataatcatatataatttatatgacaaataactaataaactaataagcttctattgtacctaaagagaaacatttatataaagaaacatttccatagaagagaaacatttatataaaatatatttatgtttatataaaatctaaattcttccatctcagtcttatatagtctaacttcttcaacctatcttaatataattcatcaagtaactttcagctactagacattgattgctcaagtcctactcctgatctagttcctttttgaatggtgtctattctggagggtaaattttcagctttacttaagcagcactagcacttacatcaagtactgagaagtatggtgacctatgcttctaagtgcctcagaaaatatgaccccattatgaataaattctgtacaacataaacaacaggattattctgtcaactgtatgtttttttgcgaaagagaaatagggattaaaaccatttttctggctggatgcggtggctcacacctgtaatcccagcactttgagaggctgaggcgggcagatcgctggagcccaggagttcgagaccagtgtgggcaacatgaagaaatctcgtctctacaaaaaatacaaaaattagccaggtgtggtggtgcacacctgtagtcccagctactcaggaggctgaagctggaagactgcttgaacccaggaggcggaggttgcagtgagccatgattgcaccactgcactccagcctgggcaacagagcaacagagccagaccctgtcttggaaaaaaaaaaaaaaaaaaaaaaaaaaaaaaaaaaaactctaactccaaagccattacaccaggacttgaaagattttcctaaataagttcaatttttcacaagtgattcagaaataaaaagctaaaattcagagaataagagtctactgggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagattctactgaatattttctcaaatatctctatctggcagctgccctatgagctgagaaaaaaataaaactaacatatgcaaatggtaaatattataaagttattctttaaatattttcaactgctaacaagaaataaattaactttactacatagtaacagaattaaaatataactaacctgtatgaacttcttctcctgtacactcacagtcaagcagatcatgagtaacacaatctgaactttcatgtaatgtgaacaaatttttaagttcttctactgaaaactgaatatgttcagatgtcttggtgaggtcgacaactgccccacaaagaccttgcttactgatctgcctttgatagatcttttcttctattgtacctaaagagaaaacattaattagatttccttcagatctttatgttcattatttttgttgggtataatgtttagtaacatactagttaataaaataacaatatattcctgacactgaagcacaggctaacaaaaaataattttaattattcaaagagtatacatttttgtcacactgaagggttgttacctgtagttaggagtctgtaaatatgtacaggatatttctgaccatctctccatactctagacattgcctatagaaaataagtgagaattctgagagtacagtagaaactaatggccccttccacacatgcaatttgcagaaatatgttttaaaattcggaattctatattttacatacagcttcagaaaacaaatctcaggtgtgtgaagcatgccctacttcatagctttttcttggcagaaagaaagggatgagtgaacacttactatggtactgtaaaataactacaagagtatcatgcaagagtgagagaatagatcttcatcaatgggacagtgagtatggacagcaagaatggaaagaaccaagtgtagcatgggcttggaggttcattctcagtccaaatagctaaagatttgcccctgagaactacctaggatacatgtaatcagctaaggctctaggtggatccctgtggtttaaagatttatcaatgatactgtgcattaaagtgttgatgttcaaaccctgcacatttcaaataaaaatctggccttcaaccaacttctaagagatcatctctaggcctttggaatgtcctgcctgatatgagtgtctgtttaccagacacttgggccacaccagatagtttatgctaacaatgttatatggtggggccttggatcatgtagtttgatttctggaggctaaagactgattaactaaggtcagtcatgcaggtgttccatgactacagaactgaccccaaacaaaattctggacaccaagacgtggatgaacttccctggtggacaatattctatatgcactgtcactcaccaatgccgacagaattaagtgttgtccataaaactccactggcagagaacaactggaagcttgtgcctggtctctcttggactctgccctggactcagtaccttttccttaccgctttgagtattctttactataatgtaacataactgtgagtatagctgcttttctcagttgagtccttctagtgaatcattaaacctgagggttgtcttgggatcccccaatgcacataccaactgaggtgcaaacctacaggtagaaaactcaagatacaaaaagatgggctgtactctaaagaaaaccaaaggcttctcaaacattttcctaaatatgttacttttatacccttactatagcctgcataaacactaatcatagcatctgtaactttattgtcttcacctgatggtcatgaacaccctaaaggccaactctgcagtaaactagaacctggagacatacaggtttaggtctgaatcctggctctgcatcttacaagctgtgggatctagaacaagcttctatatcttcatctgtaaaatgggactactaatatccatccttgtaggcttgttaggaggattaaacagatggaaagcacttaggagagtgcctcacgcaaaataagggctctttatgcagtggatattatatatcatcattatctttgtatcctcaataggcattgtatcctcaggcattcaataatatctatttaatgcataaatattcctacctgaatgtcagtggctggattccaatcaatgtcatagagaattaagtgagatcctccaatgaggttaagtcctacaccaccagcttttgaacttaacaaaaaaataaaaaaagaagagtgttgactgttaaagccatcaacaatctgctgcctttgagagattggtgtttgtccatcaagtcttgtataagcatatccatgacgcttacatacttcttgtaaaatgttcaaggtttgtgtatagttggataccaacaccaccctgtcaatcaaaaagaaagattctttagataaatttaaaggcagcattagattttcttagttgaaagaaaataccacaataatattatcactgacattgagagaacatgcaacaatgaccttgtacaattaaaacataggtattcctgcatattccattttaaagtcaatatctaaacttccagttttaagacagtgcggcaaagacctttctgccttcttcatctctctgaggttcactctaaaaacagcaagagaatgagcaaaatacaaaaatgaacagaaactaactctgaagatatttgaaaacaaaaaccatagtgaagcagtcacctgcttaggagtatacataaggtgatgcctacatgcccaaagagggagattccagtaagaaacaaatgaaagttcatttgcaccacagaatcttgctaaggtacctgagaaggaaggaatttagactggaactattacaacattggtacgtagaacccaggccctgctcccatgtgatcagttgacttttctttcccaaataaagtatttattatctggagaaaataaaccaaagaaacttagaccagggaactgactgtagaaggcaggagagccaatgtagtggcttatgcctgtagcccctgctactcaggaggctgaaacaggaagataacttgaatccaagagtttcagtccagcctggacaatagagcaaggccctgtcttttaaaaaaaaaaatgtgttaatgaaagtctagatactgaataagatccctctacccttttcctgccaactactagaataccagcagccaggcaccccatatgccagcccaaggaagatactactaaaggattcatctatggaaagacttaaatgattccacagaaaagatccacagatagggagtccccaaatttaaaagctagcttgctgcctgattacccaatgatgattattagtcaacgagccctgcctatccatacagtgttcaattaatgttttactgcttcactcttaactgtggacaccagggaacaccagctatttgaagtgagcttcaacatgaaaaggaaaaatcaaaataaacaaacctgaattaaacaaagcaatgaaaaaaaacagaagaaaactttccgaaaataatttatgtcctcaaacaagagctatctatccttcaatggaagaggatgcaatttttcaaaaggaacaatcaagaattagaaaaatatcttagaaatgtaaaatgatagacaaagttttaacaggagagctggaagataatagtacgagagtttgacaggaaatacattaagaagaaaaagtgatgaccaataggagagaaaaaaaagaattagagaatcaattcatgaggttcaatatctgactgacaggaattccaaagaaaacaagaaattgttttaagagaaaggccgggcgcggtggctcaagcctgtaatcccagcacttcaggaggccgaggtgggcggatcacaaggtcagaagatagagaccatcctggctaacacggtgaaaccccgtctctactaaaaatacaaaaaaattagtcgggcatggtggtgggcgcctgtagtcccagctactccggaggctgaagcaggagaatggcgtgaacctgggaggcggagcttgcagtgagccgagatcgcgccactgcactccagcctgggcgacagagcaagactccctctcaaaaaaaaaaaaaaaaagagagcgagaaaggatatctcccagacatggagtcttcagataaaaaggacctactaaaaagttcccagctcaattaatgaggactcatattaaggtatatcaagattataactcaaagtatgaagaatgaataaaagttgatcaatttttgatgaagaaaaataggtcatatgcaaatgaatcgaaatttgaaaatcatcggacttctcaaaagcaactaaaaactagaaaacaacatgtaaagcaatgtcttcaaaattctaggggaatactattttgatctagaagtttatgacaagggaagttgtcagtcaagtgctagtgtagaataaagacagtttcagatgtacaagaagtcaaaaagattaatctcccatctttcttaggaaactactgtgagatgtgctccagcaaaatgtgaaattcagaaaacagaaaatccaacacagaagaggaaaaaaatgaatttataagttaatatgatttggctctgtgtctccacccaaatctcatctcgaattacaatctccagaacccccatttgttcagggagggaccaggtgggaggtgactaaatcacgggggcggtttcctgcatgctgttctcgtgatagggagtgagttctcacgagatctgctggttttataaggcagttttccctgctcttgctagctctctctttcctgctactctgtgaagaaggtctttgcttcccctttgccttctgccatgattataagtttcctgaggccttcccagccatgtggaactgtgagtcaattaaacctctttcctttataaattacccagtctcaggtatttctttatagcagtgtgaaaacggactaatgcataggtgatggctttttaaaagtcccaggatgccgggcactgtggctcacacctgtaatcccagcactttgggaggccaaggggggtgggtcacctgaggtcaggagtttgagaccaacctgggcaacatggtgaaactccatctctactaaaaataaaaaaaattagcatccccctgtaatttcagctactcgagaggccaaagcacgagaattgcttgaacccaggaagcagaggttggagtgagctgagatcacgccactgcactccagcttgggcaacagagcaagactccatctcaaaaaaaaaaaaaaaaaaagccccaagatgacagctatgtagcaagattagagatcagttcaaattgtagcaggaagacagaggactcacagaggaaagacaaagaaaatacagaggcacctagagaccacagtggtaccccattatctgcagatctgctttccactgtttcagttacctgcggtcaacctcggttcaaaaatattacacacagtaaggtattttgagaaagaaagagaggatgcacattcacataactttcactacagtatactgttatgattgttctattattagttattgttgttaatctcttactgtgcctaatttataactttatcactggtatgaatatacatgaaaaaacaaaatccatatagggcttggtagtatctgtggtttcaggcatccattcctggtcttggaaggtattcccaaggataagatggggattcccaaggataagatagccaaaaagcacattaaaaggtgctcgatatcactaatcattagagaaatgcaaatcaaaactacaatgatatcccacctcccatccactaggatgactattatcaaaaaaatagaaagtaacaaagttggtaaggagatagagcaatttgaaccctgtgcactgttggtggaaatgaaaatggtgcagtcctctatgaaaaacagtatggcagtacttcaaaatattaaaaatagaattaccatatgatgcaacaattccacttctggatttatatccaaaagaatttaatgggtgcagcaaaccaacatggcacatgtatacatatgtaacaaacctgcacattgtgcacatgtaccctagaacttagaatataataaaaatatatctataaattaaaaaaaaagaattcaaagcagggttttgaaaagttatttgcacacccatgttcacagcaacattattcacaagagccaaaaagtagagacaacccaagtgttcagcaatagatgaatggataaacaaaatgtggtatatacatacaatggaatattgtttagccttaaaaaggaaggaaattctgacacatgctacaacatggataaacctggaggacattatgttaagtgaaattggtcagtaaaataaagaaagaaaaactatatgattccatttatatgaggtatctggaatagtcagagtcagagagtagaagggtagtccaggtgttaagggaggggaaaataaggagttggtgtttaatagatttcagttttgtttgcaaaactgaaatagtatttcagttttgtttgcaagatgcaaagagttctgaacattggttgcaccaggatgtgaatgtacttaacactacagaattatacataaaaaaatggttaaaatggtaactctatgttatgtctatattaccacaatttttttttaaagaaaaggcgatctcttcagataatgtgaagcaacagaacaaagacccagcctgtgccacttatgaaagtgtagcttctccttcaatgcaacatggcagggtttaggtttcttaaggacccacaaggagtcaaatgaccatcacacctataatcccaacactttgggagactgaggtacgcagattgcttgaactcaggagttaagagaccagcctgggcaacatggtgaaacaccgtctctacaaaaatacaaaaattagcagggcttgatagcacattcctgtaatcccagctacatgggaagctgaagtgggaggatcacttgggcctgggaggtcaaggctgcagtgggctgaggtcacaccactgcactccggcctgtgccccagagtgagaccctatctcaagataaagagaaaagaccaccccaacttcaatccccaaatattacttttatttttcttaatcattatatttttcttcattcctttcttccttcttgccacaagagggaaactttcccctatgacatcttcaaagataaattctcacatctatattcaaactgtatctcttctcatttcttccaaaactcttttcactcattatcctttgtccaatgacagccacctatcccgcccacccttcagagaaaaaaaaaagtccagttaaaaaaaaaaagataataagatatgaatagaagctaaagtgaaagtttgcactcttaaactgggtcacaatctgcatatgtacatctcacatgcccttttgcacatagcaaatattatctaataaaacatgtgagaagagctccattagaggtaggtacaggatgctatggagtacagaggaggggagtctaactcaatctgagataggagaaagcatgagagctgagtcttgttgttgttgttgttattttgtagaaaaggggtctcactctatcacctaggctggcctccgatgcctggcctcgagcaatcctcccaccttggtctcccagagtgctgggattataggtataaacaattgcacttggtctgttgagctgaggcttaacaaagagaaaaagttggccagaagaatgagaagcagaggtaagccagccacagaaacctgcaacatgtaagagcagagcagaagtggggcaaattacaggctctgcaggtggtttggtatgactggaccacatggtatgtgtgaaggagtgatgagagatgaggctggaaaaggaggcattaaccatgtcatgaagggtcctgcctaatgtgctaaagaatttagaaatttctggaagacaagtgggagtcttcaaatgattttttaagaaaaggagtgacaagttcatatttatattttagaaatataattcagggcaatgttgagtatgtcagggggctgaaagtaagagggaagtagcttataagagatcatcataacccaaatcagtaattttaagaatcaaaacaaaaatcttggtaccagaaaaatgaggatggattcttgaaattaaaaaataaaatcaatagaatttagtgactgacactgtgggataaataaagaagaaaagtgagtctataataatttccagggtttttgcttgcattatggtaccaaggaataatgggacaagatgaggcttacaataacaaaatgatggttttgtcacatggttttggacctgggaagtttgaagtactataggacatcaagatagatttagatgtccattcaacacttaaaaataaagatgtagaaattagaagagaggactgaactagagatataaatttgtttcaatattatatgtgtttggtatccaagaagatataaaatatatatagtcatcacacacacacactggaccacatggtatggttgtgtgtgtgtgtgtgtgcatgtgtgtgtgcaatagttgaaagtacagggagtatagcactcaggaagtgtgttaagagtgagaaagttaaagagaaaatcctaaggtgtatcagtatttaagaaacagtaaaagaagaaaggattctgaagaaaattgagaaacaagcattatatatcagaaaatatcactaggtttttaaaagtatacatatgtttagtttttcttaaaacttacagacacattgttaattacaagtttatgaaatactagaagctaaccatattcccaaagaagaaaataacttatttttaatgttttcttattttaaaagggaagtaggaagtaaagaaatagtgcaaactaaaactctatgagcacttataagtttgttaaatcgatcttacttttcagtaggtcgaagttcgtggataaccgctaagagcttggacaacacctgtagttttcctgactccttttcagtaaacaggagagggttgtagtcagcaggaaacacacttagcaagcctttgtatagactcttttcttcatttttatcacaagttgagctacattccttttcctattcaaaatgatgattgttaatgctggctcaagtttgtttttttaattaggaggggaaaatgctaaaattatggaaggaaaaaggtgaagattaacggctatctgaaaagtccaagaaactgttaggtaaatctttataggtcatgatttgatcattttttaaaaaagtaacatgccttctactgagttagttacagagcagttctaacgcagtctcatgcctgctaccttcaccctgcaagtgtagtattaatatttcccacatgtaactacaggaagtaggagcagacaaagaaaggagagagaaataaagggcaaatggtgatacaaaatccatcctctccaaaaccctaacattttgcatctttgatacatctttttctcttttcctctctccttccctccctgttagtattctctactgaattgtgggcttcatacaacacctttacatccaaaaacaagcactatcgtttacttaatcttaccagtttcttctgtaagaaggaagaatttcaccaataaattaacagagaaatttattcttacttacaacaatactttttatttcaccaatagttgtagaataaatttattccaaggtgattatcagcacctctgaaattccccctccaaaactgcctagctgatatgtgaacatataactagagatcagagatattcatgactacatcactttttgggttaaattcctaggattggcaggtctcttaactctctcccatatttaccagatttatcactgtttttgaaactttgttcaacctaaaccccttgtctggaatacttttttattttgctgctcaattatcccaatcctataaacacttgaggacccagtgcaaattatacctgattattcatagcctttgtttgcactgagttttaacctttatggttacacagtacatttcaggtttgactttatctaattgagcagttaatgatatgcagttgacccttgaacacatgggtttgaactacgcaagtctacttatatgcagattttctcccatctctgccaccacccctgatacagcaaggccaacccctcctctgcctcctctcctcttagcctactcaatgtgaagagctttgtgaggatctacttccacttactgaataataaatatattttctcttcttcattcttttcttaataacattttctttttatagcttactttagtgtaaaaatacagtatataatatacaaaatatgtgtgaactgacttaatgctactggtaaggcttctggtcaacagtaggctattcgtagttcagttttgggggagtcaaaagtcatacaagttataaagggattttcaacagcacacacaggggtcagcccccctaaccccagggttgtttaagatcgaatgacttttttttatacttcacaaatgttttcctgtgtgttgcaccccctctttagtaatactagaaacactttaagggcagtgaatcctatgtgaaatgtataaaaatgctgggcacagagtactaattttaatttggcttactgtcaaaatacagcaatatttaggtgtagtcatttgattaaaaatactaggaactctaaaatatttctatcactgggacatatgaggagaaagaagtagctgctggctgctttaggttagctctgcctacaacttggaaagatcatcaaaggaccacaggcccagggtctagtatacagtttttcatcttcagaaacttgaatatgcttaagctctagggaaattattcatattaaccaaattaagagactgaataagtcagaatgaaaatgtattgacctatgagacctgcctatttagaccaatcagtctatgcacgtgcattctgtcctatgaaagaacgtccccagggaaagtcaaaccactaacagaaggtgtctggtgaatattaaatcagagtacagggagatgggtgatcttttctttttttaaagagacagggcctcattatgttgcccagactggtctcgaactcttggcctcaagcaattctcccacctcagcctcgcaaagtgctgggattataggcgtgagccaccgccctggccaagacgggcgatcttaatgcacaagttcttaaccaagaacacgtattagaatcacttgaaaaggcttttttaaaaatgctcatgcctgggtcctactctcaaacaaactctgaattaatccatatgtgttgaggcctggactaatgtaattttaagagcttcccaggatattataatatgtaccactaattaataattgaccaatagataatatctttatactgtgacagcctgatgcagcatctccatcatagagatttaccagtttgacttctcatctcaagctaatcgcgacactatctcttctgactccatgtacacttcaattatgagttatgatattgttactggttacgttccactcacatttcctaaagaaagacctaacatcttaattgaacttgggaaacaatttagtttcaatagaaacatagttacaagccattgcttaaaggttatttatacatgtagaaggctcatttctgcccttttatatcaatccttatttgctatgaagttagagaaaaggcttttctgaataaatatcagactataaattatgtaccctatttgaagtatcctatgcctattattagtgactgcatggcaacaatggagaaacactcagagccccctgctgctttcttcaagaatgtacaaacatattctaaattaactggtatactctgggccatcataaggtcttccttttaatgaagaaatttttggctatttttaccgtgcttcatgcccaaagggtttgatttttatcactgtatatagaatcagttttttttaagttgcggctgggcgcagtggctcacacctgtaatctcagcactttgggaggctgaggtgggaggatcacttgagctcaggagttcgagaccagcctgggcaatagagtgagaccccatctctattttttaaaaaataaatatttttaaaaaaaataaataaaaagggccaggtgcggtggctcaagcctgtaatcccagcactttgggaggtcgaggcaggcagatcacctgaggtcaggagttcgagaccagcctggccaacatggtaaaaccccgtctctactaaaaatacaaaaattagctgggtgtggtggcaggcgcctgtaatcccagctactcgggaggctgaggcaggagaatcgcttgaacgtgggaggtggaggttgcagtgagccaagatcatgccattgcactccagcctgggggacaagaacaagacttcatctcaaaaaataaataaataaacaaataaataaacagcatcactaagtttctccagaataagattatatatatatagattatatatagagattttatatataatatatatacatatatacatatatatctgagcccctatttcctcaccaaaaaaatggggatggtaatactagtacttattccagagttttgtaaataataaataaaataacactaataaagcacttagtgattggtacaggttgaccatcctttatccaaaatacttgggaacagaagtggttcagatttcagattttttcagattttggaatatttgcatcttgggcatgggctgcaagtctaaacacgaaattcatttatatttcatatataccttatacacatagcctgaaggtaattttatacagtatttttaataactttgtgcatgaaacaaagtctgtgcgcacttaacatcagaaagcaaagatgtcaggtatggaatttcccacctgtgatgtcatgttggcactcaaaaagttttgaattttggagcattttgaatttctaatttccagattaggaatgctcaacctgtatataattagtgcttaataactgttagctaatattattaataccaaaatgtgattttccatgggttgagcttaagatgatttttattttctttgtgattttctgaattttctaaattttatgcacaatcatgtatcactttcaaaatgagaaaaaaataaattatttttaatggcacattttgtatttgtcagcaccaaacaaacaaaactgacagactatattaacataaaataggaagggagacgatcgccaagtattagataaggtgccaaaggggattgggcacaaactatagaaggcagtacctcaaactcatctcttccctacttcagctctaggagtgtggacatgctctgaagaacaaatgaaaggctggataagctctacagcagaaccatactagatagccagcagagctttttgaaaacccacaaatgcaacctcagaaattagccctgtctgccctcttagattcatatactatagaaccctcatatccctgacacagtttcagatactatgcacttacctttatagagttgaacaaaaggcaggggtgattgcacagttttttaagagctcctatacatattagatggggactattttccaacaacccttgaaggcagaacctgacaacctgagaatttaacagctttcgataaagctcaatctgtagtgctcctggtcggcaaaagacaacattctctattttaggtgggagatatttatttataatttcttgggttcttctaaggataaagagtccagtgaggcaagtaagttcagctgctcttctttctcctaactccttttcttcctatggaaaaatagcagacttaaatgaaagtgttatagacaaaaatacacttaaaatgaacattaaagatttcataatgataaaccatttactcattgcttcccaacaaattttaaaagaaataaaatatgagtatagggacagaaaaaccaaccatgatctatttatatgtttagcataaccatttaattaagtgaagtcacagtctcctaaataacaaaataatgatatatcctataattggtagaatcttagagtcaatgaaatatagtctgtatacaacacgtagaccataatttaaccattgtcctacctttaaaaatgtttgtttcccatttgtgtttcctttagtttgcttcttttttgttgttgttgtttttgagacagagtcctgctctatcacccaggctggagtgcagtggcacgatctcggctcactgcaacctccacctcccgggttcaagggaacctcttgcctcagcctcctgagtagctgggattacaggcacacaccactatatctggcgaatttttatatttttagtaaagatggggtttcaccatgtcggccaggctgatcttaaactcctgacatcaagtgatccacctgcctcagcctcccaaagtgctgggattacaggcatgagccactgtgcccagccagtttctaattttttacccttacagctaagtttttatttcgttttatttttttgaaacagagtctcactctgtcgcccagggctggagtgcagtgatgtgatctcagctcactacaacctccacctcccaggctcaagcaatcctcccacctcagcctcccaagtagctgggaccacaggtacatgccaccacacctggctgatttttttttttttttttttttttggtagacataaggtcaccctataccctatagctaagtttttaattttttagttttgttttttttttttgagatggagtttcactctgtcaccaggctaaagtgcagtggcatgatctcagctcactgcaacctctgcctcccgggttcaagtgattctcctgagtagctgggactacaggcatgtgccaccatgcccagctaatttttgtatttttagtagagacggggtttcaccatgttggccaggatggtctcgatctcttgacctagtgatccacccacctcagcctcccaaagtgctgggattacaggaatgagccaccacacccagccagctaagtttttaaataaatgtacttttttttataataaattcataaaaggagtattgccaggccacaagatatacacaattttaatgcttttgatatacattgccaaactttccccaagttgtgccaacgtacattccaaccaacaatttacattccaaataggagactcttgtctacacttgctactactagtaaatccaagttggggaggtggtatacacctgcagtcccagctactcgggaggctgaggcaaaaggatactccaggagttcaaggccagactgggcaacgcagagtgacaccatctctaaataaacaaacacacaccaatagaaaagtacaaaagtcactttggttattttgttctacttttttcaaaactagtaaagatgaacatttttatatgtttattgtcataattctttgtgaagttcctattcatgaattttagacaagtgatgtcatattctaaaataaggaatgcaagaaacgaaggattgtggagaaaaataaagagttcacactattgatttttctaaatcaaaataatatgaagttatggatgatttcctcagacatacggctttttaaaaacctatttattagagtaaattatacctcagaagcagaaggttctctcgataaaatgatgggttcttcatatattttcctataagatgacaaagagcctaatattcctggatttacaaaatcaattaatgcaaaaaattcttgcagatcattctgaattggagtacctaaagagagacaaaaatgagtaaaaggtcaagtttgtgttttacaatcacaatctcaggtttatagcaaaaccacaatggaagtttggagaaatttattccctaaaaggaataaatacaagcaaattgcctaaaactaagaaagagcagtcaaagcaagttaaaacatattaatcaccacataaacttttaactctggttttaattgcatactaagttcttacatagtagtatagcatagagactgagtgcaggctcagtggagtctgactgcttaggttcaaatcctacctgcatcacttactccctgagtgaccctgagaaagttatttacaccagtttattttctgtaaaatgcagataataacagtcgttcctagggttgtgaggatcaaagtagtcaatccatataatatactttgaatggtgcctacagcataataaatgttctataactttagtaattttactgttattatagctgtgtgactttggacaaactgcttaagtcctttaaactcagaattttttttttcatttataaacgtataaagataataaattcccagaataattataatggaaagtagagacaatggatatgaagtacccagcaaaatgcctgacactcagtagacactcattgaatggcacctattattactacctttcaaagttatcagatcaaattaagatcttcaccatccaaagggttaatacagactgtaatggattcatataccttctatatattacatatagtatgcaatagctttaggctaattttcaaagaaacattagcatgtttcaataattataatagtgccaaaagaacatataaatcagcacaaacaatgtaatatcagatggctttcaaataagagattagaaaatgttgtccaaagatataaataatgtgaaaagtaaataaaaatgcatttatttcattaagatagatgacataacttttttaatgtcaaggaatttaataatcacctccctaaaacttaatgggtcctccccacccccaggttggaccagcaattgctaatttttttaaatttaacacatctagtcagttttaaatttttagacacatcattgaaagagttgggaaaaatacatttatgttggtatatattcagttaagcctctaaaagaatatgcatgatgatgacaaagattggggagtataggaaagacgagaaagaacggtagaaggatcactgtggttggctttcagacattcatcaaaccccaaatgattaagtcaatcatggtaattctgtcccctcctttgcaaatgactgacatactcaagggttcttgtctcatactgcgttcactggaagcagagcctaagacagtgatttgtttgcatgtgatttacagagggagagctctcaggagaaagggaataatggaatcagaaaatggtaggggaagaaactaagcaagaatggcctcagctataatttagcttgagctaaattacagggagctctagagcataaactgcaccataacgttggtcctgaaatcactctaaggcaagggagctgccatttgctgcttacccctaaatcagtcagtcgttgattgcaaactatagaggagaatacagctctcattcaatcaaagataattctccagaaaaggaaggggttctaagttgtttaatcaatagtaccagcagctaaaggatggatacaacagcccagaaaaggagagctagaaagggcaccaagaagttccatcagtagcatgtgactcatcctggccaatgagacatgagaagtcatcacagaggggctttgaggaaagtccctcttaaacacagagaaacaagaagagccagtcctgttctcctttggatatcatcacatctagctgtgatgtctggaactgctgcagtcacttgctaccagcctgaggatgaagccaacaccaaatatggcagagcagaagacataaccagaatccttgatgacaacgttgggttgttgtagcctggcctacctttagacttccagttatatgggggaataagcacatctgattcagatcatctgttaccagcatctgaaatcatcccaactgatatacaaagggaagaggcaagaacaaaactggacaaaagaagaaaagcagaacacaagaagggaataggaaaaaggatttagggcagaaaagaagaaggaaaaagagtaaggaaggggggaaaaagatgagaaggggaatatggctacaagacagaaccaattgtatagtatagcatcattgtaagagtttgtcacattgctttctagtggtaatttagatccccatttgctatttcagtgctctaattctagactaggtaaaacctgtagaagaaaaaaaaaaaactaaagattttcaagtcaagttggtgtacttactaagactattttcaagagtatgggaaagaaacttctgagaaaatgaaaggactctttcttttccctacctccaccctatccctacaaaaaaaaaaaagctttttctttgttttttggtttgtttttttaaaaaagaaataaatctaccacccaacccaacactgtcaataacctacacctatatcctcctgtaacctccacagaaagctctgagagctttttatacacatttatatttttccttttaatcctataagcccacttctaggaatctatacacaaagagtatatgcttgtagatattcatcaccacattatttataacagtaaagaattaatctcagatttatcttttctatgatataatgaaagggcattgaagatcttataataatcattcagctcttaattgtgggctgaactgtatctccctaaaattcctatgttgaagctctaacccccaatgtgactgtttttggagataggacctttaagaaggcagttaaggttaaatgaggtcctaaggatggggccctaatccaatatgactggtgtccttctaagaagagagagagatactccacgaatacatttgcagagaggatagagtacatgaggacatagggagaaggcagctctctgcaagccaagcagggagacctcaatagaaaccaaacctgctgacatcttgatcttggacttccagtctcgagaactgtgagaaaataaatgtctgttgtttagtctgtggtcttttgctatggcagtgctacaagactaatacccctctatcaatcaaactgaatcctaaccattttccagtaaatattaactccacagcactgggctagataatatgaggaaacaaaatcaaaattattttcatttgattcttagttattgagcacctatcatgtatatatcactgtacatactcctatacaaacatgtactttcataataaggaacaaatcatcttggggtaaaacgtcctgcccataaaagcaaagacttcattcaggcaattctaagaatacagaaaccaactatgagtatttctaaattaaaaaggttagttagggctagtttttacctaaattcatagctcaggggataagagtgataaggacagcaaaacagaaacaagctaagattgacaaaggatacagaggacaatactaatgcctcaaatgaaacaatctcactggttgctatcaagacattcttgttgaatgaaatcctagatcaattttctactgcagattaaatttaatttggaatgttaaattagtatttgcttatcattgagtatatcaataaaattatatatttttgctacagaaaattatgattttcaagtgaggaagggaactacttttatttcttatcttcagtacttttcagtatattttatttctcactcttcttttttatttatttttcttctcccttctagtgctaaacatttttactttatatctgcaactattctttaaataagcaatactgacccccatccttaagcagtaagaagaaacagtctttttctcttctaactcagtgttactaaattcagctaactcattttttttttcattacttttctggctccagtgatctcaagatcaaaggccagtaaagaaatctgaactgcagcactggaaatcaagtataacgaatccactcagcttctcaaacagccaaagatatgaaaatcattcagagtatggttcctatttccctgactcattttttcctttaaaaatggcattttataaatattcaacactagttttcctattctttggtttccacttcactattactgacaaacattcattgggcatccagaaaatcttgggggtataactatgaaatttgaccctagtccttttgtctttatcatcgtgattaaattcaaaaaataaaaaggtcatttagcatttcccaaaatcatttttttaaagcacagatcattttaaaaatcgcttttgataatggttaatacaatcctcctatacaaattggaagtcaaatcatgaggaatttcttaaaggtggatagtcttccccaccccaacacagtaagaacagaagaggaggagttttctcctctctgttgttctggggcatatttccaccctatcagtataggaaggaggtacaagtttttggtcatactccttctctctcttcatttaacttcagagagctgtgacatgcataaacgacacatgaaggaaaaaatgacgatgacacagtaagaataatcatatcctgaccattccttccaaaagggctgaagatggtagggaaaatgaagccccaagtagaaaataggggaattgtaaatattagtaatgaatacaattctcttctttattctgctgacacaacggcaaagtggaagggccatacaagaccaagatgagatatgggagaaaagctacattgagctacttagatcatactccagtctaggccttaaataaaaaggtagaagaggattctcgtatttaccatccattccacctttccagacagttgggtccagaagctctgtccaacaataaaccatgcatatgtagcatatacatataaaaataactgatatttatattaaacacttaccacatgtcaggtagttataaataactgatattaaacacttaccacgtgtcaggtagtttcccaagaactttacattgattaactcctctgaccctcatgagaactctacaaagttagatggtattatcattcctattttagagatttaaaaaaactgaggcacagagacactaaataatttgctccaagttgtacagctatgtcagactcgggaaccaagcacaagcaatccagtctgatctcctaaattccttatcatgatatcattgtgtttattcctaaaaaactccaaagtctgggctacagaaaattacacatggatttgaagattcagaatcctaccaagagttaattaacacaggtttattagtataaattccatccaacaccaccagttatttgaatgttaagcatcatagtacaagtctgtatgttcactaggcaaaaattccaaaatatcttccccaaactgaatactgaccagttagaattattcttttctcacaagaaaggctaatgagggctgtagttgtcttaatggcactgttcttcaaacgatgcccctcgtcacagattagaagatcaaattttatattcttaatttgatccagggaacgaagtaacatttcataactgataataagaacagaataaaatatagacttgatgaattcttcaactttgtggtcctgaggaaaaaagatagtattttaaaaatcaggaacagaaactatatgaaatcaaatttaagcagcctattcctgacagtcacttactaagaactggaatgtgttaactctttctgtcttagtcaactgaggctgctataaacaaaataccatagattgggtggcttaaacaacagacatttatttctcacagttctggtggaaggtctaagatcagggtgctagcatggttgggttctggtgagagccctcttcctggcttgcagaagaatgctttttactgtatcctcacatggtaaagaaaggaagttctggtgtctcttgctctggttacggaggcactaatctcatcacgtggctctaccctcacgacctcatttaaacctaactacctcccaagcccacctcctaatactgctatattgaaagttagggtttcaacatatgaatctgggggacacaaacattcagtccataacaactcaaaaccaaaatgtaagctaaaactccatttttgtgcaaaagggttagggagttaacaagtaaaaactgaattactgatttgaaaaactagattttttttaaatgactaaggctaaacttttaagtttcttacctgatcaacagtaaatatcttgatcctttcacttcctagccatttttgaaattctttcttccaattattcaccaagcttccaggtgtgacaattagtgtcttctttattactggcttgcctccatagggtccctgacactgcagggtccagatgagcgaaatacattgcaatgtcttccctaaacccatttcatcagcaagaatagctccacatctgccattcattctgttagaaataattttacttcctttaatcacaatagaaaaatattttatgctcttaaaatcatcaagaaccagaaactgatattttgtaatgacactgaagacttttagtacttcattagctgatttacaacacatcttttgcatctttgataattatatccattacatattgtcaactaaattaccaaaacataaatctgaaattagagagttgaatctaaatcatctgctactattacatgtacatatttagaggctagaaatgaattccaattttatatctgcatatggataatttaactataactgtgtttctcatcactaagagttgagtgatttttattggtttcagatatcaaaacagtttaaaatatattgttgtattatatttaatcagcaagatctactgagctgtattttatgattctgtcagtaaatgaagtcctcaacaaaaatagctccctgcatcataaaaaaattaaacactaaacacttgatataatacatataatttagtaaaagttgttatcctacagacctactgttatataatttaaaattaaatgttattagagatattattagtaagaccatgtatttttatgccactttatatttttaaagaccttagaagtgtatgttttatatttttaaagttaagaaagtccaagggaattaaggatattaccaaaatacataagtatacagttgaccactgaacaagaagggtttgaactgtgaaagtccacttatatatgggtttttttcaataaatgttataaatgagtgtgcctacctctcttgcctcccttctatctcctccacctcttccgccacctctgccactcctgagacaaccaaaccaacccttcctcttcctcctcttcctcagcctactcaacatgataaggatgaagagctttatgatgatccatttcctcttaatgaatagtaaatacattttctcttccttatggttttcttcatgctttcttttttctggctttcttgtaaaaatacagtatataatacatatatgaaattatgtgtaaattgagtgtttatgttatcagtaaggcttccagtcaacggtagtttattagttaagtttctgcaaaagttatatgcagatttttgactacacagtgggtcagcacccctaactcctgagttgttcaagagtcaactgtagtttgtcagttaattgtatttcttcttagtagaaattaagaaccaatatgcaattttatatatgtgttccatttcaaggtatagagaaaaaaattaccaacataaattacggctactatttaggtggctgttttagatcaatactttggcaacaaaggaccaaatgtcagcccaatgagatacagtgaatagcaaagagaaaatccagattcatcctttcacgataaagagaagggagcaaacaggaagcctttatggagatgtaccttgagcaaaattgtaaagggtaaataattactacactaattaggcagctgaatatagttggagcttgaactgaaaaatatgaagctagcacggcaggtagaagacaaaagatgaggatacttaaccttgagagtttagactgtatcttatatatcagcatctcccaaacaccagtatttcatgactaccatcacgatttgttgtcatatctgtgatactatatgttatttatgatttttcttcaaatcattttaacttaaatttgaaaagaaaactctttctaagcataatttatctgtgaaaccaaaagtttaatgtgctatttttcttttttttttttttcctctccagacggagtcttgctctgtcatccaggctggagtgcagtggcgctatcttggctcactgcaacctccgcctcctggattcaagtgattctcctgcctcagcctcctgagtagctaggattataggtgcctgccaccacacccagctaatttttgtatttttagtagagacgggatttcaccatgttagccaggctagtcttgaactcctgacctcaagtgatccgcctgccttggcctccgaaaatgctgggattacaggtgtaagccaccatgcccagcctatttttccaataattaactaaatatgctactattcaaatttttttaaaggcttgtccacttgccacctcaaaatggtcccatatactgccagtggagtagggatcacagtttgggaaacactgttctaagttctgagagtctctgaatgattttaaataagggaatgccatgttcagaactgtttttcagaaaactcaagatggtggctttaagtagaatacattatttgagaagcatcagaagcaaatatacaggttagaagccattgcaatagtctagataaaatatgatatttttatgacatcggttactagagatgctgcagtggaatgacagaaaagattaggaaacaatatttaggaggttaaaataattaaaagttcaggtttgactagattcagaatgtgagagagaagaaatcaaagatgattcacagaccaactgagataagaccttcgaaagaaaaagcagatttgggaggaaatatgagtctagttaacagtttctggaagacagtattcccttaacttgtcatcattcaaggagttcttagagttggggagaatttcatttccaactacctttaaaggacaaattttaaaatcaagggtcttggcatttaaaaacaaggcaaaacaaaaccaaaacaaataaacaaaaaagactggaagaaatgttagcaggggcctttgattctttttttctcctgtttttttgtgtcctctaaaatatctttaagatactactattctttaatcagaaaatgcaaaaaggaagaagaaacttttttctattttcagatgtagagacagaagaaaatctttttccaaaattctcataaccaggtgcagtggctcatgcctgtaatcctagcactttgggaggctgaggtgggtggatctcttgaggtcaagagttcaagaccagcctggccaacatggtgaaaccccgtctctactaaaaatacaaaaattagccaggcatggtggagcacgcctgtaatcctagctactcaggaggctgagatgcaagaatcacttgaacttgggagatggagattgcagtgagccaagataacgccattgcactccagtctgggcaacatagtaagactccgtctccaaaaaaaaaaaaaaattcttataaccagaattaaaagcctctttcacttgctcttatgaccctttaccacactagcagtcggtaagcttttattataccacattaaggtcaattgcatttatctgtttactcaaatactttaaaagccacttaaaagtaaggaccgtggtcctgattcccatatgcccacctcctagcagtatgtttggcacgtggcatctatcaagaaccacttttggaataaatgcacacagtaagcactattcacctttcctaccaattgaaattcatagtgtaccctcaggactcattatattaggatcttcttagaaaaccattattgtgttacaggttaaatcaaaattcagattagattaaacaaatgatttattttcctacctcattcccattacacattcataaaggaatatgattccttctttctgatgtggtcgaagatgatatacaaggtaaggatcaatcactacatccacaagagggaaacagttcttattgaatacccactggtgattcttatctggtcgtggcataacgagggaatcttaaaaaatgataaaagtacaagtattgtaatttcactttttcagcaaccaacattatcttgttttcattaccctaagatagaaatgtttgccatcatttgtggccaaaaaagtccaaaatttagtcacagtaatgttacccaagggcacaaaatttaaaaagaaaatctcatgccttactgatgaacgatttcatgcaaagaattacgaagagccttccaaacttcatatacccaaaagtgcttcgaaagcaatgaaattcactattgtctagtaaggaattcaataagccacaacattgaatagttcagtattcagagcaaagagaactatttccaactgaaagtacaggttggaattttgccaagatgcatttgccaatgttcacagcttctcattctgaaaagtctccccaaatttaacatacaggctttctatcttttcagtcctaaacacactaacaatgatcattactcctattaattagaactgagaaaaaatgataaattctccattgacttagccaccattatttgcttgaagttaattactacattcatgaatgtcaagttcataaagcttttttttctggggacagagtatcactctgttgcccagggtggagtgcagtggtgtgatctcagctcactgcaacctccgcctcccaggttcaagcaattctcgtgcctcagcctcccaagtacctgggattacaggttcgcgccaccacacccggctaatttttgtatttttaacagaggcaaggtttcaccatgttagccaggctggtcacgaactcctgacctcaagtgatctgcccacctcagcctcccaaagtgctgggattaaaggcatgagccactgcacccagcctcatgaacctctttaaagcagcatgaagtcatcatagaataacaatgtaattcttcaaaactatgctaacacaatttaaaagatttactaaaatatcacccaaaaaggcaaaatcaaatataactagaaggcaggtctcaattgataaatctgaaattagataataaacccaccaaaattattttggggatatatttgcatgcctacatcatgtttataaaaattgaattagataaaaaaagaaaaaagaatgaggagatgagaagaggagataaaaagaaatagactccagtagactatgtaaatattcatcagtgtggaactatactgtcacaggaataagagtttagtcatgtttaccattaacaaatacccagagggtaagttttctctggatcttcctaggtttctgagtaactgaaatgaactttcatctttgaggtcaattcctgttaggtaggagactaggaagtaaaaatgggaaatgtagtccttggctttcctctatatcactgtagcaaagtaagagtgtgctccttgtggatttccagtcaagaaatggccccgttatttttctatcttttaaaaaggacaacaaggaaaaagagaagatagaggtgaaaaatcacatactgcccaagcaaaaaggactataggattataaatcacctaataaaaggcccatcttcaagaaagagaaacctaaacagtcaaaatcatagaacactagttcaaattttaagatgtttctttatcttcacaatgatgaagacgatcatttaatattaacaacatgtctgaggcattaaagtctacaacctaattctatccttggctaagataaatacataagaataattaaccatttactatttacctgaagtgcttttacacacacacacacacacacacacatatatataaaattcacatgtacacatatatatacatttacatcacatacacacaacacataaatgccacaataaaatgtttcattcactcactcaacaagtatttcctggaaagagtatatactagacactctaaatctctacggtggttattaggacccacgttttacacatgagtaggcaaaacattaggaaggttagtgactacccccaagaggtcaaagaaccagttagttcagtggcaaaaccatgattcttactcagatctctgaataagcacagtattcttttcagttccccacagccctgtattgtgtaatagtaaaagtacaaagagaaaggagaataaagaggagggggattgttaaaagagctggtgggacagacaaaatatttggacaaaaagagaaaattcagctgcatcagcttccactgcctgtatttcaactaagtctttgggataagctaatatagaactcagaatttttaattgtggggttttgtcccaataatgccgttgattatttgtatttaggtaagtcggttcatcttcctgggcctcagttttctccaatgcaaagtgaagagacgaatctaaatgatctcaaaggcctctttacttcaaaacttatgtttccataatacttgcaatggggaaaaataatcattactttatatacttgctgttgtgaggaaagaagtcacctctatgtctcaactttcacatctactacactatactttgattcggattacttgtccttcccctcaccaaatgagaagctctgtgatgacagttttatctttaggcccaacccataaaaggcaatcaagaaatacctgctgagtgaacagtcaaaagaacaatcagatacaatctaggtttctttttttttaatgtgatttttaaaattgcattcatcagtgtgaaaattaactgattgaatggaactttcactagtaaaatttggactttgcatgaaatcttaccattcaatatttttacacactaatgcttgtgatcaaggcatacagtcctcaaattagaagtataatcatagtccagattaatacatttactaatttctctccttactaaaaagtcagattttattcaaaattatacacatgtatgtgtaatgtatacacatacaatttagatatgtttccttcaacacatgtacagtatttttattactgtattcttagaattattcatttacatatgaaataattcccaaactatattgttatttgacttcaacattatctcttatgtcagattatatatctcaagaataatgtatactttcacctaaaacttttaaaacaaaatttaaacttcaaattcacacacaaaaaacattttgacagtaaaaacagaaaattcaaattatttttaaaatcttacttggcgtatatgggtcatggcgtggtttgcaattttggaaatcattctgtctattttcctttgaacttggtttacaaacacttttgaaagggttagagaaacatttcctggcaacctgagaagaatgcgagatagcagtacttcctcctccaagctgaaaacacctgccactgctgaagtcatctggagagattacacccatgacttctatttcttttccacaaatcatcagtgtttggccctcttcaatcttttcaagctctttgaatttataaccaatgcctttaagttaagaaagaaaaaaattaattgacactctatgataccacggtcaccttcccgtaactgtacaaaaaaactgcactttgaatgtaaatagtcttatataatgcattagccaaaatggaagcataatttaacattttggttaaaaaaaacattgaaaatcaaaagaaataatacagctatcaaattagccatgctttagagaaagcaagaatttttttactattgaaaatatagattattgtactctatagttttgccatctcttgtccggaaaaattaagccaagaaaatagtttgataggctatatgtatcctcctttcttgtaaataaactacagaaacatcatggtacctctattttcacttagaaacagctagaaatgtgaaggagaactagcaataaaagcaactgctaccacaactagtactgactgttccacatgagatagcaaagttaaaatacagttgtggcaagaggtcacagatattccatgttctaactctttaataaaacatggaatattttgtaatattaagcttgtttgaattattattaatttgatgaacatttattaagtgttgctgtgtaaaggtgctgatgaaatataagtatggataagtcagtcatgggctgcttaaaatgagttcactaaccacatagatggcattttagacttccatgcttgtctattaaatgcattaaactattaaatgtgtagttattgtgccattaccaagcaaaggagctgtgtataccagaaacttttaagtctctaaaaataataataaaagactgccacattttagaaaatatgatgacccttttcaagtagttgaaaattactaaaattttctctactgaaactggcctaaaatttataatctgtgccaatctgtatttaatatatagtcttaaattatttatggtggaatactttttaattgtaatgctctgatataggaagaaattacttagctcaatgtcaaagacccatcactccatcccaaatcagtattggtcttcacttatccaaattaatgaagattatagttttatcttcacataaaatccaattactgttaatctcagttttacatggaaatggaagacaagaataaccttttaactttgaggtacctttaaagtagctctaattccaagatctctcatttcatttagatccatagatgatcttgatccaaaggtgactctttcaaacatctcagtcgctagaagcttttcttttactcttaaactttgtttcacatactggttttttttttttcctaggtattatgcaatgatggccaactgagcctgatgcattatcacaagctattagcaattttagcattccagctttcagttttcttagcacctctatctttacattaacaaatttacatattgtatatcccagttatttaaaagaaaaactgcttatagacagtaacttgcaaaattaacttcaggttaatacatttattaatgttataattaagcaaccaagtcctatgtttggatattttcattttgaaaaccctaaaatatacctatgttcagtccctctccctaccatacaggccaaataaatcagagcctcaaagaaaggtcagagtctgggcatcggcatttcttttctttttctttcttttttttttttaagagacagggtctctccagcccaggctggagtgcagtggcaggatcaaggctcactgcagcctcgatctcctgggttcaagcaatcttcctgcctcagtctcccaagtagttagagttacagatgcatgccactacacctggttaatttatttttttgtatagacaaggtcttgctaagttgcccaggctggtctcgaacttagcctcaagcaatccttccccatcagcctcccaaagtgctgagattacaggcgtgagccactacacccttaaaagcacctcagatgattctactggcatggtcagggtaaaaacccactgttttaagcctaattttcattttttgttacttgcaactgaaagatcattttattataaactacacatatgcaaaaccatgcacactataccttaggggtaaaagatattccaaagtaattgtgataatttttcctctctcactgactttagaatttcactaaagaggcaataccaatgcatgaacaaattctccaaaaatctagccccaatcgaccttaaccaacatagaatgtgtactatctatttttctttttacttccccaatcactatacacagttgttccatatttttataataaataaaacattctattgtagataatttagtttgcttcaactcttaacactgtcacggcctttcatacactacattcctgaaacactgaactagtttgaattccttcctgcttttgtgcctttacatgtgctattctctcttgcacatggcccttacctataacctccaaaactattcatccttcaaatagtatcttaaacggtaactcctatcaagcttacccctagcctcctgtgcagattaaatggttcttttatgctcccactgcttcctgggcagattaaatggttcttttatgctccaactgcatttagtaaaacttctcattgaaacaactgtattattgcttcctaatcatcaattactttgctttgttcccactaaattataaattataatcatctttggtattcctagcatactgcctggcacataatagttattaaaaactataaactatatttttaagtaaataaacatgtagaacagattttatagttataggtcacactcaaaattgaactgagacaatgcaaagacactgtagttggtgttagccattcttaatttgtagcctaacttgtattactacaaattatgctggcaacattttgtaacagaaacaatggcaacctccaatttccatatgttaatctaggtcaggcctaaccattatctccttgctctgtttttcaaaacattattgagtagtgctgaaattacatatcattcaacttgatatcaacatatttttcaattttaaccacttagcattcttaaaaagagagagagagaaagtataccaagtcaaatttagtgtttaagctcagaaaagtaccaaaataactatatatagctggctggccatttttggagaaaatgaaaccataggataggatttgcttcactgagctagcataaaccataagattgtcaggctcactaaccattatgagattattttatgtattatacacagttgaggcatgaacatccattaaagaataccttatcatctctttataaaacccaattacatttcaattatgtaaccggagatacatactaatttcaggccaaactgtaaacattaggtagtatcataatacctcttccaatgtctttgccttccaaattctttaatataaatgactttccttttacaataagaacagcatcaccttcccactttttatgttttttctttgaaggcttacaccaaacaacactgaaatatttaactaggctatcagatttctcttcttgttccttggacactgctacttctttaggagccgaatgaactacaattaaaaaaaaaacacacattattaaaaatgactttaatgtctaagtagtaaggtcattcaaacaaaaccaaaaggcacaagaaaattagattatattaagaaatagtatgaaagaatatttgatcatactcatgttagcattttataaactaagaaatccaaatatcaggtgttaatattaccagatgagtataattactacaaatgtcttactgttccgaagtcaaataaactcaaatgaagtagaataacataataatcactgtaaacattttaaaactctaaaaattaagaaattatttcaatgtctatagcatggaaaaatatctaaaatcacattttgacaaaactgatttaattaagtaacatgacaagctgaggaaaggcaaagattacagagttctctgaaagtaaaacctgaaatttttgtttatttaattgataaacaaaaattatatatatgtaggtgcacaacattctgttttgatatatgtatacactgtgggatggctaaatcaaactaattaatattatccattacctcacatactttttgtggtgaaaacattttttaaaatgctactttcttagcatttttcaagtatacattgttattaactatagtcaccatgttatacaatagatttcttgaacttattcctccttaactgaaatttcggatcctttgaccaacatctccccaatgccccacctctatccaactctaggtaaccatcattctactttctgtttctaagagtttgacttttttgaattccacacataagtgagatcacacaataattgtctttctgtgtccagcttatttcactgagcataatgtcctccgggtttacccatgttgtcacaagtgacaggattgccttctttttaaaggctgagtagtgttctactgtgtacctataccaagaagtttttaatccattcatccattgatggacacttaagttgacttcacatcttggctactgtgaaaaatactccaaggaacatgggaatgcagatatctcttcaacatgccaatttcattttttttttttttggctatatacccagaagtgaaagtgttggatcatatgatatgttactttttcaaataagaacaagtataaaacagcaaagtagaaatgagaataaatattattaaaattacgttgtctcctgcttcttacacctaacttgcacacactagattttcagtggctggataaaaggtggtttagctgaagacagcaaaatctcattcccgccattactgaagagctcttcactatgtcttttacgtcatacacacttgaaccatggaaactatcaaaacaataaaattttaaaaacaaaatgaagtaattttttttcctttttactattttcctacttacttaaataggaataaggcaacaaaagcatataaagtataaagatcagaaaggaagaaataaaaccggagcatttacagataatgtaactatttacatagaaatccccagagaatctaaaaataaagaagaataaatttagcagagtcacaagatgcaaggttcatatgcaaaaatcaactgtattcttatagactagcaaggaataatcaaaaataaaattttttaaattccattcacagtagctccaaaaaacagacatgtgaaatacttgggaaaatatctaacaaaagataacccagatctctacactaaaattaaaaagctttgttgaaaaaaaattaacaaagctcttataaataagcacagctcctatttcatgaattggaacattcaattttgttaagatagtaattttccccaaaacgatcaatatatttaacacaataccaatcaaaatcccaggacatttttagtaaaattggcaagttgatttaaaaattcatatggaaataaaagtaacgtagactaaccaaagcaatttttgaaaagaacaaagttggatgtttacaataatgctgcgataatcaagatagtttggtactgcccttcctctccaaaaaagacatatagacattccaatgcattggaagagaagcaagaaatagaactattcacacatatacggcgaaattattttcaacaaaggtagggaagcaaattcaatgaggaaaggaaagtcttttcaacaaacattgctaaaccaactggatacacatttggaaaagataaacatcaaccattaagtcaccccatatacaaaattcaactcaaaatgaatgatagacctaaatgtaaaacctaaaacaaaaaatctctaatagaaaacacaggataaaatatttgtaacctcaggatatacaaagctttcttagaatacaaaagcacgaaacataaaaatcaaaaattattaatcaacttttatcagaatttaaaacttttgctttttgaaagatgccattaaaaaaacaaaagggaagccactggctggggtaaaatattcacagcatatgaataagacaaaggtcttgtatccagaataattattcttttttttttttctttttttttttttgagacagagttttgctctgtagcccaggctggaatgcagtggtgtgatctcggctgactgcaacctctgcctcctgggttcaagcgattctcctgcctcagcctcccacgtagctgagattacaggcgcccaccaccatgctcagctgatttttgtacttttagcagagacggggtttcaccaggttggccaggctggtcttgaatttgtgacctcaagtgatccacccacctaggcctcccaaagtgctaggattacaggcgtgagccactgcacccagcctaagaattcttatagtttaaaaataagacaacattgattttatatcctgagactttcctgaagttgcttatcagcttaaggagattttgggctgagacagtgaggttttctagatatacaatcatgccgtctgcaaacagggaaaatttgacttactcttttcctaattgaataccctttatttccttctcctgcctaattgccctggccagaacttccaacactatgttgaataggagtggtgagagagggcatccctgtcttgtgctggttttcaaagggaatgcttccagtttttgcccattcagtgtgatattggctgtgggtttgtcatagatagctcttattattttgagatatgtcctatcaatacctaatttattgagagtttttagcatgaagcgttgttgaattttgtcaaaggccttttctgcatctattgagataatcatgtggtttttgtctttggttctgtttatatgctggattatatttattgatttgcgtatattgaaccagccttgcagcaaagtctcaggatacaaaatcaatgtataaaaatcacaagcattcttatacaccaataacagacaaacagagagccaaatcatgagtgaactcccattcacaattgcttcaaagagaataaaatacttaggaatccaacttacaagggacgtgaaggacctcttcaaggagaactacaaaccactgctcaatgaaataaaagaggatacaaacaaatggaagaacattccatgctcatgggtaggaagaatcaatattgtgaaaacggccatactgcccaaagtaattcatagattcaatgccatccccatcaagctaccaatgtctttcttcacagaattggaaaaaactactttaaagttcatatggaaccaaaaaagagcccgcattgccaagtcaatcctgagccaaaagaacaaagctggaggcatcacactacctgacttcaaactatactacaaggctacagtaaccgaaacagcatggtactggtaccaaaacagagatatagatcaatggaatagaacagagccctcagaaataacaccgcatatctacaactatctgatctttgacaaacctgagaaaaacaagcaatggggaaaggattccctatttaataaatgctgctgggaaaactggctagccatatgtagaaagctgaaactggatcccttccttacaccttatacaaaaatcaattcaagatggattaaagacttaaacgttagatctaaaaccataaaaaccctagaagaaaacctaggcattaccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactagccatcagagaaatgcaaatcaaaaccacaaggagataccatctcacaccagttagaatggcaatcattaaaaagtcaggaaacaacaggtgctggagaggatgtggagaaataggaacacttacactgttagtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatataccatggaatactatgcagccataaaaaatgatgagttcatgtcctttgtagggacatggatgaaattggaaatcatcattctcagtaaactatcacaaggacaaaaaaccaaacaccgcatgttctcactcatagatgggaattgaacaatgagaacacatggacacaggaaggggaacatcacactctggggaatgttgtgtggtggggcgaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaaaaaaagaaaaaaaaataagacaacaaacaaatcaatagaaaacaggcaaaaatcttagacaattcagaaaatgatatatacaaacaaccaataagcacataaaaagatatttaacatcattagtcatccagaaaatacatattaaaaacctgaaataccacttcacaaccattaggatggctggaatcgcaaagtcagataataaacaagtgtgatgcgtatgtggagaaatcaaaaccctcataccctgctggtaggagtataaaatggtgcagcactttggaaaaaccagcatgacagttgctcaaacaattaaacaagagttaccaaatgacacagcaattacactcctaagtatatgcccaaaagaataataacatatgtccacaaaaaaacttgcatatgaatgtttatagctaggattattaataatagccgacaggtagaaacaacccaaatgtgcattcaactgacaaaggataaacaaaatgtggcatatgcatacaatggaatataattccatcatagaaaaagaacaaagtactaatacatgctaaaacacggatgaaccctgaaaacatttatgctaagtgaaagaagccagtcacaaaggccatatattttaggattccattcatataaaatgtctagaacagcaaaatcttacagagacagaaaatagattaatggttgcttaggctggagggtaaggatggggttaggaagcagggtggtggtagctaaaggtaaaaagtttctttctgaggtattgaaaatattctgcaactggctgttctgatggttgcacattaactgtgactatattaaaaaacaatgaattgtacactttacatgactgaatcatagggtatgttaattgtatctcaataaagctgtttaaaacacacacacacaatgaaataacaccacatcttgattatactgactaaaattaaaaaaaaaaaaaaactgaccacagtaagtgctaataaagatatagagcaactgaaaatatcatatcctgctggaaggaatgtcaaacagtacaactagtttggaaaatggtttcgcagactctttaaaagttaaacatacacctaccataaccagccattacactgctaggtattcaccaaaataaaagaagaagaagaagaaagaaaaagaagacatatgtctggaaaaaaaaaaacttgtacatctccaagccaggtaaatcaacctgccaaatgcctgaaaatttatcactactagaattcagataaattgtatcttcattactggcattcatggatttagaaagtgagtcttggctatcttcaaccagtaaattatactcagaaccaccaaagttgttttctgagaaaacaaatgattcatacccagcttgagtcagctctgtctggcatgacccaatgaactctgatcagttcctgaaaggattcagtctgctagagccctcagcaggaaccaagaagacaaaggacttaagtgcagctcctccagttttctgaccttccttccctaatgagagtgtatggataacacgtcatttttcagatacttttttgggggaaatgtgcttctaaatgtcccagtagatgtagtggatagttttttacccttctcttttcatatgttattgtggatatatttctacatattattagtcccttattactggactttttttttaagctctatcatattcaatctgtgcatctctggttatttgtggaagataaagtccaagaaatgaaattaccagtccaatgaatttaaagattttcagattcttgatttagactgacaaatttttctccacgaaaggttgtatcaatgatattcccaccaagcaagggtgtccacttcattacacccattacacctacattagcacaaaacatcacctttatccatttttaactattgtttttaaattttcatacagtaaaatagactttttcttttgatgtacagctctacaaatttgaacacatatatagattcacagaaccaccatgaccacaatcaggatatagaatcgttccatcatcccgaaagactccctcatgctattgctttatactcacaccctccccttacccaaaacccctgcagttactgacctgttttccatgaatattgttttctttttgagaacgtcgaataaatggaatcatacagtatacaaccgtttcaaaaatgatttctcccattcagcataatgtctttgggattcatcccaaattgttgcctgtatcaacaatttgttccttattattatataggatagtgacagacagttgagttttcagcttaattttgatagctttgactatcataaagcttctatgaactttttctgtgaattcatctttatcaatttaattggcagaaatgatatctccttaatgctgcaatttgaatttgattagtgataggatatttttaaatgtatcttcatttcctctttgctagactctcctaatttcacactacacttaaagaaggtacctgagaaaaaaagaaaagattctcatatctttaaagttttaatctgaccagaaaaccctcaacattcagccgacatattgccaatatgtagaatctaatccctgaattttacttaaaatatttaagtaaaaaataggcataaaagaatttcaattagtaagaactgttaaaattaaagcaaaaaggttgggagtggtggctcacgcctgtaatcccaccactttcggaggccaaggcgggtggatcacaaggtcagcagttcgagaccagcctgaccaacatggtgaaaccctgtctctactaaaaatgcaaacattagccaggcgtggtggcaggcacctgcaatcccagctactcgggaggttgaggcaggagaattgcttgaaaccagaaggcggaggttgcagtgagccgagatcatgccactgcactctagcctgggcaacaagagcgaaactccgtctcaaaaaaataaataaataaatgaaaataaaattaaagcaaaaaataaatctactgaattttaatatgtaaaatgctacaaaatacatggaacacaagtgttgactgtgctggaagaattaagaatccatttaatattttctttaataggaggtactaagttacggggctgttacaatattttaaataaacccaggtcatttaaaaactcctccctcttctctcacagcctggcccccaccaaaaaaaaaaaaaaaaaaaaagcaacatgaacaatttaacagagtaaaataaaagaggttgaaataagcccactcacacttactagaaattattaaacactttagtatacagtcatgtaccacacaacaaggttttgatcaaccacagaccacatatatgatggtggtcccgtaacatcttaataccatatttttactgtatattttctatttttagatatgtttagatacacaaataccactgtgttacaactgtctacagtattcagcacagcacatgcagtacaggtttacagtctaggaaccataggctataccacacagcctaggtgtgtagcaggctataccatctaggtttgaggaagtacattccacaatgttcacacatcaacgaaatcacctagcaatgcatttctcagaacatattcctgtcattaagcaacatgattgtactctaaatcaatatatcgacatgctgtagtaaaagcgccaaagaaaacttgattttttttttttttttttttttttaagacagagtctcactgtcacccaggctggagtgcagtggtgtgatcttggttcacagaaacctccacttcctgggctcaagcgatcctcccacctcagcatcctgagtagctgggactacaggcatgcaccaccaagcccggctaattttttttttcgtattttcaatagacagggtttcaccattttgcccaggctggtgtcgaactcatgagcttaagcgtctggtctacgtcagcctcccaaagagctcttaacaaggtcactctttgacttcctacttaataaactcctttctccacagtaaatcatggggaaaaaacatagcatggaaaaataaagtcaagattattatgtaatatgttatatttcagggagaaacatgtattgcaggaagaaacacatacataaaaaaaaagaagtttttggccgtgcgcggtggctcaggcctgtaatcccagcactttgggaggctaaggtgggcggatcacctgaggtcaggagttcgagacaagcttggccaacatggtgaaaccccgtctctactaaaaatacagaaattagccagacgtggtggtgggcgtctgtaatcccagctactcaggaggctgaggcagaagaatcacctgaaccctggaggtggaggttgcagtgagccgagatcacaccgctgcactccagcctgggcaatcaagcgagactcagtctcaaaaaaaaaaaaaaaagagatgttttcctaccataagaagctgtctaccccattgtttccacttcaagtatccaaacactcccacccccacactgcctctgcttcttcaaattcccaatcactccttaactgctccaatatggcttccagtagtcattccccctaaactgccctgttaaaggttaccaggaactctttgtctataaacccacaggttgtgtttttagtcctaatcaaagttctcaaaagcattagacaatgttgactacttcctcctagaaatactgaactatacttttgtagattctctaacatccttcaaattttcctcttacctctttgcttgcttcttcttagacatctttgccagttcatacttcatctaccttttatctattggagttcttcagaactgacttctaggccctgttctctcactgtgcaccacttctctttaagtagcctgtccacttgagcggattcagtgctgcccaggtactaaaaacctttttttctctagcccagattacaactcttgatctgcatatccaattgcctcccagacatgtccacatatctcataaacatctcaaactcatcatgtccatgtatcttttctccaaaaattgttcctcctttggtttccccatgtctcgtccttatacaagccagaaaactggaaatcatccttgacactctactttttcagtcccacagacaatcaaccacaaaatccagacaattctgccccctaccaggttttcaaagctatgtattgtatccttctccattgcctccacttttttcaactcatctctgatctgaattttggtattactgcaggggcttcccaacaagtctactgacagcgtcttttgccacctctattctctaaaaccgttttccacatttattatagttatctatttttaaatgtgaatctgataaagtatccctcttgcttaaaatccatgagtcctagtaatcttgaaggaagtatgctatttccagctatagacttttacctgtcttcttctaatgcccttatctaaattaacttctactctctgtacaacttaaatttccgattgccaaattagatctagttaccctattacctcaacattatctcaataattagttatgtaacaaattatttaatgtcagccttccccagtaacttataaagtcctgagagtatgttttgatttgttcatcaccatactcacagaacaagatacttttcaaaaactgctattttgactctaggtacattttgactaaatgtttataaaaacatttaattaaaatacaattatcagccgggtgcagtggttcacacctgtaatcccagcactttgggaggctgaggcaggcggattacctgaggtcaggagtttgagaccagcctggccaacgtggcgaaactccatctctactaaaaatacaaaaattagccaggcatggtagtacacgcctgtagtgccggctacttgggtagctgagacaggagaatcgcttgaatccgggaggcggaggttgcagtgagccgagaacattccactggcactccagcctggacgatagagcgagacttcgtctcaaaaaaaaaaaaaaaaaaaaaaaaaaaaaaatatatatatatatatatatatatatatatatatataaaattatcagtgttacagctctttcagaattttccagtttttgccaattctaaatccagtttcagaattttctagaaagcctcctcaccacaaaaaattatatatatatatatatatatataattgttaggggtggttattctggaacatagcaaattagtcaatattttcataatacaagtagtctagatataggaggctatgttccactatcctatgttgccaatgatcttgtttttaccttttggagttattcaccctcttcattccctgctgtatggcctacataattttaaaaatgggactaattgggaaagagaatatgtataaatatacatatatatttatcttaaaattcattttcattaagagttgctttagaatataactctgtcctcatttccattattacccaatttttattttcattgacaaagacttgttaccggccgggcacggtggctcacgcctgtaatcccaacactttgggaggccgaggcaggctaatcacaaggtcaggagatcaagaccatcctggctaacatggtgaaaccccatctctactaaaaatacaaaaaattagctgggcatggtgacaggcgcctgtagtcccagctactcaggaagctgaggcaggagaattgcttgaacccagaaggcggagttgcagtgagccaagatcgcgccactgcactccagaccaggcaacagagccagactccatctcaaaaacaaacaaacaaaaaaaacttgttatcatcaggatcattttccaagtaaattttgtagcaaagattcagtcacttctttatgtaccatattatttcattgatcggtgaaagcttttatgaacatgttctttcataaccataatttctaccaaatgaagttttactgagtcaaattttgcacagctaaatattatcaggatcgtattaatccaacaaattttagtcaagaaaacttaaccagtttttagataaatttgtagctgtcatgggttattttcgttgttttaccaagcccgatcttcccagataaagttttgaggtttttagcattaacaaaagacagaatacttcaattagcttttgaactcttttcacacaaattttgctgtgtgcaattttagtcaattttaattagttttctttttgtattatttctaccagtagcagtcactgtgcattgaattaaaaactgacaaaatctttctgcatagttaaaatgtgtttctctgtttttattaggttatccaagagaaaaacatacttccccttttaccctaaagagcgggtaaaaagaatgtcttcatcaaaagactgggaaaaacatcctggagtaaaataccgtattgtattaccagggtctaagagaatggatgttatgtccaagaccctccctgccaccatcccaccagctcccagaaaaaacaatgaacaagataactaaattctgataattcagaaattacttataagtaactttgaaataccataagattctcggatatacacttttcttttgcagaacagcagaagggcatgaactatggagacagactggctgggtcagagtcttaagtctgcctcttactagctctatgaccctatataagttacttaacacctttgtgccagtttataaatctataaaatgaatataatactaatacttacctcgcaaacctactgtgagcaaggattagtgaatatatgtaaaacacaacagtatttgccacatagtaagtgctcccttaatgtttacaccatcaacatttgcccttgtccctttctcaattactcccatttttaaaattatgtaggccatacagcatggaatagagagggtgaataattccaaaaggtaaaaacaagatcgttgggaacatggaatagtggaacataacctcctatatctagactacttgtattacagaaaatattgactaatttgctatgtcccagaataaccacccctaacaatcccagtctataatttcttaactgtaaactgggttctgatctattttccccttgaccctgtaatgtgcttgccaaatcaataccaaaaagtggtcggcataaacaagagacttgaaggtctatctgcaagactcataaggcagctggcacagtggctcacacctgtaatcccagcactttgcggggccaaggtgagagaatcactcaagcccaggagttcaagaccagcctggacaatacggcaaaactctgtctctataaaaaatacaaatattagctgggcatggtggtgcacacctgtggttccagctactcaggaagttgaggcaggtaggttgcttgagcccaggaggttgaggctccagtgagctgtgactgtgccactgtactccagcctgggtgacagagcgagaccccatctcaaaaaaaaaaaaaaaaaaaattcataagggcatgttttgataaagggaaataatgtcatttaatattaatagtgggcattatcgtcttagtgaatgattcctaagcatagccactctggagttgaatgacttaattgtacaacccataaacctaagcctttaatattcttttttttttttttttttttttaaagaggtcttcaggttggtctccaactcctggactcaagcaatcctcctgcctcagcctcacaaagtgctaggattacaggcatgagccaccgcacccagcctaatattcttttgtttaacaattctaaatacacacattgttttcaatggcacaaatgaaaatttaaaatgtctcatataatcaaattcaataaagaatgtaaatactcttgcagatcatgttttgagttttaaaattaccaaaacctaccaatgtttaatatgcattaacatataactgcaatataaatttaagattgaaacagtttttattacactaaaaagcatacaaacattaatatacaaatcccttcaaactgataatcactcacagttttcttatatctaagagattgaatgtgaactaaatataagtatcaataagtataaaataaacctagaagatatttctttgcattaaagatcattttcagaattatgttttataagcgtagcagagactacacatttcatatttcttcaatacctcatgtcagagcatatatgcaactagtactaaaatgaaaaaaaaaaaaaccagtaaactacaatattcccagatatctaaattacctgtccaacattttgaatgcacttaaatattacaaaaattattcatcaatttcacttctgacattccagtcactgaacatgcaaagggcgttttgtttcgtttttgggacagggtcttgctctgttgcccaagctggagtacagtggcgtcatcagggctcactgcaacctctgcctcccagattcaagcaattttcctgcctcagcctcctgagtagctgggattacaggtgcctgccaccacgcccagctgatttttgtatttttagtagagacggggtttcaccatggtggccaggctggtttcgaactcctggcctcaagcgatccacccgcctcagcctcccaaagtgctgggatgacaggtgtgagccactgtgcccagccttttgcaaaaattaaaaaaaaaaaaaaaactcataccctgttgatggaagtgtaaaatgatataatcactttagaaaatgtctggcaatttcttaaaggttaagtctgtatggttccctaactaacattatgtccatgaaaaacttgcacaagaatattcatagaatctttatacataatagccaaagtatggaaattgccaagaagtccatcaaaagataatggataaaaagtgtggtatatttatgcaatggaatactgcacagcaacagaaagcaatgagctactaataggatggataaacatggatgaatattaaaaacactaaggtgaaaaaaacagaaacaaagtatgcatattgtatgattccaattacatgaagttctagaataggcaaaacttatctataattttttttaaattaggacaatggttgcctgacgtgcaagaagactgattagaagcaggcaagagaggactttctgaggtgatattgttctaattcttgacagaggtttgagctacacagttgtagatcaaaactcaccaaatggtatattttaaatttgtgcatttcactgtatgcaaatcttacctaaaaaacacacatgcacaaataaatagtgaactctagtaatactcatgctgaagtacttaagggtaaattattctaactctacaacttgtttcgaagtaacatttttcctttaaaaaaaagaattgatggataaataggtgatgaagccaagtatagcaaaacattaattgcagaatctatgtggtagatatatggatacttactataactatcttttcactttttctgtatgtttgaaaggtttcttaatgttaggggaaaaaaaactttgtaacagaggtgaattcacacataaattttaaaacaaaaaagacctgctagcaaagtggaattataatgatatatccttttagtttaagttgtcaggactgatatgagcgatatttttatttttatttttatttactcatttattttgctttccactattacaaagcaattggaaactaaaaataaataatatgttcaaattataactactagctttaatcaatataaaagatttataaaaatatattgaacaatttctcaaaatcgtatacaaagattttgcttgactgttaatgtttaattagattgcatattctaagaacttactcttgtttaagtatgcaaccatatttcatctaattacttttaagtgtttacaatcaaattcaccatcaaatatttgattttgagaagctgtggctcttaacatttgaaaaaagaaatgaaatgtgatatttagatatggtacattggccatctattataacataatcatctaaataaatgtatttcaattatacctcatcaaaaaattttacctctacagtactgaattatttgtcttaacggcacacaaaaaaagtacacaaatcagtacaaagtagtatcttgtatttaaaagaacatgtgttaacaaagcatttaaccatcattatctacagtatatattaaacacaatttattacactctaagttatttaaacatgtgtatttaaaagttgacattactccaaaagaaggcacatgaaaaaaactcatagtttaaacattttcacataagtaaagatagaacagggtagaatgactccttaaaaaaaaaaatgaaataacaccaagttaatatctcatcatacacaaaagaaaaatacttgactattttaagaaatctggtattcgttagaaatgagtttcactgacttttctcaggatgtcattataaatcacagctagtttagaaaatcataagttgtaacaacatatccattacattcatatggataagagaaagataggaaagtggctatccactatctaaattactaatatattggatgaaataatctatatacttagtatatttatcaaatgtagtatatttctacagaatcaagtctacatttaaaaaacaaaatcactcttctctatgttctcccagcattacattttgtaattaaagctcatggaccccaaacaattgtctatgatatgcaagatgtctggtggcttaagtgtatagtcatccctcagtatccaagggggattggtttcaggacaccccctaccccatcaagatccacagatactcaagtcccttatataaaatgtttgtattcacatacaatttacacacatccttccatatactttaaatcatctctagattacttacaatggctaatataatgtaaatactatgtaaatagttgttaggatacaggacaagtgagccccaaaactggggattagcccaactcctacctcagttataccgtctttttaaatttcgtattactttttattgttgtactgttatttatttttctgcctgaatattttcaatccacagtagttcaatctgcagatgtgaaacctgcagatagaaagccaagtgtacattccattgtactagcaaactttcccctatatattccccttaatgaaacttgtcctcaacaaaaactgctaatgttagttggtaagtagtcccctaactcaaaaaagtctcaatacaaaaaagaagaaaaaaaaaggtttggttccaaattaccctaagatactctgtaagataataaacagcctcggaaaaggattctatggtcaaataaataattttctttatacaggaattctcataaactatactatgttaatcatggttatacaaggggaggtagacaatgaggagaattatatgcatttaaacttttgcaaattaaaagtaaacaagactgacttggagaaaaacaagattgacttggaaaagttgctgcagtaaactcaaagagtgtgattctggtgtttaaaaatatgtaaaaataggtttcttattgtatacagcccctaaatgctaatgaattgtgtcacctaacacactaaagaaaaagcaatcttaaacaatgctgcagaaaaatatgattgtagcagactatgtttatgctattttatgggcagcaaaggaattttcaagggctattttgtatatacataatttttaccttccacaattattttagaacctaaccaccaaaaataaaaaagatgtatactgcacttttttttaacacagatctcttttctagaaacatctcacagaattaatgttccacagaacacacttgggaaaactctgatttgctgtaaaagccaacatttaaattgaacattcattatcaattcttagtagcatgctgaaactgtaaagtgaattacatctcatatatgtgctttcaataatttcaaaaaataaagcttactactgccaagatgtgtttactagaattatactgggaaacattacctcaaattaagaattacaagattcattagactcaaagaaaagtcatagcacagattaaagagaaaaggtaacattgtcaaaaggatatatcaagttatatattcaggacatctttataattaaagaagttaactctaccagctataaaacaccctctttttaatccaaccaatgaaattaagtagtcaacatgctaaaatagtaccttgagttcatttttttctatttctatagccataacttaaatttctgatttaagttcttccaatacaatgcctgtccctaaatgccactcctcctaaatcacaactataatcaaattagccctctaattcaaagcattcaatggcttctcattgtacgttaagtctgactcattaaaaatagtatttaggctgggcacggtggctcaagcctgtaatcccagcactttgggaggccgaggcgggcagatcacgaggtcaggagatcaagaccatcctggctaacacagtgaaaccccgtctctactaaaaacacaaaaaattagccaggcatggtggtgcgcctgtagtcccagctacttgggaagctgaagcaggagaatcgcttgaacccaggaaacggagattgcagtgagccaacatcgcaccactgcactccaacctaggtgacaaagcaagactccatctcaaaaaaaaaaaaaaaaagtatttaatgtaattcataatctggtatcaaccatcatccaaatttatatccctcagttcactttcaactactcttcgacaaaaattttgagactagtatgatttaggcaccaagcgaggttccaaaatactctgtttcactggttctcaaactttagcatgcatcagaatcgctaaagggtttattaaaagagattgctgacacccccagggtttctaattcacttggaaatggatttacatttctaacaagttctcaagtgatgctgatgctgctggtcaggacccatacttggaaaaccattggtctactccaaaggccacaaagtggaagcccaatggctcagtgaggcccactcacatgttgtctgtataatgttttaaaagcattttgtgttatttgcaaacattttaaaattggaagattcctcattaaaaaatgcagatttctggtttatccccgcatgtgaaaattctgctggagctaaacagcagctaccctacctagtccagggagatgtccttcctagtccaggatactacagcccaaattgactctctctacattcacttaaaatcaatggcttagcactgcatttgtgcttatatactcaatccactttttcccattcttttgtcttttttccagcgtctcactcttgacttcaaacacccatggtccccttcactgctgaaattacacccaccccattctacaacttggcttaaaaatcccttctcaacaaaaccccagcaaaaatagaaattcttaagtaacatacatattagagatttaatataaatttaatatgtatgctttaagaattgaggttttatttccatgaatactaaaataacaatacttataaaatacataaaattttaattttgttcattctgatttttactgtgaaagaaattttttccagaacaggacattcaaaatgaattaagacatgtctttaaatcacacagccaaaatatataatagcttcaatggaataccttatctattttgctggaacaaaaatagagagagaatgggggtaattgatgtaattatcctgatttcacaacctaacaatctttaaaggcaattttaatgaaagaaatgcttctaatatttaaatctagagaatgttttagtggatatttacttctatcgaatagcgggatggaaattacacaaagaaaaactaagtgctggtctctgctctgccataaatagctttgttaccctaagtaagtcattgagttctccctggacctgtttcattacccctaaactgcagagatggaaaaaaagtgttctccaaatatcttccatctctaaaatcctaggatttactccttcaaaagataaaagcataaaaaccaatgtcatacagacaagcttcttggtattaggttagtatagctcctaaattagactgacttaaaaatctctaattatagctttcaaagttctaactaaaaatgttgaagactcagaactttgaaagaatatgtgtttgtatatgcatttgtgtatatcttagtgatcagaataaaatatcttttgtaaggtcaacaattaaacttagggaaaaaaaaaagaagacaataaaaactataaccatgccaaccaaccagtaaattttaatatctcaaaagaaaataattagaaaattatatctaaaaagtttttccataatagagattaacaacatttttcaagaacgtgtattctgtttcaggatattcccaaattaaagtaatttggccaaaatcaaaattatcaaattgcaagattgaaaaaaaaacttagagactgttatattcaggtagatcatgccgtaagcgaattgctttcagcttctccacttcaatttttgctcttagtagctcttcctctagctgctgccttcttttcaatccatccctcttctcctgaacatacaatccaaaatttttttgattttctaaaattatctgatgctcctctttcaacatttgcaggatctgaggatcataccctaatagtgacctaaagtgttcaccactctcatgccgaaaaaaatcatctctccttggaatagaagatggagacgatgtcattctcatatcaacagaggaaagtgaaggcgacaaggatctttccataacatgtactaattcatgttcttctctttgctctaaagtatcactctgttgagaatttaaaaccagtggaggaggtggtttaatgtcttcttcttgcttcacctccactgtaatagcaacaggatggtgatccaacattacctgtagtgaactggtaccagcctgtgcctcctcatccaagtttgcactatagcacacaaaaaagcattataatatgtaaatcaaatgaagaaaaagtgtatatttatagcataattttaatttaatgtacattaaatgataaagctttaaaactataaagttacaaaataaaaaaaaatcttaaacacttgaaatacattaaagtgactaagattgggatttcaataatacatactcacagatctcccccatccttaactttaaaattgtgctttaaaggagcaggaaattacaaatattatagaaggccaatgaagaaaataaaaagaaaagccagttttcatgttgtcaaacagacaccaatctttcccacaaccctaaggttttcaaatggtgtacagagccatttaatgcattctcagtcttgttatccccataccttagccctagacctcaggcttctgctctcctggactgatcttaaaaccatgaaggcccataacttataaaaggacagtgaaaggccatctatgggaggtactgatttctgcatttgcccaaaaaataaaacataaagattgtatatggctttgggatatgctcaactactggaggttatcctaactttcttatttcagatgcttttatctgataggaaaaacttccgttttacctattctgaaccatatgactcagatgctgtttaagtctttcaatcactggtcaggtaaagttcacaagagcaatggttttaatccacaactgtatactcagtacctagcaggtactgtacttagaacctagtaggtgctcattatgtgttgaatgactgaaaaaaaacaaactaaatgattttttaatgaaacatttttaatggcctatacagatatattaaaggtttattaaatttacacataatttccaccaaatatgcattcccaatggagacaactacagctttagcataatttaagcttcagcataacaagttatgatattataaatgcaataaaccttaaaattctgttttataaacataattttatgtataacgtgaagctgtgaattaagaatatctgctccttgaggttgttttttttaatttatgcttctgcctaacttaaaaataaaagttataaagggaaattagatcattgaacatgaatggaaatactttatttaatattatttagagaagattttacatataataagaaacataattaaaagaatacattctacatggatgattaaaatgctggaacaagttcaagcagaatgcatagaaaaagattaaaactacccatacgttacttactaatgccattaaattgccagaaatatcagatatttatctaagagacaaaatgaaacatatatagtatataataaaaaatctatttgtaggttatataaattcatttttgttcttgtctctgtttgtgtcattttattatttccaaaaacaaaacaattaattataaatgtaattcaaagtagcaagctctgcttctattaatagctctgctaaaacctggaatgggaaaaggctaaaattgcatatgaaaattaagtttttaaaaccacataattactatttcaaattagtatgtaaaatagagagtataaacatagacataatactaccaagtaaattaaaaatatgcctcatatctggaacattcctttccattttagctaaaacattacaactaaggcataacaatataaaaagggagaaaaaaagctttagagcaggtcacaaaaatgacagagaaggacttgagaatcagaactttgaagatcagtttacaaaaacacaaaatataaactgatattaggaagaggtaaaaataaagacataagtcaatgtgagttacagaaaataaatagccttacaaaacaggtatatatttttaagtatgttaacgcaaacactagtattttccttattaaaaaggaagagtttggtaagattaacaggcatatttatgtagaagtatagttaagattatagaataattataaacttctgagattattaagattcaaggatgatatcaatcaaataaatataagcacattaaatatatatattaaagaaataagctaatacagagaaaatgtcaatgtagacacagtaacataagaatttaaaaggcatgtttcttatattcttccctttaaaacctaacaaattggtattatttaagccataggtatagaaatgtacaaatcaactcatttttatcagagaaatgttcatatcccaaaagattttttgtgtgtgaatattgtaaatattcacacacacaaatagtcaaaatgtaaccagatacttgtatatttatatattatttttcttctactcactgttatttttaaaatatgcaactaactaaaattacagtttctacatgtcgttttcaaattataaaaacctatacctactaaccaaagggtacagttttatacctgcgatgcaaaaaacacttttctccatggttcaagggagagaaaattctgcataagtagcacagtataaaacaattttactgcgtagttttctggatatctagctattgggatttcatcatttgtcatcacagtgaacattttaaccagtggccccaagaattaatccactgtgtattcatgtcctggattcccactggtgatattttttttactgtgctatcaagtagaaataagcagtatctggtaagaagctaggctcaaaaatactttcctagtaaattaccaaaataacatatgcacttggctacaaagtggtttttttctgcttctctcctaatttcaaagggatttcatagtaatcaataatttgcttatataatgcctcttccaccaatagaaaagcacattgtgtaaagctttgtttgaaaggctcctcaaactaacaaggagtttacaatttgtttaaattaccctaaatggttcagaataagaatgtagctgccatttttatattttgccagaggttacaatctgaattagtggcaagataatacttttgaaaattccaaggcaaatagttacatagaagacaagtttaaccaaaaaattgcttctaactctaaaaaaacccagttgctcttaggggtattttaaaattcataatttgatatccttgcaaagcagtaagagaaagcttactctttcctatacgacccaagatcaaagtgaaactagactattaaggaataaaaacaacaacaacaaaaaacttttaattttattaagtaaactgaatccctaattaggcattaactccctttagttgtgttcatctttattttaaacgtgttagaaaaataatttaaactgtcttcatatacacaatcatgccattaacaagtttacttattgattttgtttatatttgttagttaacatatattcaataagtgtagacaatgacaattcataaaaaagcaaggttccatttctctagaaactgctaactttatataaattttatataaaattgaaaattccagtgaaatgtaatcttaaatgagaaaaaaagtatctctcagaagcaaactaaataatttaattttaaagcttaagaagtttatgaagtgatgtcacaaatttcaacccacttattcctccctaacctttacttttagaaactacaggagggaagggggaggggaagacagtaaaaagtagcttaaatgcaacagaaaaattcctcatagcctcacttttctctttttaaaaaatgcaaaacaaagacactattcattgctcccgttgtggggatgcttactatgcatatctctatcacgactaagccaaagcccaatagataggaggcgccataattttccataacaaaacaaaataaagcttacctttgtatgtggttcctgtctcttaccaggcaaaaactggaaatctggggaatcatctccataactttcttggttggctcagaaatattgcttttaaaatctgattgggtctctttttgctgcaatagctcctgtttggcatattctttgagccttttataaagggtgcgtaggccctgtgctgttcgaggagggcggtctactccaattgcattatagttaactgctatgatatcccaacatctattcttttctactattactgaatgtttattagtgtgttcttcgagaattttcacatatggcttcacaagctttagcaaatcaagcttttcggataaggtaaaattggaagatctagcctttcctaccattgttcttttcaaattaagtaggcagtttctgaaaccaccatgcagccttcagctctgctcagctcttttcacaaacagaaaaagatcaggcttaactaggctagcctcatttaggcccacgcctacaggggagggtttattaaaattcctccagcttaagctgacgcaggttcaggaaatctgcttaagccaagcctgacctacataaagcttctcactgaagaagacaggaaggcacaagcaaaacacacttgtgtataaagggaacagctcgagacaggatttaatacacaaaggtctagagataagcatggaacacagctaaaaattagctaatttagtgagaatatcaaatttcacacatgtatgcctagctgacagactgaactgcattgcagtatcactttaataaaaacaaaagaggaactgttttgtgctatttatttacaaatccagtagacagaaaactaaaagatatgagtagtgaatgtagtaattcctaacagagcctctcatcactgtttctgagctgagtgttctcccttacaaaatctgcataatgctggatctgctgtcaatcaggaattgcatatcctctagctagttaggttacacccagacccagactccacagtaaagctaagcttctccttcattttacagtctacattagcctctgcatatttttttcacttaagaaaaaatttttatagaacactcaatctaaaaagcaggtaaaaatcatgtttttaaagcaatggattattctagccgtaatgtatgtgaatttgctagcctgccttatcatgtgtaaaaaatcactgttcatggtgagaaacagtataatcacgccttaagactccacatacaaaatcacatttgctattataatagagccagattttttatttagctatattcacacagtttggactatgaaaggaaacagctagtctagccattttcaaggccaccagtttcggtgcttagaatatatttgttaaccccagtatgaaaatatatgatacataataatgtaagcaagacaaacctattttctcacaatatacatatttttccagataggggaataaattagaacatacttgaacatagttctatccaataaaactattactgaacaactgtgatagttattaagaggtaggaaaaataaattgtttttaattactgaccacgtatataaatgctcccaggcactgtgcaagacccaatgaaatcaaaaatgaatctagatacagcacctatccagggaactgtagttccacagaaatgctataaattctcaattatcttgtttttcattcttttaacaatggagaagcaaattacatttactgagctctcactgtgagccaatgtgttaaaagctttaagtgtattatctttcagaaaacagtgaaagattgctggatgttctacggaatgctagatgttgtctggtatacgctactgagtaatttgattccataatagttctaccctttcattgtctttgagcagtttcacagctctgtaaattgtagaaatcagtaatgcaaatgattcttgtccatagagatgcaaaaagaaaatcgacctgccccaacaacaactggaccacaggtactcaaaatcattctagcattttctgagcttttggaacattaaaagagaaccaaagaaagaacatagggtatatactttatttagataattattttgttattttcagaagaaatacaggtattacagaacacagggtatatactttagataattattttgttattttcagaagaaatacaggtattatgttaagaatgaaacactactaaaatatgaaaaaatgttcaatctcactagttatcagggaaatgtatactaaaaatgattttcattcctagattagcaaaattttttaagacttaaaatgccaagagtgaggccaggctcagtggcacatgggcctgtaatccaacagttttgagaggccaaggattacttgagcacatgagttcaagaccagaccgggcaacatggagaaaccccatgtctacaaaaaatacaaaaattagccaggtgtggtggcatatgcctgtagttccagctattcgggaacctgaggtggaaggatcacttgagctcaagaggttgaggctgcactaagccataatcatgccactgcactccagcctcggtgacagagcgagaccctgcctcaaaaaaagaaaaaaaagaagactccaagagtggaaaaggatagaagggaaagagtactcttctgtaccactgaagggagtgtaaaatgacattttggatggtgatctggaagtatctactaatattttacatgagtaggaaatcttctaaaattgtggtaattttatgtctcagaatataccttagaaaaataaaatgcacacgggagcaacgaagcattctttgcagttgcatacagtggaagcaatctaaaagcacatcagttggagttaaaagcatacaatacatccatatcatggtctactccaggcagcattaaaatgaaagacgcagatcatagtgtgtttgaatatatcacgctgttaacgaaaagagtcaaactctgtataaaatatttttagagattgattctgagccaaatatgagtgaccatggccaaagacacagccctcaggtggccctaagaacatgtgccaaggtgggtggcgtatggcttacttttatatattttagggaggcatgagacatcaaccaaatatatttaagaaatacattggtttagttcagaaaagcgggacaactcaaggcgggggcggggtggcggcgggggcggtgttccaggctataaacgttttctggtttacaattggttgagtttatctgaagacctgggatcaatagaaaggaaatgtatgttcaggtaaagataaaggattgtaggcaccaagttttattgtgcagaggaagctctcagatagcagacttcagagagaacaggttgtatattgtttattatcagacctaaaagagtgcctggctcttacttgattatctcctggatctagaaaggaaggaaggaaaacaaggggaaagtggattctctatagaatgtggatttttcccacaagggatggctttgcacgaccatttcaagatatggcagagaaacatgttttggggtaaaatatttttattttcttccatgttatgccagagtcagatcggaaagtaagtcatgatatacagggttaaataaaaccatctgatgagaatgtatggtttacagagcatgattccccagaccccttagataggaatttaggcaagattaaaaaaaaaaaaatcagagcttagtcctcaatgcagacagcacaaattagtgataacctatgtaaattgtaattgatgattaatctgaaatatttattactgtttgattatattacaataaaattatctttctagtttaaaaatagaatggacaagtttttaaattaaaagaagctatactactgatgcagaattaagtggaaaatactatgcaggactttctaaagcagactatgaaaaggtatcatggatatacttgttaagaatattacgaatatatgtgtaaatgctatgaatcactgccagtttatggaactggtaaaagacatcgaataattttttgttctttgccaatgctcgttggtgtagtcatagagttttatgaagaatcactgtgctgtctgagagtgaaaaactcaaactgtttttcctctgctctcacaccacaacaatcaacatgaagacttgtgtgaccaaatgtgtgggagtttctccccacacaccaagcaagaagttaagttctgcagtggagaggagccgggtatcctctaattcaactttccaacactatcaggagatagtgttagatctcaaaggttaagagctcagtaccacaaaccccatggccccacctgagggaagagagagaccctctcatattgttttatattgttttatactcagtacctgttttaagaaaaaaacaaggaagtgaaatcaaagacaggcagcccggcgccaggtccaaaaccaggcctgggcctgcctggcctaaacctagtagttaaaaattaactcatgacttagaacccgatgttacccatagattccaggcattgtatggaagaacactgtgaaactccctgctcttttctgtttcactctgaccaccggtgcatgcagcccctgtcacgtactccctgcttgctcaaatcaatcacgaccctttcatgtgaaatctttagtgttgtgagcccttaaaaggaacagaaattgtgcactcagggagctcagattttaagacagtagcttgccgatgctcccagctgaataaagcccttccttctacaactcggtgtctgagaggttttgtctgtggctcgtcctgctacacaaccagtcacaagtctgggcctccagaacatctaaccaaaaagcttcaagttggggttcccacaatcccctctgggttctattagtttgctagagtggtcacagaactccagaaacacgcttaccagtttattataaaggatattacaaaggatacaaatgaacagccagatgtaagagatgcatagggcaagttatggtggaagggacacaaagtttccatgcccaccccaggcacaacccccagaaacctccacttattcagctatctcgaagctctacaacacagggctttgggctttttaagaaagcttcattacataggcatgactgattaaatcactggccactggtaatcaatttaaccctcagcctctctcctctccccagagataggggtgaggctgaacgttccaactctctaatggtgccttggtctttcacgtaaccaactcacatcctgaaactacctaggggctgtcagccatcaatcaatcactagcacacaaacagacattactttggaggtcgtaaggattttaggagttgtataccagggaaacggggtcaaaggccaaacatatattccacaatatcacctattattaacttcagttggagatttttgtgaaacaaaatgtttacgaaacagtcaataaacaaaggcaaaaaaatcaacctaagtgtccatcaacagatgaataaagaaaatgaactgcatatacacaatggaatattatttggttataaaaaatgaaatcctgacatttgcagcaacatggatggaactggaagtcattatattaagtgaaataacccaagcacggaaagacaaataccgtatgttctctctcacatgtgggagctaaaagggtgaatctcatggaagtagagacttgattagtggttgccagaggctgggaaggagaggtggggattaagagaggttggttaatgggtacaaaagtacagttaaaagctgggcacggtggctcacgcctgtaatcccagcactttgggaggccaaggtgggcggatcacaaggtcaggaatcaagaccatcctggctaacatggtgaaaccccgtctctactactaaaaatacaaaacattagccaggcgtggtggcaggcgcctgtagtcccagctactcgggaggctgaagcaggagaatggcgtgaacccgggaggcggagcttgcagtgagccgagatcgcgccaccgcactccagcctgggtgacagagcgagactctgtctcagaaaaaaaaaaaaaaaaaaaagtacagttaaatagaaagaataagatctagtgttcagtaatataatacggtgactatagtcaacaacaatttattgtatagttcaaaacagaagaattgggatgttcccaacataaaaaatgtttgaggtgatggctgtcctaattactcttgtaaaagaaaataaaatcttaggaccccaaactcattataccaaaaggaaagttaaacctagaaaattagtcatgcaacactgcctttccttcctcctctttccccccagagctataatttcacaaccctgtgtcatagcattacacgttaagtcagcattgtcccgcaatggcaaaaggacatatacctccctcacaaatttctcataagaaaatcccttcctagtcactaaacctttcaggatacatatcccctaaaaccagcacatgccaattgtaaccttgggtgtgcaacctaagtttaactctcaaaactgagttctgttaaatctcatgctgacaatgtcaattacaagcttaccttcttaggtacacaacagggacaagacaaaaaatcactccttcgatcatgtcttttgcagggacatgaatggaggtggaagccattatcctcagccaactaatacagcaacagaagaccaaatatcgcatgttctcacttataagtgggagctgaatgatgagaacgcatggacacattgtggggaacaacacacactggggcctatagggatggtcaggagagcatcaggaagaataactaatgaatgttggcttaatatctaggtgatgggatgacctgtgcagcaaaccaccagagtacacatctacctatgtaacaaacctgcatatcctgcatatgtacccctgaacttgaaataaaagtttaagaaaaataataatagtaataacccaagggaataaaatgaaattatcaaaaaaaaaaaaatcactccttcggctaacccgagatggatgcataactgactctttcctctactccatcttttcaaatgtttaccttaccttatgtaaaacacagatttactgagcactaattagagcctcacaaaaatgtaaccatttgtctcactgcctctcttaccttcctttgtcccttctgcttgctctttattcttcaatactgagttccagaaaccctcttttggaaagcacaggtaacagatgctcctgtgacttgtgtttttcccaggtgtatccttaaactttggcttaataaacctctgattgagtcacatttttggttaatatactgatttgatcattacacattgtatgcatatatgaaaatatcacatgcacccccaaaatatgtacaactattatgtatcaataaataaaaataaactgtaaaaataaaaaatatacaagtttaccaattttttgagtcttcatttacttatgaaggctcctgtatcatataaaatttatattaaattttatgcttatgaaatacaatagaaaaatggttgtagaatacagataacttaatgaataaaacacaaatgtccaacatataaagaactcaacttcacaagtaaacagggagacacaaaagataacagtaggttttcctcattcaattggcaaaagttaaaaagtttagtaacatgtgttgaagaagttgggaaaataaattctctcatacactaatgatggcagtcattttggaaggcaatttggcagaccatattaaagtgtaatgcaaacacattatgatctgacaactcctgagaaatacatgcatatgttcacaagaccacatgcataaggatgttcactgcagaggttttaatagttaaaaaaaaaaaaaaactaaaactaaaaacaactatgatgtattcataccatggtatactttgcagcaattaaaaagaataaggtggatctacgtgttctaaaatgaaaacaaaaaacatccaaggcaaactaatgagaactgtaaataattcttggcaaacaactccatccaaattcttgctctaagagccttgaccaactctagcaaagcttctagtagcctagcccacctccactcagccctggaatacccagcctccttttgagctccagtctgtctggagaagttcagggctatcaaaagaagcttactgtttattctagccaacacctgactataggcccctgaccttcctttcttagagcactaagaagagtttacaattgtaaattcttcctctgtccctttgagatgtgtatgtatctcctacaactcagcagtgtctttctcaagaaccagaaagccactcctttgaaatgtaatcatcaggaaggtttggatctctgtgtcccagtctctgtggaaggacagaatcctaattttgataactgtcagcgagcaggcacacctgacccactcacatttacaatgaccaactatcttagcctggagctgctataacaaagtatcataaactgggtggcttataaacaacacaggtttatttctcgtggttctggaagctaggaagtccaagataaaaacaccagcagatttggtgtctggtaagggcccatttcctggttcttagatgacgccatctcagtatgtcgtcacatggtagaaggaacaaatgagatctcttgggcctattttaaagggtactaatcgcattcatgagggctccactctcatacctaattacctcccaaaaggccctacctcctaatatcaccaccttgggggttaggatttcaacatataaatgtgggggaaaaacaaacattcaaaccacagcaccagccctttgtaattttcactttcctgacgctacttgagccctcagttgctccccttccgtactccctcattctccctttaaaaggcccagtcatgactgcacaaatcatggagctcagctctttcccctattgccagtggttactgaataaaatttgtttttaccactttaattgtcttgatttttttattcacaagtgtcaaagttgtaagcagataaatactgaataacaccatttatttgaagcacagcacccacaataacagctgagttgtatctgcagtattttagatagttttatgaaaagaatgtatttaggtacattaatttttttttttttaagagacagggcctcactatgttgcccaggctggtcttgaactcctggcctcaagtgatcctcccacctcagcctcccaaagctctgggatcacaggcatgaaccaccacacttaggcttaagtacattaatcttaatgaattgcatgaattattttgaggaaaacgtactcatatttgaaactttagaactcttttttaaaattaatgtagattgatggataaatatataataaaacacatatagcaaaattttaattgtagacttgagatggtaggtttatgggtgttcaacacaaaattctttcaacatttatgtaagattttttaaagtatcataataaaatgttcaaaaattatcattaaaaagaaaacatagcaagtagtgtattttaaagtctttagccattaaaaatgtgcaaagtttgaacaaagttgaattactaaaacttagataaattagatataatagtaaagaataattgtggggtaggggtgattttttccacaaactctttttaaggcacaaaaagtacagtgattacagaaattttttctgtattttaggaggtagtccaaaagagtcaagataagaattatatgccttattaatctttgtcttggcccagttctctggcaaacagagcctgattaaaatgctgatgtttcacttgagaggtgcatacacagggcatcaaaggtgaagagaaggtaaactgaggcaagaaaatatataaagcaagggaaagtgctggctaccattttacaacaagctataaaaaaaatagtaggtcacttaacaaatgcatccacttggtgtactctttgtggaatgtctcctgatagactacaaaaagaaaccatacctcagagtagtccatgtgggaaaagaaatttatctggcaggttccctcctgtctcctatttcccactggtcaaagtccaccctgaagtacactgcacttcattttgtgtcatctggccttcacagatgcttagggtgctacctacaaggatgttgtgtggcgttatacccaagattggaagtggcaggaggagccagaccctcccagagtatggttcataaacttagctagatggtggccaccaaggcatagggccctcattcctcagatgaagcaactggttagcctccagtggcagcagaaaattctacgaggcagatggtgccaagggactctgaaggggcacataagattatgtttgatataatcacaatgcaacatgagaggaagataagacttaaaaaaaaaaaaatctgtcacataaaaatagggcaaaaactagggtaaatccaatctctaagagttattctcagttacagcatttaaatatctcacacttcatcactgtgctttggtggtgatattctgtgatgttaagcagttaagacaatcaaaacctaggatttaaggaccttgaaaaccctcacaaaaccaaaggagtcaaattataaaatttactccacccatgctacatgaatcacagacctactctatataatctaaatttacatatatcttcacaaaatagctcccagctgtctattaaggatctctgtttggccaagtcttgtccttggtgtaaaaatatgttgagctaaaggagcctctctgcctcagaagctggcctgccctttagatgaattttgtatactgcaaacattgctaagctactcttatttattttagccattctttcacttaatcattttatcagtatagtcaacattatgtttgctggtggcgtctcacaatattcactacaccactcactcattgtgttgcagccagaaaatctgggtgaaataactctcacttctaaggaaggagatgaaaagtatgtgcctgcttcgtacactgaggattctcagaaactggtaaggattcctcttcacgatggcaaactaagactgggattagaaaaacccctggtcacaggaaagtggtcagcaatagcacaaagttaggaaatcttatttagtgattctgagtaggaaccatctgcctgtcatgagatagatgagaaaaagcgtgtggccacagtagttgctgggatccatcatttaacatgagtggagccagtctaagaatgcaacccatcctgcagatgacagatggaataaatagaaagaaactgggctcatgacaatatcctttaaactgctagaccagtcagccctgaagcctggaatttccagttatacatgccaataaaaaccttcagttatataagctagtatttttatcgatacttgaaccaaaagcatattagctgatataaaaatatattctttttggttatttttttctttcccttgtgttttcttctttgcctatgttaccttgctcaaattaccacttctctgacattttgtttttaaatgaggattcaaatgaaagacaagataggaagacagttcattctccaaaaagtagaggctgaatgtcattattatttcaactattctatagttttgggttttttttgtctttccattgagctatgattgtaccactgcactccaccctgggtgaccaagcaagatcctgtctcctccgccccactcccccaccaaaaagaaacaggagataacaaatgttggcaagggtgtggagaacagggaaccctgtacactgttagtgggaatgaagattggtgcagccattatggaggttcttcaggaaattaaaaatagaactaccatatgacccagcaatccctcttcttggcacacacccaaaggagatgaaatcaccatctcaaaaatctgcactcccatgttcgctgcatcatgggagcacacacacatacacaaaatagaatatcattcagccttaaaaaaggagactctgtcatttgccacaacatggaaggatgtggatgacattatgctaaatgaattaagccagacacagaaagaaaaatactgcatctcacgttatatgtggaatgttactttaaaaaaaaaaaaaaggccaaacatacagagattaaaaataaaacagtggttactagaacagaaaggtgggttggtgggggaggagggagaggaaatcgggagatacgcgtcagaggatacaagtagtggatatgtacgatgaacaagtctagggatctaatatacaacatgaaggctatagttaataaaattgtattaggtactttgttaaataagtagattttaggtgctctggtcacacacaaaaaacagtatatgtgatgagtaatatgttaacttgcttcactatattaccattttactgtctctatatatgtacgtgtgtgcacatgcatatacatacacacatgcatgcacacacacacacacacacatacacacatatatatctcccataacatcatgttgtaaacctcaggtatgcacaataaaatttatttttaaaatgttttaaattgagctttaatattaggtcttataccacacccttcccccccgccccccaccacacacacacacagacaaccctctagaacccatgttaattaactactgcccaatatccatatcatcaggttgttgcctcttcccttgagtgacccatctaaaaaataatgctctatactctggtggccaggtgcagtggctcacgcctgtaatcccagcactttgggaggcagagacggacggaccacatgaggtcgggagttcaagaccagctggccaacatggtgaaaccctgtttccactaaaaaaatacaaaaattagtcaggtgtggtggtgggcacctgtaatcccagctactcaggagcctgagacaggagaatcacttgaacccaggaggtagatgttacagtgagccaagatcgcatcactgcactccagcctgggtgacagagtgagactctgtctccaaaaaaaaaaaaaaaaagaaggaaatggtctatactctggagagaatttgataacccaacctcctagaaatagccctggataacacctcagtagtttcaaacatcctttaggatgatttggaaggatgcatatgagagagtcaatattcaaatgaccaggaccttttttagtacctttaggaccttttttattcacttccatccaaggcaggaattcaaaagaacagtcccagtgtataggtttcctcaaaagcccttcttaatcctgacaactaggacaagaactagaaggcaaattagttaggggagaattatcttcaatggtgtatttttgaaaggagaaaggatacacctatcatgtttccccttcttcagcagactggactactgactgtgtggatcagaaacaatgctcatacgcccaaaaatcataaaacctaatttattccctgacccaaatcttcataaaagagccctaaaggacaaaggatgatctcctcaaaactcaattgtctgtggagaattttctatggggaaaaagatatagtggctctgaatattcaatatctgattccttgcagttatgtctaggttgttatataaggaagtaagagccactagaaaagaaaacagattcaccaatcaactggtcacaaatttttaaaaatcagtttccattcaaatgtcccttaaacctcaaccataatatcaaagtctctttgagactgcatgacaatcaactacaaaatgaaacagcaaatcttgcaaaaggttgacatgataggtacttggaaagagactgacctgaatatcaaagaattttaggcccctaggaaaagttaagcaatccacaaatactatgcaaaaaccctttttatgatggggctaaaagagtcatacacaaacaaaagaagttttatcatgtcatagtttctgtgagaaaaagtataactaacttctattcaaataagcacttttaataaggatataaaatctcagccaggctcgtgcctgtaatcccacaatttgggaggccaaggtgggcaaatcacttggagccaggagttcgagacgaacctggccaacatggcaaaaccccatctctactaaaaatacaaaaattagctgagtgtggtggtggacgcttgtagtcccagctacgtgggaggctgaggaacaagaattgcttgaatccagaatgagactgtctcaaaaaaaaaaaaaatttactattaaatttggtccctttttgatagactggttaaacagaaattaataggtaaatatatttaagataacaataaccaaatttttcactatgaaagaaagggctgcaaactaaaatgaaccctggggtactatattagaattggaggtattggtatgagctgatggtttttaatatttatagataaatatagatgtaatcatatatagattttcgagttttgactgctagaagagctaaaagcaataacactgcagtatcaatgagtacacctagtggtcagttcctggtttttaaatacacttctccaccaaaaaagaactagggctcttgaatgatttctacagctggggcaggaaagatcttattgtgccggaagcacaaaaacgctcaaaaactgatggggattgtcaaaaggacacaggaaccctggtaaaaggattcccattggccaaatctgagacaatctgagcatcataataaatgataacagattataacccactgaataaaacagacatttatgaatccataaaaattaattaacaaataaatgggggagaagggaaagctcttccttgcaacagaatgccaactaataaatatagatggaatgagaaaactaacatttggcaacaattatagtaataaatttcaaagtaactctccatagatactaatttcaaaggtaaaaataattttatggtgaagaaaccctgctgacaccaatttatccaaataatcaaacttattatcaccagtaatgggataaattgacatcatgtgccttctgattgatatactaagaactatttccgtgatatttctgccaaaaatgtgtaaactaaaactaattataaggaaatatcaaacaaacccaaactgataagcattcaacaaatgattggcctgtactccttaagttaaaaagtcacaaaatagaagcaaagactaagaaaacgttccagattgaaggcaactaaaagacacgatgactaaatacaacacatatcctggtccagcaggaaaaaaaaaaagtttattcatttttaaatttgtttctgccataaaggacgttgtcttagtccattcaggccgctataacaaaataccataaactgggtagcttataaacaatagaaatgtatttcccacagatctaaaggctgggaagtccaagattaagaaactggcagattcagtgtttggtaagggcctcctttctggttcatagatggcactgtctcctgtgtcctcacatggtgaaagagaaatggcaactctctggggcctgtttcacagaggaaataatctcattcatgagggcttcaccctcctggcccagtcacctcccaaagccctcacctcctaatattaataccatcacattagtgcttaggtttctacatatgaattttggagaaacagaaacattcagaccatagcattgtatcagtgttaatatcctgattttgactgttgtacttctgtactttatcatatagcagcctgtccttgtttaggaaatacatactgaagaatttcaggtgatggagcaccatgtcagtatcttattctcaactagtactgaaacattacacatatacatacaatacacacaaaaatgttaaatttgtggaagttttttatactatccttaattttttcttttttctttttttgagatagagtctgcactcacccaggctggagtgcaatggtgctatctcagctcactgcaagctccgctcctgggttcacaccattatcctgcctcagcctccagagtagctgggaatacaggcacccaccaccacgcccagctaattttttgcatttttagtagatatggggtttcactgtgttagccaggatggtctcgatctcctgacctcatgatccacccatctcggcctcccaaagtgctgggattacaggcctgagccaccacacccagcctactatccttaattttttctgtaatttttaaataatctttaacatcaaaaagtttaaattgaaagcacaacaaaataacactgtttaacttagattgtcaaatatcaaaaatatgaatatatacttacatatagattgagcatcacaatacatgataaatgcactcctcacgcattgctgatgagagtataaacctgtactaacctctgtagaaggcaatttatcattatccatcaaaatgctaaaggcatataccttgtgatgagtatcctactccaaggtatttatgaacatagtctcctatatgtatatattatatagatatttattgtagctctatttgtaataacgaaagatcccaaacaaactaaatatccattattaagacattggttaagtacatttggcacatccacacagtggaattagttttaaaaataagatagttctggccgggcacagcggctcacgtctgtaatcctagcattttgggaggctgaggtgggcggatcacttgaggtcaggagttcaaaaccagcctggccaatatggtgaacccctgtctctactaaaaatacaaaaaaattagccaggtgtgatggcaggtgccgtaatcccagctactcaggaggctgaggcagaagaatcacttgaacccagaggcagaggttgcagtgagccgagatcacgccactgcactccggcctgggtgacagagcaagactccgtctcaaaaaaataaataaataaataaggtagttctaaatgcattgacaaaaagatttcagtgatatactgttgcagtaaaaatgcaatgtatagaacaaggaagctagtgaacaattatttagatggagaaaaaaatatatatgtatacaaatatgtttctagaatacttcaaaaaagacatacaaaaaactagtaactggttacctctggggaagggaagtagacagctatgtaacagggaagggagactttttactatattccctttttgtttgtttgtttgagatggagttttgctcttttttgtccaggctggagtgcaacggcgcaatctcggctcactgcaacctctgcctcccgggttcaagcaattctctggcctcagcctcccaagtagctgggattacaggtgtgcaccaccacactcagctaattttgtatttttagtagagacagggcttcaccatgttggccaggctggtcttgaactcctgacctcaggtcatccacccgcctcagcctcccaaagtgctgggattacagacgtgagccaccatgcccggccaactttttactatactcttaacatcttctgagttttttaccatgtgcgtgcattaccttttaaaaaaaaaaaaaagtcacaagggattacatattgcatgattctcattacatcgcatatccagaataggtaaacccatagagacagaaagcaaattagtggttgccaggggctggaaagagaggagagaaagagagtgactatttaattgatctggggtttctttttagagaaaaatgctctggaactagatagaagtgacagttgtacaacattgtaaatatgctaaatgccacttaattgtatactttaaaatgattaaaatggtgaattgtatgttatgtatattttatcacaattaaaaaacaaacatttatgaatacaaataaaaccaataaaatattttaaaatatattagtttcatgatagtaatattttgctaagtttaaactgctaattacaatataaatatgataccaacagatttgacacacatcttttgtgtttaacaagccttttatccaataggggatgagatggcttaattcattcaccatccctatttgaatatgggaaaccttcatttggcaagagtataccacttatacagttgtttacttgttctcatctgcaggcataaaatcttgtaatggcactcaattataaggcagctatccaaaagatctagcacgagcgtatacacttttattcatatcatttaaaagaaaacacaaaagtctaacttatctgagaatttataaacccttgagaatatgcccaaccatctccaaggacctaagacccacttaagaaacatttagctaacttctccaatggggaaagatttttatcactcccctgttatacctttaatcttccactcttcactacctttttcctctcagcctacaacatactaccttaaaacaaaaacacaacaaaactctctagccccctaccattcctcgagatactacttccttcactaccgaatttatttatttacttacaaactttatttacatacttactcgcattcacttcctccactggcctatttccattcatcacatatccattacagcatgacttttgttccaaaacacttgtgaaattattctctcaaatattaccagagcctgcaaactataatgttccaatagcctctttgtggctacttgacttccctgaagcactctgaagccaaagacagccaagagactcaactagagaaaactgtaagtttctcaggatctctttgttcagtcacaaaacatttttaaatctatatagtttgatttaaaaccttaacaagagaacattcctgcctttgcatgtcacagttttgtgaaggagattcaggtaaacagataacagaagatggcatagtctcctctcacagttcttcagaatgagaaagaatcagaaagaataaaaaaactttctctttttctaaagaaactatatagctctgaatacccaagagatctggggcttcctgtatttatttctgagactcctgtaacaaactgggtggctttaaacaacagaatttattctcccacagtctggaaaccagaagtccaaaatcaaggtggcagcagggctatgctctctctgaaggttctaagggagaatctttctttgcttctttctagcccctggtggtttccagcaatcatgggtggttattccaatctctgcttccaccatcacatggtctttttccctctgtgtttctatctctttcttcataaggacaccagtcattaaatttagggtctatcttaatccagtatgactttatcttgattacatctgcaaagaccctatttccaaataagttcacattcataggtaccaaggcttaggactttaacatatatctttaggagacacaattgaagccactacatttcccctctcccagaatttggtttttgaaagcccagggtcaaaagtactgaactggattgttcatgaaaagaaacacctgtggagcttggatcaaaaaagatagaagtgggtcctatggccattctaccacaacccccaaagaaatcacattccctaagctttgggggaagtcattagtggtagacctacatcttcattctcacacaaaggatattatctgtaaacacgcagtgttatgaagagactcaaagtgtcccgtgaattcaagaaagtgaaaatgtacttatcagggctctttcagttgaaagagaaaccaaactgaaactagcttaagcaaaaatgacattaacaatgaactaaatattatgaattactattaatcctgtttggtataataacaatgtgtggttatgcaggagaaaacatttatttcaagaaatacacacttaagtggctagaggtaaagtggcatgatatatgcaacttattttcaaaaggttgaggggagtgcatctacatagagaaaaagagagaaagcacacaaatgaggcaaaatgttagtaactggtgagtttaggatgttaattgcgtcattctttcaactcgagagtttgtaggcatatttcaaaataaaaaggtgatggggaaaatgacatatgttatttaactgggacatacagatttgtagttcatttcaaggtggattagatcaagaatgaaaaagatgtgaaagggtgagtggatactaaacaggtctctcatctctatgcttttctatatgctacatccctctccaacaatccaccatagagaacaaaacatttctcacaaagcttttttccccaatttaacctctttctgaacaagaaacaggagggtatcaggaggttggcacaggttctccagtccactgaatgtactaatcagagaaaggattacgggattaggagttgagtaagttaactccctctttattttatcttaactcttaactcccttctcaaatttagcagggaagagaatgagaaactatggtagaatacaaataaagcccaagattagtaacataaaaggtattatattccagagtctaaatgtcattttctgatgaagaaattagaaaagaactgggcatacatggatcattttctacctcgggcttaaagtagaaaagaaaatctgggaaaacagaatagtcacctaacaaggatggaagcaaggaaggaggaagtggggaaaatagggaggaaagaagggagagcaagtcagtaagatagagcagagctaaactgccatgcccagagctgttcctagggatcttcctatactgaatcagctcaaaaagtctttctccaccttgttctgacaccagtcacagcttttgaaaagttatgaggagcacataaatggcaccaagataatggccagttaggtaaatacagaattcctttctgtccggacaagatacaaacccattcacaggtaaaattcattaatcatcaggaagtccaagaacttccttcaaaatggtgcttagggcactttgttgatttgcactggtatcataaggatggcagttactattctgtagcccaacagatggggccggctggctgaatctgttcattcaaccaaaacatgaataaaatgtaatttggaaaaatacagtctaatgatggctttcacaagaccaaataaacatctatgaaccatcttaattatttttttagttacctaacaaatagtgttctcttacatatacaaaaagaaccataatcattattttaactcagttcaacaatagagggatggagcatttgttaaatgcttggttttcatgcaagtatgtatcataataattcaactctgatttgaagtactccagactctaatgaattaacaagtaactactttcaagttcaactctccaattttagtcctattaacatgctttttagaaaaaaaatgtataaatcctatctttaaacacaatcttggttcttgaggaaaagatcacatttgaccaagtttataatcaacagtcttaagcatacatctactataaagcactttaatcacacagttattaatccaatcactaaagataaattatgacaacaaaaaacctgaactaccaacaatgtagtggtattacatcaacaattttctaatataacatattcattcttaaaacatcatttaaagaatactgtaatactattggtcaagcataaaccttatcaataaaaagcagtcttacctgtatgaggtggatctaatgttgccagtgtaggtgcttcaaaacaatattttccactgcaattatctctgttattgatttctctagtactttcttcactaggcagatttaaactgcatattctaagatcattttgtgacgggagaaaggtgttattaattgcaacaccctaaaagaaacaaatatatatttaaatcagaactcaaacctaattttctgtattttctgtatttttacataaaagattctaatttaaaacaggacatactggttatatatataaactagaactagatatttaaaaataaattaatatctgctgggcatggtggctcatgcctgtaatcccaacactttgggaggccgaggcgggtgaattacttgaggtcaggagtttgagaccagcctggccaacatggtgaaacactgtctctactaaaaatataaaaattagcctggcgtggtagcaagtgcctgttatcccagctacttgggagattgaggcaggagaatcgcttgaactcaggaggcggaggttgcagtgagccaagattgtaccactgcattccagcctgggcaacagagtgagactccatctaaaaaaaaaaaattaactaattaattaaaatctaatttttattgcttgtttttagaactattttaaattatgctactaaaactgaatgatatgacagaatgaaaaattatgcttataattatagtgtattttaaacatatcagaagtttttaaacaaatcataacatgccattctcataataaaatgctctttttcttgttaaatttctcaatactaaaatcaatacttaaatatttttaggtgagataatggtaatctcactatgttgggtttttttaacaagcccccacctctttttttaagagatggggtctcggtctggtacccaggctgaagagtgcagtgtcacgaccatagctcattgcagccttcaactcctgggcccaagggatcctcccacctcagcctccctagtagctggaactacaagcatgtgccaccatacccagctaatgtttttttttctgtagagatggggtctcactatgttgcccaggctggtctgaactcctggcctcaagcaatcttcctgcctaggcctcccaaagtgctaagattacaggggtgagccaccatacccggccttaaaaagctcttatattttagggacatattctaaaaatttacaaatgaaagcatattcctggaatttgcatcaaaataagaagggagggacttgagctggagtggaaaactaaagatgaaacaagaggccgggcgcagtggctcacgcctgtaatcccagcactttgggaggccaaggcaggtggatcacttgaggtcaggagttcaagaccagcctggccaacatggtgaaaccccgtctctactgaaaaaacaaaaattagccagacacggtggtgcacgcctgtaatcccagctgctcaggaggctgaggcaggagaatcgcttgaactcaggaggcagaggttgcagtgagccaagaatgcaccagtgtactccagcctgggcgacagaacaagaccctgtctcaaaaaaataaaaaattaggccgggcgcagtggctcacacctgtaatcccagcactttgggaggccaaggcaggcagatcacgaggtcaggagatcgagaccaacctggctaacatggtgaaacccggtctctactaaaaatacaaaaaataagctgggcgtggtggcgggtgcctgtagtccctgctactctagaggctgaggcaggagaacggcgtgaacccaggaggcagagattgcagtgagccaagattgcgccactgcactgcagcctgggcaacagagcgagactccgtctcaaaaaaaaaaagatgaaacgagatcagtcatggccaggcatggtggctcacacctgtaatcccagcactttgggaggccaaggcaagcagagtccttgagctcaggagtttgagaccagcctgggcaacatagtgaaactcagtctctacaaaaaatacaaaaattagccaggcacagtggtgtgttccaatagtcccagatactttgaacactgaggtgggaggatggcttgaggccaggaggccaaggttgcagcaagctgagatcacaccactgtactccagcctgggcaacagagccagaccctgcctcaaaaaataaaaataaaaaaaagatcagtcatacattttcaattgttgaagttaggtaatatggacaaggaagttcattatgtgctattttctcttttttttgtatatgtatgggttttctattgctgctctctcaaattaccagaaatttggtggcattgaacaacacaaatttatcattttatagtttcgcaagttagaactcagacttaggtcttactgcattaaaatcaaagttatcaccagggctgagttcctttctggatgctccaggagagaatatatttccttgtcttttcaaaattctagaagccaaacaaattctttggcttagccctcttcctccatattcaaagtcaactatgttacatctctctgaccctgcttccctaatcaccatctctttctctgatcctcttccctctctctcttccacttctaaggacacttataattataatgggcccactcagatcatccagggtaacctccccatctcaaggtccttaacattaatcacgtcagcaaagtctcttttgccatgtaaagtaacacagattccagtgattaggacatgaacatgtttaaagggccattttttctgtctaccacagtagtaaatggttgaattttttttaaatagaaactcacaataataggcaaagttgtcatgttattataaatactcatctttttttttttttttttttttttttttttgagacggagttttgctcttgtggcccaggctggagtgcaatggcgcaatctcggctcactgcaacctccgcctcccaggttcaagcaattctcctgcctcagcctcccgagtagctgagattacaggcatgcaccaccacacccggctaattttgtatttttagtagagacggggtttctccatgttgaggctggtctcaaactcctgacctcaggtgatccgcctgcctcagcctcccaaagtgctgggattacaggcgtgagccaccacacccggccataaatactcatcttaataaatttcatggttagtaaataaattttccaaaaaaaaacctgataaattttttttatattttttatatctgatcagatattaaagtaagtcaactaatgaaggtcacaaattttcttttttgcaacattttattttcatataatttcaaattcatggtaacattccaaaaatagtattcctatatacctttacccatattaaccattggtttacattttcttccatttccctctcctcctttgctctgtgtatgtgtgtacacacacacgtgagagtaaactgcagacgctatgctccttcgcctctaaatacttcaaggtgtgtttccaaagactctcttccataatcacagtaaaattatcaaaattgattatttaacactggtataataccagtatctaatccacagtctatattcaaatttggtcacttatcgcaataacgtctgttatagatttttccccaaatcaggatccaatcctagatcacacattacatctagtcagtatgttcctttagtttccttcaatctctaacttcattcatcgtttctggtcttgaaatttcaaaatttcaaaataaggccagttattttgctgaatatccctcaatctggatttgtctgatgtttccctatgattagtttcagattgtgaatttggggcaagaatacaacagttcatcatattaggaggcacataatatcggtttgttccattaccagaggtattaactttgatcactgattaaggtggtgtctgccaaagtatttttccctttgtaatttttttaagtatgttgtgaggagatacttgaatatattcaaatatcctatttcctcattgaacatttacccactagttttggcatccattgagactctctaacaccatcattacttctacttctatgctttagcattccactgtaaggaagagtttaatcttcatttatttatttattcatttatttacatatattagtatagattctgactcctgtattattcaatgggctataatccattagtatatttcttttgatgttcaatttgtcccagattttgtatttatcagaccaatcaagtaaacaccactgaagtcactaaagcaatactttctcactataggttaattcaatctaagataagaaatagtttaaaaacaagaagttaagaatgtaacagacaaagtaaaaagacggcagagttgactgctaagcctaatacttttaggcttctcatgttaccttgcttaaaattgctgtataatttcaaaaatgccccacttcagttttaaaaagtaaaataactatttaatttatttatagaattaaaagaaaaaaatagtaaatctgtgtttttgcctagaattagtccttagacattacatcaaaaaacaaatcttggccaggcatggtggctcacacctgtaatcccaacattttgggacaccaaggcaggcggataacctgagatcaggaattcatgaccagcctggccaacatggtaaaaccccaactctactgaaaatacaaaaattagctaggcgtggcggcaggcacctttagtcccagctactccagaggataagacaggagaattgcttgaacccaggaggcagaggttgcagtgagccaggattgtgccactgtactccagcatgggtgacagagcaagactccatctcaaaaacaaataaataaataaataaataaataataaatattggttggacacagtggctcactctagcctgggcaacagagcgagacttcaccttaaaaaaaaaaaaaaaagacagttctccaaagagatacacaaatgggtaataagcacacataaaagtgctccatatcagctatcagagaaatgcaaagcaaaaccacaatgaggtactactttacccactagtatggccacaatcaaaaagataataagtgttggtagggatatggaaaaattaaaaccttcatacattgatggtaagaatgaaaatggagcagtcagcttggaaaagagtctgtcagttcattaagaggttaaacatagaattatcatatgatccagcaattctactcctaggaatacactcaagagaaatgaaaacatggccaagtatggtggctcacatctgtaattccaacactttgggaggctgaggagaggactgcttgagctcaggacttagagaccagcctgggcaacataggcagaccccatctctataaaaaatttaaaaattagcctataaaatttaaaatttaaaaatctctaaaaaaatttaaaaatgatggcacatgcctgtggtcccagctacttaggagatggaggtgggaggatcacttgagcctagtaggtggaggctgcagtgagccatgatggtgccatcatcaagaccctatctcaaaaaaaaaaaaaaaaaaaagaaagaaagaaaaaagagagaaacgaaaacacatatccacacaaaaatttgtacacaaacgttcatgagtattactcataattgctaaaaagtggaaacaacccaaatgaccattaactaatgaatagatatataaattgtggtatattaaaacaacagattattcagtgtggtaggcagaataacggctcccaaagatttccacaccctaatccccagaatctgtgaatgtattgttatgtggtaaaaaggactttgcagatgtgattaaggaccaggaccttgaaacggagagatgatcctggattacccaggtgggcctaacctaatcaaatgagttctagctgcagaaaaccaaagagaaggaaacatgagaactcaaacgtgcttccctggctatgaagacggaagaaggggaccatgagccaaggaatgtggtgacctgtagaagctggagaaagccagggaacagatttcccctaaaatctccagaaatgaatatagccttaccaacaccttgatcttagatctgtgttgaacttttgacctacagaactataagataattcatttgtgttgttttaagccattagatttgtggtaatttgtttcagcagcaagagaaaactgatatttcagcaataagaaataaattcctgataaaaagtttctttttggtgtcatgaaaatgttctaaaattgattgtggagatggctgcacaattctgtgaatataataaaaaccactgagttgtagtaagtagactgtatggtatttaaattatatctgtattagtttgcattgctataaaggaatacctgagacaggtaatttataaagaaaagaggtttattttggctcacagttctgcagcctgtataggaagcatggtgccagcttctgtttctgatgagagcctccagaagcttataattagggcagaaggtaaagggggaaactgcatctcaatcacaagagggagagcaaaagagggaggggggagatgccgcactctttttaaacaaccagatatcatgtggactcagagcgaaaactcactcattaccatgaaaacagcaccaagccattcatgaaggatccgcccctcatgacccaaatatctcccattaggccaacctcaaacactggaggtcacacttcaacatgagattctgaagggacaaatatccaaactctatcaaacctaaataaagctgtattttaaaaaggaaagaaagaaagaaaccttattaagaaaacaaaagcctatgttttctccttacagtgtgccagaatttttacattggtaagtgctaaacaatctacttgggaaagaaatataggataaaacaaacacatacagaccaaaaaaagcagtcaaaaattagaaggttttttcagcaaaaaaagacaccattaaaaaccaggcaaagaccttaaatagacatttttccaaagatatacaaatggccaataagcacatgaaaagatgctcagcattgctagtcattaaggaaatacaaatcagaaccacagtgaaataccacttcacaactactgagatgccaataataaaaaaattttttaaatggaaaataacaagtgttcctgaggatgtagatactacaaccatcacacattcctgatgaagatgtaaaatggtacagctatgaaaaacagtttgacggttcctcagaaagctaaacacagaattaccataatacccagcaaatccatttctagttataatccaaaagaattaaaacaggaacacaaacagaaacttggatgccaatgttcacagcagcattattcgccatagcaaaaaggtggaaactgcccaagcatgcatcaaatagatgaatggatggataaacataatgtggtaaaaccatataatgattattcaaccatacaaaaaaattaagttctgatacacactacaacatggatgaaccttgaaaacattatgctaagggaaataagccagacacaaaaggacaaatattgtatgattccacttccatgaggtacctagggcagtcagatttatagagacaaaaagtagaatcgtggttatcaggagctgagtggagagaatggggagttaatgtttaatgggtacagagtttctgtttggggtaatgaaaaagttttggaaacagattgtggtgatggttgcacaacagtgtgaaagtcattaatgccacttaattgtacacttaaaaatggtaatgtggcaaattttatgttacatacgcttaaccacaataaaaaagaagagggaaaaaattaatagactttaatccctataacataaaaggatcagggaattgcagagtagtaggtagtgtgaattctccattttatatgccttctttatactttatatgcctttcatatatactaacgcctttgatcttagacctaagaccaaaacaatcctttttcttaacagtaaatgagacacattaagactgcttccagtattcactttttttttttttgggggggacggagtcttgctctgtcacccaggctggagtgcagtggcatgatctcagctcactataacctccacctcccaggttccagcaattctcctgcctcagtctccggagtagctgggattataggcgcgtgccaccatgcccggctagtttttgtatttttagtagagacggagtttcaccatgttaaccaggctggtctcaactcctgaccccaggtgatctgcccgtctcggcctcccaacgtgctgggattacaggcgtgagccactgcacccagccagtattcactttttacagataaaagtgagaaaaaatgtttggaatagtgatacaaatcattatgtattttttcctctttaaatgaccttaaagaagttttcacttatttatgtggtaactttaaaaagaacactgattagaatctccaccccttccctcaaagaggtacttacttatcattaccaaaagtttattttatagactcaagtacatgttattccattgattgattgaatgagacagggtcttgctgtgttgcccaggctggatggagtgcagtggcacaatcacagctcactgcagctttgacctcccaggctcaagtcatcctcccacctcagcctcccgagtagctgatactccaggtgcacaccaccacaccccactaaatttttattttttgtagagacagggtctcactatgttacccaggcaggtcttgacgtccttagctcaagtgatcctcccgcctctgcctcccaaggtgctgggattataggcatgagccactgtgcccagcctgttattccttttaaaaaaaaattatgtaatcttcatttccaaggtttttagaagatgttttcagagatactgaaaattcctacaggcagaaaatactgttaactctttaaatggcattttcttaaacatacatgcttctctatattatctatatcatgagtctttttttgccttacctcaaataattttatatctggattcagttttgtaatctcttcattcagacctggattacttcttcctggaggtataaattttggttttttgaaggaattcccctgcaactgacttggtgctgcagatcgtctcatattcagcagtcgtgacctgaaaaatacccaaaacagttaactatccacgaatctaattacaatcacccccaaatataaaaatagctcaaaactacaactaagatggaacagaaacccctcttatgggcctgcctggccccccaagcatagaaacaaaaggaaaatcttcagttccttcaaaggaaattccaggcacttagctagccctgaaaagtacatgagcaatatgattagcaagaaggtaatagcttaaaataatggtgagggaagttagattgacaaaatgtttggttccctctagaaactaaaggtaacatcttaacatatgtccttgagttgtttttcagaaatccagaccaccaccaaatggaaaatactgtctactggcacacagacctcagattaggggaaacaggactgaactctaactgctattattctttgttctgaatttcttcttcagaggcctggaggaagtcatacccacaagccagagctcaacattcctttctgctgaccccaagtttttagacagagcttcacttccttaaccaatcccaaatcagagaatcttttaatacatctatgactcgcaagcccccacttcaagatgtctcacctttttaggccaaatcaatgatgcattgatttatgactttgcctgtaacctctgcctccccatctttaaaaatagttacatgaaagccatcacagagtttgggtcttaaccattagctacccatttttcctcgcttggcaccctgcaataaacgcctcactttctcttgctgcaaatcccaatgtctgtggagagctttgctgtgccaggcaggccgtctcaagtttggtttggtaatacaaccatgacatatgtaaaaaggtaaaaggggccggcgtggtggttcatgcctgtaatccctgtactttgaaaggatgaggccggaggatcccttgaacctaggagcttcgtctctattaaaaattaaaattaagaaaaaaaaaaaggccgagcacggtggctcatgcctgtaatcccagcacttcaggaggccgaggcgggcggatcacgaggtcaggagatcgagaccatcctggctaacccagtgaaaccacatctctactaaaaaaaaataccaaaaattagccaggagtggtggcgggcgcctgtggtcccagctactctggaagctgaggcaggagaatggcgtgaacccgggaggcggagcttgcagtgagctcagatcacgccactgcactccagcttgggcgacagcgagactctgtctcaaaaaaaaaaagataagaggagcttggtggtgcatgcctgtagtctcagctactcaggaggctgaggtgagggggatcccttgaggtcaggagttcaaaaccagtctgggcaacatagcagcaagacttcaactgaaaaaacaaaaacaaaacatatgagaataagcctgagaaaacaggttcaggctgggcaaagtggcccacatctgtaatcccagcactttgggaggccaaagtgggaggatcacttgagcccaagagagcccatctcttgtttttttttttttaataaaaaaaaagaaaaagaaaataagttcaatagctagtaagattttatttttcatcaagggctattgaaaagaatttaagatttaaactgaacggtgatacagtttggctgtgaccccacccaatctcaccttgaattgtaataatccccatgtcaagggcagggcctattctcgtggtagtgactaagtctcacgagatccgatggttttatacatgggagttcccctgcacaaactctcttgcctgctcccatgtaagacgtggcttgcttctcctttgccttccggcataaatgtgaggcctccccagccatgtggaactgtgagtccaataaacctctttcctaataaattacccagtcttgagtatctctttattagcagtgtgagaacagactaatacaaatggtgtaaatttaagtatatgtcaattttgataatactataagcatgatatcttctttaaagcaatttaaataaaaatttcaaaatgcaaggaaatacaattcacatacaaatatcaaacatgttgcctttttcctattccactaatccataaaccacatgaaggcagcaatctcatgcttgttttctccaccactaatgactataatgtgtctggcaacagtgacagatacattaccatcactaacaaatattttgaatgaatgaaatctggcaatttaaaaggtatttttataattctacttgtttttactatcctacttcatttgaaaacagtggaattttttaaaatataaatcaagagactagaaccaggtttcccaactttcactcaatcttatttccactaggactggataggggaacagatggaaaacaaggacattacatacatacatcatgtttctgcaatggatagtagcaagcattccaattcaaagcaacaccacaaaacactatttaacataagccatcagcaaggatgaacatgactaccaacattatctgtttcacccagaaattccaattctggcaatttaacctaaggaactatcagagataatactaagtaactacgtataagaataatcagctgggcaggacacagtggctcgcacgcatgtaatcccagcacttcaggaggccgaggcaggtggatcacctgaggtcgggagtttgagaccagccaggctaacatggtgaaaccccgtctctactaaaaatataagaatttgaggccaggtgcagtggctcacacctgtaatcccagcactttgggaggccaaggtgagtggatcacctgaggtcagttcaagaccagcctcatcaacatggagaaaccctgtgtctattaaaaatacaaaattagccaggcgtggtggcgcatgcctgtaatcccagctattcaggaggctgaggcaggagaatcacttgaacccgggaggcagaggttgtggtgagccgagatagcgccactgcactccagcctgggaaacaagagcgaaacttcgtctaaaaaaaaaaaaaattagccaagtgtggtggtacacgcctgtaatcccagctactcaggaggctgaggcatgagaatcgcttgaacccaggaggcagaggttgcagtaagctgagatcgcaccactgcactccagcctgggtgacagagcaacactctgtctcaaagaaaacaaagaaaaaaaaaaagaataatgatgctagtatcaattacagtagggggaaaaagggaaacaaatgtctataatgaagtacaagataaattatggtacacccacacaacagaacactctcttcatataccaccaaaatcgagtcagtactattccccaagctagccatgttctctttttctctaggctttgaacaaactttcccttatataatgttgggaatgctttttcccacttttctttgcctaattaattctaccttatcatctaggagtcttaaccatgagccctcttcatctcctcccaaagactggactggagaccttcctgtatatgcactacccaagcacttttcacactgcaatgaaatttgccctatcattccctctgagctattaactcaggcatgaaatcttacgtacaattcatcagtatatcgccagtaccaaatacacagaagaggttcagtatttgttatgtgaatgataccattaatgggtggcgggggggggcagtactttaaaaaaatgtttaatgacaagagaaatatgttttaataaatcaaaggaaaaatggccacaaaacatgtccagcctcattctaatttttacaaaagaaaagaaaaataaaaacaataatgggtgtatgtacatttaaaagactagaaagcaaaggagcatgagagaacttgttggaggtgatagaaataatctatataagattgtagtatggttacaggagtatatatacatctgtatatgaaaacatcaaaatgtacacatctaactgcacactgtaaattatactgctataaagtagatataatatacatgttatatattaaaatacacaatcgttttttaaaaactagaaaaatacatgccacaacattaaccctaattatttctaggtctggttagaataccagtaatttttattctattctgagttattttctgtatatttcaaattttttacaatgaaaatgttacctttgtaatagggaaaagtatcattaattagatttttttaaattaccatatttcatcaaatctaaaatgccatcaattgtaagatatactcttgattgttagtccatataaaagaaatttttaaaagtaaataaaaattttaaaaataaaaattttttaaattgtaagatgtaccattattttatgtatccaagaaaaaaagtgtagccaattaaaccatgatacactatcattgatggttagacatttcccaatttcatcaatgttaaaataatgaaacatgtaaatattttatatataaccagcctttatatagtttgaggaatgagtaggagagatcactctcttctgtttcttattcaaggacaaaatagatctctattagtataatctttaatcttaaagcaaattatgaaacagatggtttttgactgctttagaagcagtatttaccaataccagaagtcagtacaaattctgaccaaacaagtcatgccaaaataacttcattaaactaatttcctttttataatgggtaagcagaatactacaggcctctaaatatataactgacacaagtttgaaattgattaacggtaactgtcacaggacgacatggatgttaggccttgcacttagactcagttacttaatggtcaaatgaaatagaacaatagaagctgaaatttaaaactaaagattttagtgactatagctcaactgaaataagataatgagccttcttaaactaataaattctagatagcattaataaaaatatgatgtccacatcatgaaatgtaatcagttctgttctctacattagtcagactcccctctaatactgtgaaaattctgacactttttaaaaaggaacacttaaaaaatacagtagttagaaacatcaacagtagaaatgaaggaaaccagagtgtagttcagattctgctatttcagggatgcttaactttggggaagctatttaactctctagacaccaattttctcatttataaaataaagaatgaactagatgctaaaatttctttcaacactaaatgcgaagaattactaccctaaatccttctacatctaatacatgatttctgatttttcaatcctcctattttgtaaactaataaaaatgataatgcaagcatacaaccatcagcacagagcagtggttaagaaaacagactgactctggagccagccaggctgcctggctagaatcccaactctgctacttacatatgaccttgggcatccatcaagccatttaatttgttgatacaaagtaaaatgcagaaatcagtacatttccccccaaaagaccattgcacccttatagctttttaaactggttctgtatgttcatattgtcctgtccataataaattaattaattaattagtgctgtctgagccctttccccaggtcctagaaataaagccatttggtagccctgatgtgatgctacaacttctataacacctattagtttcagtccttccaagtaaaatggtaaggccaagctgacaactgtaatacaccagatagccacaagtacttggcactacactgtggtaaataagaacacaactttgaaagcaaatgcctgaatataaatgtggactgacactttctaatggtcttgcacagtttactttggctccatgtgtctcagtttcctcatctttaagagggggtaccataatcatgcttacacaccggactgttgggaggattaaatgaaatatgtaaagcacttagaacaaaacttgacacatagtaagcactcaatgttatctgttataattagtattatcggagagtagaaatgatgaaggtcctgtgaaggagatagagaaggggtagttcaacatacaggacaatgaccagaatctttgggttcgtctgggctttaaagagaggtatgtgcaaccatcaaacgtcgaggatgcaagaatgtaagtacaccaactctaccaagaaccagcaacggtctctccctgctgttgctgcttgtcgacttccaactacattaggtagtaattatttcacttcatgccttaaattgctcctttgagactccggctatatagatggttcctaatttaggacggtgtcacttagaattcttcgacttttaagaaagccatgagcattcagtagaaactgtacaagtaaccacacaaccgtctgtgttcatgattttgcccaactgtagattaaggtaagtgttctgagcatgtttaaggtaggctagcgcagccataaaaaggaatgaaatcatgtcctttgcagcaacatgggtgcagctggaggctattatccaaagcgaattaaagcagaaacagaaaatcaaatattgcatgttctcacttataaatgggagctaaacattgggcattcatgaacataaagatggcaacaatagacagtggagacaactagaagggagaggaaaggaggagcaagggttcaaaaactattgggtaacatgctcactacctgggtgacaggatcaatcgtatccaaacctcagcaccacgtaatataccgatgcaacaaacctgcacatgtacccccaaatctaaaataaacagctgaaaataatttttttgataacaaaagtaggctaggccaagctttaatactcagtaggttagctgtgttttaaatccattttccatttgggatattttcaaccccgtagtaagtcgagaagcatctgttcctacctagaaaatcttccataaggtaatcgattaaaaggttttaaggaaatacaagaaaaacctgaccagtgaagaggtaaaagcccctaaagaaggcgtaccgacactctccaggacgctcgcagagccttcaccccctggccctggggaaggaaattcccagtgcaggagtgagggagagacccaaaagccaagaggagcctgcgcaaagcgaccgcagtggcggccccaggggccactgcccagaaccatccctcccacacaaacgcacaaccctaaacccccaccgcccgcccttcgctccaaggcccccggggccagcaaccagggcgtccctggcacttcagaccaaagctgcaggcccgcagaaggccacttcggtcgctcctgccgccttccctccctcctccctcgttggcctgctccggcgccactccctgctttgtcccgcacgagcctacaggctgtcgcagcctcccgagcttccccctgcaggacgcaccggcgaaaatctgacagaaaccactggccctgcaaagaagtccttctggtaaccagctatcccctcgccgccggagaagctcaaggatcccgcctcggcgaagccaatcgcggac

SEQ ID NO: 102 - DNA, 81189 bp, Homo Sapiens
tggaagtgtttgctaccaagtttatttgcagtgttaacagcacaacatttacaaaacgtattttgtacaatcaagtcttcactgcccttgcacactgggggggctagggaagacctagtccttccaacagctataaacagtcctggataatgggtttatgaaaaacactttttcttccttcagcaagcaaaattatttatgaagctgtatggtttcagcaacagggagcaaaggaaaaaaatcacctcaaagaaagcaacagcttccttcctggtgggatctgtcattttatagatatgaaatattcatgccagaggtcttatattttaagaggaatggattatataccagagctacaacaataaacattttacttattactaatgaggaattagaagactgtctttggaaaccggttcttgaaaatcttctgctgttttagaacacattctttagaaatctagcaaatatatctcagacttttagaaatctcttctagtttcattttcctttttttttttttttttttgagccacagtctcactgtcacccaggctggagtgccgtggtatgatcttggctcactgcaacctccacctcccgggctgaagtgattctcctgccttagccacctgagtagctgggattacaggtgtccaccaccatgaccggctaatttctgtatttttagtagagatggggtttcaccatgttggccaggctggtttcgaactcctgacctccagtgatctgcccaccttggcctcccaaagtgctgggattacaggcgtgagccaccatgcccaggtttcaagtttccttttcatttctaatacctgcctcagaatttcctccccaatgttccactccaacatttgagaactgcccaaggactattctgactttaagtcacataatcgatcccaagcactctccttccattgaagggtctgactctctgcctttgtgaacacagggttttagagaagtaaacttagggaaaccagctattctcttgaggccaagccactctgtgcttccagccctaagccaacaacagcctgaatagaaagaatagggctgataaataatgaatcagcatcttgctcaattggtggcgtttaaatggttttaaaatcttctcaggtgaaaaattaccataattttgtgctcatggcagatttccaagggagacttcaagcagaaaatctttaagggacccttgcatagccagaagtccttttcaggctgatgtacataaaatatttagtagccaggacagtagaaggactgaagagtgagaggagctcccagggcctggaaaggccactttgtaagctcattcttggggtcctgtggctctgtacctgtggctggctgcagtcagtagtggctgtgggggatctggggtatcaggtaggtgtccagctcctggcactggtagagtgctacactgtccaacacccactctcgggtcaccacaggtgcctcacacatctgcccaattgctggagacagagaacacaagcagagattagtgtcaattcattctcctggactaggctctaatcaatcgactccagggtcctggttgtatgagttcttaggattaatgaggtagaagctaattttttttttttttttttgagacggagtcttgctctgtcgccgaggctagagtgtgatggcgcaatctcggctcattcaacctccgcctcctgggttcaagcaattctcctgtctctgcctcctgagtagctggaattacaggcacatgccatcacacccagctaatttttgtatttttagtagagacgggggtttcacaatgttggccaggctgctctggaactcctgacctcaggtgatccacccaccttggcctcccaaagtgctgggattacaggcgtgagccactgcacctggcctttttttttttttttttttttttttgagacggagtcttgctcttgttgctcagcctggaatgcaatggcacgatctcagctcactgcaacctccacctcccgggttcaagcaattctcctgcctcagcctcccaagtagcagggattacaggtgcctgccaccatgccaggctaattgttttttcttttttttcagatggagtctcactctgtcactcaggctggattgtgatggtgtgatctcagctcactgcaacctcaacatcctgggttcaagcgattctcctgcctcagtctcccaagtagctgggactacaagtgcgtgccaccatgcctggctaattttttttagtatttttagtagagatggggtttcgccatattggccaggctggtctcaaactcctgatgtcaggtgatccgccctgaggctgaggcaggagaatcatttaaacccaggaggcggaggttgcagtgagccaagactgggccactgcactccagcctgctaagtgacagagtgagactccacctcaaaaaaaaaaaaaaaaggcaatgcttcaggacataaggccttgctctgaagaggccctaggagtgactcctggtgacagtgaaagcccacagcctctggcaactgtattaacatgaacttcaatctgttaaaggaaagccaccaggaaaacagcactgtaatttaacgatgtggaaaaatgtatgtaatatcttaaggaaaaaagcaaaacagtgtaattatgatcacattttataaaatacacgtgtatatatacgcacatatgcctggtggagttttatggtgatcatctccaagtggtggaattactgggattattttattgtttttgtgtaaatttatactttcttttttctttttgagacacggtctcgctctgtcgcccaggctggagtacagtggtgtgatcgtggctcactgaagcatcaacctcctgagctcaagtgatcctcccacctcagcttcccaagtagctgcgactacaggcatctgccaccacacccagctactttttaaatttgttgtacagatgaagtctccttatgttgcccaggctggtctcgaacttctaggctcccaccttgacctccatcttgacctcccaaagtgctggaattataggcatgagccaccatgcccggccttgatttatgtttttgtgatgaacattcatatcttactcccaccccatggaaacagttcatgtattacttttacaatataaaacaaataacaataaaaacatcaaaaagacattttagccattcattcaacaaatatttaaaatgtgccaagaactgtgctactcaagcaccaggtaatgagtgataaaccaaacccatgcaaaaggaccccatatagcacaggtacatgcaggcaccttaccatggaagccattgtcctctgtccaggcatctggctgcacaaccacaattgggtggacaccctggatccccaggaaggaaagagcattcaaagtgtcaaagtaggactactggaactgtcacttcatcattttttttgtttgtttttgagacagggtcttgctctgtcacccaggctggagtgcagtggtgtgatctcagctcactgccacctctgcctcctgggctcaagcaatccttccatctcagcctcctaagtagctggaactacagacacgtaccaccacccctggctaatttttttgtatttttggtagagacagggttttgccatgttgcccaggctggtctcaaactcctgggctcaacttcacccccgggattataggcatgagccaccgcacccagccttggctaatttttaataatttttttgtagacatgaggtcctactgtattgcccaggctggtcttcagctcccaggctcaagcgattctcccaccttggcctcccagtgttgtgattacaggggtggggcactggcccagcccatcatttctctctctctctttttttttgagacggagtctcgctctgtcgcccgggctggagtgcagtggcgcgatcttggctcactgcaacctccgcctccggggttcaagcgattctcctgccccagcccctcaagtagctgggactacaggcgtgcgcccctacgcccagctaatttttgtatttttagtagagacggggtttcgccatgttggttggccaggatggtctcgatctcttgacctcgtgatctgcccacctcagcctcccaaagtgctgggattacaggcgtgagccaccgcacctagcttttctctctctctctttttttttttttttagacaaagtctcactctgtcacccagtctggagtgcagtggtgcaatcttggctcactgcaacctctgcctcccacgttcaagcgatgctcacacctcaacttcccaaatagctggcattacaggcatgctccaccaggcctggctactttttgtttttttttttttagtacagatggggtttcaccatgttggccaggctggtctcaaactcctgacaagtgatccacctgcctcggcctcccaaagtgctgggattacagacatgagccaccatgcccagcctccagcccatcatttcttgatgatttgttgaaacacagtatgctggggcagtcacagagaggagggggagggacatatgggaaaaagagttagagggaaaaagtcttccctcagtatatttaatatgtgcagttctcaaatccttacccatcccttacagatggagtcttttggcacaggtatgtgggcagagaagacttctgaggctacagtaggggcatccatagggactgacaggtgccagtcttgctcacaggagagaatattgtgtcctccctctctgacagggcacccaatacttactgtgccaagggtgaatgatgaaagctccttcaccacagaagcaccacacagctgtaccatccattccagttgatctaaaatggacatttagatgtaaaatcactgcagtaatctgcatacttaacccaggccctctaccctacactctccggatgaaggcttatagcaagacctctcaatgggagagtctgtctctctgctccaaaggacaatggtcttaaaatagtaggggtatggattttaagtcaatttgccactgatatgccatgtactctggttatcagtctccataaggccacttggtataaggtttgatagtctctcaaataaaatgcttgaaagaaaaaaaaatcaaagatctaatttccattaatttgctaaattgctggctaagacactgtgtgaaaaaacacccaccttccttccctcccttcctcccttcatcctaattctgtgttggtaactgataatcacggccactgaaaataccatacttggtggtaattactgtaaatgtcaagagatgggaagataattcatccagtcaaaaaaatacatgttatcctggttagagactcagcagggaaaggctacatgctgagctggaatccatatactcaggggaataaaaatcagaagagactgtggagatgctgtgtacctggaaaatcagaactgcccaatgggctctgttggctgtgttcttcaagacattcatgtatgttgctctttcccatcagcccgtttctgggaattgctgaggtgctcctgtctgtctgactgaacgaaggttgactaactcacccccaaaataatactttctggcaaccctggtttccactataccaaagtaaaaaaacactgagaaatccttgagtggaacttggaaatttcataaaaatccaattgataactaataaagaggatggaaacaaaattacattgcagccaggttttcttgctgtcactcatctgcctgtgaccagatgctaaggcctttctctaaggtgtaagaggacctaagtccctgggcagaagcaggcacaggaggcaaaggtgggtagcttttgctgtgaaaagaacaaaccaaatttatacacacaccaaggcctttgtgctgcgcaactccagaggtaagctttatagcagtcctaagcataacattgtattaagtgtcaagtttaattagaaaatgttcatggagagggctgggcacagtggctcatgcctgtaatcctagcactttgggaggctgaggcgggtggatcacgaggtcaggagatcgggaccatattggctaacacggtgaaaccccgtctctactaaaaaaaaaatacaaaaaattagtcgggcgtggtggcacacgcctgtagtctcagctatttgggaggctgaggcaggagaatcacttgaacccgggaggtggaggttgcagtgagccgagatcgcgccattgcactctggcctgggcaacagagactcgacctcaaaaaaaaagaaaaaaaaaaagaaatgttcaccgagaatcttcccctgctctgggcccgtccgtggtgggccagctgctgtgctttcttctatgtaagtaaattaagatggtttaggaagaggagaactcctccttgatttttacctatccaaagatattttctcactaacatgttggcactaacagcagctcaacgccatctgaacacataacatactgaatcctaactattaaccaccttcatgctcttgagaagggggacaaggtatagtttttttttgccataggataacatttaggtgctgttttgtttggagagtggtagagaaatagaatagcctctagaacatttcagcaatctgaggaacccccatcgtgggatcttgcttataatactccactatgtaagacaaaggctggtgctggaactctggggttctcccaggctcttacctgtgggcatgttggtgaagggcccatagcaacagatttctagccccctgaagatctggaagaagagaggaagagagagggacaggggaatggagagaaggaaaatctagttataaaagaatattggcttttattcaaaaaacagactttcaaaaaggaagagcttttctttttcttctgttcaccacctgatgatttctgctgctacttcccagggacaagcagtccaatgtccagaacactactggatttcagaagatcttcttgaagtgcatatgtagttgacctgcactctacaggcattctttgtcattcaaggactgagcatctcacttttgtcaccaatcaggccaaggctcctccctaatgatctctgcaggtgctttaacttgttagatgcaagggaaaaaaggtccttctgtatgtttaataagaggcttggatggctagaaactcaaagttattggctgaagtttgatgtttatccagacttggtacctcaagtactcactatgaccccatcaacagaggggtctatgttgattttaggtgtacatgctccttgtctcctctgacttttttttttttttttgagacggagtctctctctgtcacctaggctggagcgtagtggtgcgatctgggctcactgcaacctctgcctccagggttcaagcgattctcctgccttagcctcctgagtagctgggattacaggcgcgcaccaccacgcccggctaatttttgtatttttagtagagacagggtttcaccatgttggtcaggctggtctcgaactcctgacctcgtgatctgcctgtcttggccttccaaagtgctgggattacaggcataagccactgcgcccggccctctctgactttcttctagccccctaaacatctgttccttccttctcactactctgagaatggccattgtatctttaggccacctaagcagtttttaatctagaagtgaagccaggttctgcctctcctcattgaactagtctgactacctggtttcctgaagacacagatcacactgcactgcctcttccacttacagggcttggcaacactgttcaaaacaactttctgtgatagtcacaatgttctatatctatgctaataaggtagccatgagtcacatatagttattgagcactggagatgtggttagggtgaatgaagaactaaacttcatattttaatttttttctttttttttgaagagatgaggtctcattctgtcactcaggctggagtacagtggcacgatcatagcttgctgcagtattgaacttctgggctcaagcaatcctcttgcctcagcctcctaagtagctgggactacaagtgcacaccaccatgactggctaatttgtaaaatttaaatttaaacagtcccatgtggctggtggcaacagtgtgggacagtgcaaattctcataaacacactggcataggttcttagcaaataacttgggtatcacttaaaaataaaccctaaaattgtatcattttggatggatatgttttgggtgactctcagtgtcttgaccttcccattgcaataaaaagaaaattgccaaggcctaaaattcacctggcttcaaagagactgcgatagagaaaaaaatcaggaagctaaaaatacacggatggccttttagaaagtggtcaccctcccccttgacagacagacggacagaaacacacacacacacacacacacacacacacacacacacacacactctcttactttaccgccagagtgaaaagaaatggcagtaggacaagtctgtgtgttttttttttttttttgagacgcagtcttgcactgtcgcctgggctggagtgcaatggtgccatctcggctcactgcaacctccacctcctgggttcaagtgattctcctgcctcagcctccctagtagctgggattacaggtgcacaccaccacacccggctaattttttgtatttttagtagaaacggggtttcactatgttggccaggctggtcttgaactcctgacctcatgatccacccgcctcaggctcccaaagacaagtctgtttgttttaagggacagcatccatctgtgccactctcactacctgtatgaataaaccgcacccccaacctgttgataggacctgcatgctcataatgctagaagttctccccaggcagccaagtggagccaaatgctgacatgaaaagtacaaaagattaggaatgtttatatccaggctaacactcagtgatgaggatgcctagttatgagataagaaatttgaagtttcgggcttggcgtagtggctcacgcctgtaatcccagcactttgggaggctgaggcaggcggatcacgaggtcaagagatggagaccatcccgtctaacacagtgaaaacccgtctctactaaaaatacaaaaaattagctgggcatggtggcgggcacctgtagtcccagctacttgggaggctgaggcaggagaatggtgtgaacccaggaggtggagtggagctggtagtgagccgagacggcgccactgcactccagcctgggtgacatagcgagactctgtctcaaaaaaaaaaagaaatttgaagtttcaggccgggcgcggtggcctgtaatcctagcactttgggaggccgaggtgggtggatcacttggggtcgggagttcaagaccagcgtgaccaacatggagaaaccccatctctactaaaaatacaaaatcagctgggcgtggtggcacatgcctgtaatcctagctacttaggaggctgaggcaggagaatcacttgaaccctggaggcagagattgcggtgagccaagatcacgccattgtacttcagcctgggcaagaagagcaaagcttcgtcttaaaaaaaaaaaaaaagaaatttgaagtttcacctctacatatacatttctcttccagagaaaaatactatggtgacatttagtattttcagaatgtcattactttgaccacatactttccatcattgctattctgcatggaggaaaaaatccaaagcactagaatttctttttaaagaggggaagaatctggtgctaatactgcctagcatacagtggaggaaaaacagaggactggctcacatggcgctcccctgtggtaaaggcagaagcagaaataaggccagcagcttttcttggcatctggaacaattacttgataggctcagaaggtaaaaacaggctgacctcagcagttcaaaactccaggcttcatttgtgatcatgtcccaaagcagttttccttaggaaattacctctactggttccctcttaagtttctataaagggacagaaagtgctcagtagaaggatgttttgttttgttttgagacaaggtctcacaatgttggccaggctggagtgcagtagcaccatcatggctcactgcagcctcgacctcccagactcaagcattcttctcacctcagcctcctgagtagctgggaatacaagagtgtgctacgacacccaattaatttttaaatttttttgtagagacagggtcttactatgttgcccaggctagtcttgaactcctgggctcaagtgatcctcctgccttggcctcctaaagtgctgggattacagaagtgagccgctgtgcccagctgggattttttttttttttttgagatgaagtctccctcttgtccccaggctagagtgcagtggcgcaatcttggctcactgcaacctccgcctcctgggttcaaccgattctctagcctcagcctcccgagtaatcctgagctaggattacaggtgcctaccaccacgcccagttaacttttgtatttttagtagagatggggtttcaccatgttggccaggctggtctcgaactcctgacctcaggtgatccacccgccttgggctcccaaagtgctgggatcacaggtgtgagccaccgcgaccagcctgggatgttctgaaatgcctggtagtgcacacttgaaaaaggaagaaaagcagactgggaacatagcacttagggagctgagaaagcagccagctcaggcctgacaggtaagtgtgaaatcttgcagactttctccctgtgaggaagtcagagttctggctaagtcatctgctacaatatgatcaggagaaagtcattgagtcttcttgggtctcatctgcaaagttgttagaatgctccattttttttccctccgtgaagccttcaacaacttttcaagaaactatagtattgttgttaagagtttagaattggaggccgggtgcagtggctcatgcttgtaatcccagcactttgggaagccaaggcgggtggatcactggaggccaggagatcaaggccagcctggccaacatggcaaaaccccatctctaataaaaatataaaaattaaggccgggtgcagtggctcatgcctgtaatcccagcactttgggagcctgaggcgggcagatgatctgaggtctggaatttgagaccagcctggccaacatgttgaaaccttgtttctattaaaaatacaaaaaactatctcggtgtggtggcacgtgcctgtaatcccagctatttgggaggctaaggcacgagaatcacttgaacctgggagctggagactgcagtgagctgagattgcgccactgcactccagactggccaacagaatcagacaaaaaattagctagttgttgtggcacatgcctgtaatcctagccacttgggaggccaaggcacaagaattgaacaaggtttgaacttgggaggtgaaggttgcagtgagcagagatagtggcactgcactccagcctgggtgacagagtaagactctggcccgaaaaataaattaacaaagaatttagacttggagctagacttcctgagttcaacttctagttccatcacttattacctgtgtgactttgagcaacttattcaacctctctgagcctcaattttcacatctgtaatataggcataattacagtacatagctcatagagttgtcataaaattgttaattagttaaaacatggttgggcctttagagcagtcccagcataaagtgatcttttttttttttttttcttttgagatcttctgtctgtcgtctaggctggagtgcagtggcgcaatctccgttcactgtagtcccctcttcttgggctcaagagatactctcaactcagccttccgagtagctggaactacaagtacatgccaccacgcctggctaatttttgtatattttttttggtagagatggggttttgccatgttgcccaggctggtatcgaactccttggctcaagcgatctgcctgcctcagcttcccaaagtgctgggataacaggaacgagccgctgtgcctggcccagtgaacattatataaattttagctattattggctgggcacggtggctcacgcctatcccagcacttggggaggccaaggcgggaggatcacaaggtcaggggttcaagaccagcctgggcaagatgagttttcagtgagctgagatcgcaccactgcactctggcctgggcaatggagtgagactccgtcttgggaaaaaaaaaaagagagagagagagcaagagagagagagagaaagacaccccagtgaagtgaaaagagcaaagtctttagattctcatctgcttaaagtcccagctcttccacttatcagctaagatctgaacccgagacgggaatccaaattacacagcctctctaaatctcttagttttatcattcataaagtagagacaatacttatttatgtggttgggatggaagagtgaaaaaagaacctgtgtgaaagtatctagcactgtgtatgtatgtaataagtcttacaaaatgaagcggcccatctctgcaaaggggagtggaatacagagtggtggggtgagatttttgtcaacttgagggagggagctttacctttctgtcctgggattctcttgctcgctttggaccttggtggtttcttccattgaccacatctcctctgacttcaaaatcatgctgaaagaaaccaaacacaacccatcaggataagagaaagagaagcttccttcaatggaagtggagcagacacgtcatatttaaggcattcaggccaggcgcagtggctcacccctgtaatcctagcactttgggagactgaggcaggcagatcacttgaggtcaggagttcgacaccagtctgaccaacatggtgaaacctcatctctactaaaaatacaaaaaattagttgggcgtggtggcaggcacctgtaatcccagctacttgggaggctgaggcaggagaatcttttgaatgcaggaggtggaggttgcagtgagctgagatggtgccactgcactccagcctgggtaacagagcgagactccatctcgcatctcaaaaaattaaaaataaaattaaaaaaaaaaaaattaggccgggtgtggtggctcacgcctgtaatcccaggactttgggaggccgagacaggcggatcacgaggtcaggagatcgagaccatcctggctaacacggtgaaaccccgtctctacttaaaatacaaaaaaattagccgggtgtagtggcaggcgcctgtagtcccagctactcgggaggctgaggcaggagaatggcgtgaacccgggaggcggagcttgcagtgagcggagatcacgccactgcactccagcctgggcaactgagcgagactccgtctcaaaacaaacaaacaaacaaacaaaaaaaccaaaaattagctgggcgtggtggcatgcacctgtagtcccagctactcgggaagctgaggcatgagaattgctggaatccaggaggcagaggttgctgtgagccacgatcatgccactgcactccagcctgggtgacagagtgaaactctgtctcaaaaaaaaaaaaaaaaaaaaaaaaaatttaaggcattcagaattgccaggcaggcagtagctgggcaccaatggctcacacctataaccctagcactttggcactttgggaggctgaggcaggaggacagcttgagaccaggagctggagacccagctgggcaacacagtgagaccccttctctagaaaaaagatacataaaacctcagccaggcatagttgcatgtgcctgcagtcccaatttcttgaaaagctgaagctggaggatcacttgagcccaggagttggaggctgcagtgaactgtgatcataccaccacactcccgcctgggtgacaaagtgagactctgctaaaaaaaaacacacacacacacacacataaaacaaaaaaaagaaagaaagaaaaagaattgctgggcagagatttgaccaaaagcaagtaaaatcattctttttggtagaccaggtgaaatgactaggatctcagctgttgaaatcaattcactgaagcaaatcttttgtgtgcagaacttaacaatcggcttttcacctcactgggacttaatgtattttaattttcaacatctatctcctctcaaaacattcacttagcatttagattagactgctaatactgtgctgttataaaggtaactgaaaaattccctatctcctaaatcaattgtatattatcatctaaggaaataaaggcttttcagatttccactgagagatttacagttaacacaaccaaaatgataaaatatacattcaatgcactaaagaaagttagaggtttttcataattactattatgactggtcatggacatgagaataaagaataatgagactggggagaaatttgaggaagaacgctcagaaacaattctgactgaaactcagattgtagggaaggccttatgtgttgccaagagtattgtgaagaaaactaaaggcaagagtataaccactggctattactaggggaagaatatctgacatttcctagttacttgaatgaggagtctagtgataaatttgtcagaagactcccatgttcatagtcctccttgtacccctgagcttcatacaatgtgtccaactgcctacttaacttctctatccagaagtctagtatacatctcaaaattcatgcatctggccgggcacagtggctcacacctgcaatcccagcactttgggaggccgaggtgggtggattacctgaggtcaggagtttaagaccagcctggccaacatggtaaaaccccatctctactaaaaatacaagtattagccaggcattgtggcaggtgcctgtaatcccagctactcgggaggctgaggcaggaaaatcacttgaaccgggaggcggaggttggagtgagctgagatcgtgctaccgcactccatgcactctagcctgggcaacagaacgagatgctgtcacaacaacaacaacaacaacaacaacaacaacaacaacaacaacaaattctcacatctaaaacagagttcctggttccattcctgcttcctgcctttcccactcccccatattccctaccatgccttcttcatctaatttaatattactaacaagatctattgttcaagccaaaacccaagtgtcactccttcaatttctctttaccttatcctccaaatttaatccattagcaagtcctctcttcaaacccatcccaaaccaaccttgtttttaaccatctccacaccaccaattaccacaaggataaaatctgaattccttaccaccaaatactatgtgatctggccctcatctatgaccttctcccattccttgtgtaatctctgcctccacacataatttgcaaattactccagctacactggcctattattattattattattatttttgagacggagtcttgctctttcgcccagcctggagtgcagtggcgcaatctcagctcactgcaatctccgcctcctgggttcaagcgattctcctgccccagcctcccaagtagctgtgattacaggcacatgccaccattcccagctaatttttttttgtttttgagatggagtttcactcttgttgcccaggctggagtgcaatggtgcgatctcagctcaccacaacctccacctcccgggttgatgaagtgattctcttgtctcagcctcccgtgtagctgggattagaggcacgcgccaccacgctgggcaaatttttgtatttttagtagagacagggtttctacctcagtgatctgtccgccttgacctcccaaagtgctgggattacaggaatgagccaccacacccagccgtgcccagctaatttttgcattttttagtagagatggggttttgccacgttggccaggctggtctcaaactcctgacctcaggggatctgcctgcctcggcctcctagagtgctggaattacaggtgtgagccactgtgcccgaaccttttatcattattatttcttgagacaggagtcttgctctgtcgttcaggctggagtgcagtgatgcgatcttggctcactgtaactcctacctttcggttcaagtgattctcctgcctcagcctctggagtagctgggattacaggcactgggattacaggcacacaccaccacaccatgctagttttttgtatttttagtagagatggggtttcaccatgttggccaggctggtctcgaactcctgacctcaagtgatttgcctgccttggcttcccaaagtgctgggattataggcacgagccaccacacacgaccaacattggcctatcttttaaaaaataaaccaagctctggccgggcacagtggctcacacctgtgatcccagcactttgggaggttgaggtggttggatcacttgagttcaggagtttgagaccagcctgaccaacgtggtaaaaccccatctctactaaaaataaaaactagtcgggtgtggtagcacgcgtgcctgtaataccagctactcaggaggccaaggcaggagaattgcttgaacccaggagacagagtttgcagtgagccaagattgtgccactgcactccagcctgggggatagagggagacaccatctcaaaaaaaccaaaatacagaaatcaaaaaaccacactcattattacctcaagacctttatgtttgctattcctctgcctataagatgcattcccttcatttttcaaggacaattatttcttgttatttaggtctcagctcaattttttcagaaaggctttccctggcctccttaaacgaaagtaatcaacaacctttgacagctaatactattccactgttctgtatatttctccatagcatttattgttatcttaaattcatctttattgtgtatctcccctcgacagaacctgaatcctaccagggacttagttagtcttatttactgttgcattcctagtgcccagaacacagtaggctcccaataaatagccactgaataaaagttaaaaccaacaaaaataatcatttaattaattatgaatacatcgaattgtgcacaatagtttataaaattactttttttttttttttaagacagggtctcattctgtctcacaggctggagtgcagtggtgcaatctaggctcactgcaacctccgcctcccgggttcaagtgattctcctgcctcagcctccccagcagctaggattacaggcacatgccaccacgctcgactaatttttttgtgtttttagtagagacaaggtttcaccatgttgaccaggctggtctcgaactcctgacctcaagtgatccacctgccttggccactcaaagtgctgggattataggcatgagccaccacgcctggcctataaaattactttcacatttcattttgcctgatctgttgtcacagaagttctcagatggctgttctgaaattattcctcctcctacactctatcttatttacttctcactgttctcagtatcataaagtgcaacatctttttgaagcaatctgaattataaacagatacatttgcatgtatatatatgtatatatgcatatgcacacacacacttttttttttttaagagacagggtcttgctctgtgcaagtgcaagagtgcaatggtatgatcatagctcactgcagccttgaactcctgggctcaagtgattcttctggcttagcttcctcagtagctaagactacagaagcacactgccatgcccggctaattaaaaaaaaattttgtggagacagagtctcactatgttgcccaggctggtttcaaactcctggcctcaagtaatcttcctgtctcagcctcccaaagggctgagattataagtgtgagccactgcatctggactgcatattaatatgaagagcttttcttcaacaacagtgaacagttttctacaaaggtatatgcaagtgggcccacttcttgttcttatgaatcttttctttccttttataaaactccttttcctttctcttttccccaaagaaaggactgtttcttttgaaatctagaacaaatgagaacagaggatatcctggtttgcgctgcaaaattttttttttttttaagacggagtctcgctctgttgccaggttggagtgcagtggcacgatcttggctcattgcaacctccacctcccgggttcaagagattctcctgcctcagcctcctgagtagctggaactaaaggcgcatgccaccacgctgagtaattttttgtattttagtagagacagggtttcaccatgttgcccaggctgatctcgaactcctgagctcaggcaatctgcctgtcttggcctcccacagtgttaggattacaggcatgagccactgcacccgattttttttttcttttgatggagttttgctcttgttgcccaggttagagtgcaatgatgcgatctcagctcactgcaacccccgcctcccaggttcaagtgattctcctgcctcagcctcccgagtagctggaattacaggcaagtgccaccaagcccggctaattttgtatttttagtagaaacggggtttctccatgttggtcaggctggtcttgaactcccgacatcaggtgatccaagcgcctcagcctcccaaagcgctgggattataggtatgagccacagtgcaggcctgcataattcttgatgatcctcattatcatggaaaatttgtgcattgttaaggaaagtggtgcattgatggaaggaagcaaatacatttttaactatatgactgaatgaatatctctggttagtttgtaacatcaagtacttacctcattcagcatttttctttctttaatagactgggtcacccctaaagagatcatagaaaagacaggttacatacagcagaagaacgtgctcttttcacggagatagagaggtcagcgattcacaaaagagcacaggaagaatgacagaggagaggtccttccctctaaagccacagccctttaataaggcttgtagcagcagtttccttctggagacagagttgatgtttaatttaaacattataagtttgcctgctgcacatggattcctgccgactattaaataaatccctagctcatatgctaacattgctaggagcagattaggtcctattagttataaaagagacccattttcccagcatcaccagcttatctgaacaaagtgatattaaagataaaagtagtttagtattacaattaaagaccttttggtaactcagactcagcatcagcaaaaaccttaggtgttaaacgttaggtgtaaaaatgcaattctgaggtgttaaagggaggaggggagaaatagtattatacttacagaaatagctaactacccattttcctcccgcaattcctagaaaatatttcagtgtccgttcacacacaaactcagcatctgcagaatgaaaaacactcaaaggattagaagttgaaaacaaaatcaggaagtgctgtcctaagaagctaaagagcctcagttttttacactcccaagatcaatctggatttatgattctaaaacccctggtgacagaatcagaggctgaaaacaccactaattataaccagcaggtatggatatttggaagtctaggggaggctgatatgaagttaagaccagaggaaatatctgtccactccctcttctcaacacccatcttctagacgccaaggctagctatagatctccattatagtgttcaaggaattaggaattatccatgtcaatagttttgattaatgtggacggagaacatctatattactagatggcaatatgtgaaagaagaaaacagtattgttgaaaacctaaatctgaaatgtcaatgtaatgacaaattttcacccctagaatgtctacctggggagtcctaaccctctaatattcccctgagagggatgggagaatacagtgcagagcttttatataagtatttcagaaagcagtagctaaagaatcacttgtttatttcccagtgtttcaaaggcccttctgaagaactaagcaaactaaggaaagaccatttagttttaaacaggagaaatgtatttaactaaatcctaaacacagcaggctatctgcaagcagcagcagcagcagcagccatgctccctcacagaatccttacaatttttgaagttttttgtttaactgctacaaaagccgatttagtaacatttattacacttaaaaacttcagttcatttgtagttcaaagcaaatgtattggctttgagtttaaagactgaactactttagatttgatttgcatttttttttttttttttttttgagatgcagtcttgctctgtcagccaggctggagtgcagtggctggatctcagctcacggcaagctctgcctcctgggttcatgccattctcctgcctcagcctcctgagtagctgggactacagatgcccgccaccatgcccggctaattttttgtatttttactagagatggggtttcaccgtgttagccaggatggtctcgatctcctgacctcgtgatctgcccgccttggccccccaaagcgctgggattacaggcctgagccaccacgcttggcatctttttacctttcattaactttgatgcaaacctatagcttaaggtatcttaaactttaatgacatttttctctaaaatagtagtttgtaataacttgttctggcacctggctccaatgaacactaccctctgaccctgtggtataattttcatgagtaagtggaaacctaagatcttagaagttcaacggcaatgtgtccaaggggtttagatcctctccttaagtgcctgtatctctgtgaaaagaatcatcataggctaggcgcgatggctcacacctgtaatcccagcactttgggaggccgaggtaggtggatcacctgaggtcgggagtccaagaccagcctgactgacatggaaaaaccctgtctctactaaaaatacaaaattaggtatggtggtgcattcctgtaatcccagctactcgggaggctgaggcaggagaatcgcttgaacccgggagggggaggttgcagcaagccaagatcgtgccattgcactccagcagcctgggcaacaagagtgaaaaactacacctcaaaaacaaaaacaaaaacaaaagaatcatcatcaagtgaactggaacacatccagagaactaattttgttagaaagattttagagttgagccacacaatctgcatcttctgcgtcctccatgcactcgtctgctttctggagccccatgagtgagtcttaatcctgttccagataacagttctcttccgggtaacggttcttcagatacttgaagacagtgtcttatttccttaaatcttctcatttcttcttcaaaagacagtatttcaagttacttttatgtatctttaccatctacctctggataaacactctccaatttgtcagtgaccatgttaaaaaccaagcacggtgcttaaaactgacatcatctttcaggcaatcactccattggagaatacagtggggctctggatctgtacttcacttgctccagagcctctgcttgtgttaatacggcccagtttcaaataagcatttttagcagccctgaaatgtgtactcagatttagtttatagtcaactaaaaacacccagaggtctcctgtattacacaagttataattaaaaccttaaaagagaaaggtataggacaaatgatctgtctcctcccttttttgctttttcatatgttaagactatctcggagctgttatcagacttttttcctgaaaaactctcaacaatactcaaactaggtgttacatgaagctggggtctccaggttttgcctcacttgttctttcttttgttgttgttgagacagagtctcactctgtcgccaggctggagtgcagtggcaggatctcagctgactgcaacctcagcctccagagttcaagcaattcttctgtgtcagcctcccaagtagctgggattacaggtgcacaccaccacgcccagccaatttatgtatttttagtagagactgggttttaccatattggccaggctggtctcgaactcctgaccttgtgatctgcccgcctcaggctcccaaagtgctgggattactgatgcgagccaccgcgtccagctgcctcacttgttgttttaggacttaggctccacctcaccagtgtagtcccagcaggtagataggagttaatagttgactatctcagctcaccaccctccaaaccttttttttttttttttttttttgagacaagaatctcgctcttgtccccaggctggagtgcaatggtgcgatcttgggtcactgcaacctccacctcctgggttcaagcgattctgctgcctcagcctcctgagtagctgggattacaggtgcctgccaccacgcccacctaatttttatatttttagtagagacggggtttcaacacgttggccaggctggtctcgaactcctgacctcaggtgatccacccgcctcggcctcccaaagtgctgagattacaggtgtgagccaccgtgcctggcccacactccaaatcttaacccaaaacaaaaggaggtaaggaagcagcaaaactattatttgtctttcataaagtaattgattgactattagaagactatcatccatgctatgctcaacaaatattcttattttttcacgttttttttttttttttttgagacggagccttgctctgtcgccaggctggaatgcagtggcatgatctcggctcactgcaacctccatctccccggttcaagtgattctcctgcctcagcctcacgagtagctgggactacaggcgcacgcgaccacacccagctaatttttttattttttagtagagacggggtttcaccatgctggccaggatggtctcgatctcctaatctcgtgatctgcccgcctcggcctcccaaagtgctgcgattacaggcatgcgccaccgtgcctcgcctcatgtggttttatgcagcagatgcaaggtattctgtaaaggttcttggtatacctgttttcataacaacatgagtagtctcttcagtaattagattagttaaagtgatgtggtgttttctggcaaacttgtacacgagcatctgaaattaaatcaaatattccattatcatgagttacctctagcacacagctcagaatactagttattccaccatggcatatgtttacctatgtagcaatcctgcacgttctacacgtgtcctggaactatttaaagtgaatttttttttttttttttttagacagagtcttgctctgtcacccaggctggaggtaaaaaaaaaaaaaaaaaaaaaatagaataccagttatcctagctttaagtctctgtttttctcagaaagggtacatttaaaaaattctaagacacctgaagtctcggctgggcgcggtggctcacgcctgtaatctcagcactttgggaggctgaggcgggcagatcacaaggtcaggagatcgagaccatcctggctaacacggtgaaaccctgtctctactaaaaatacaaaaaattagccaggcgtggtggcgggcacctgtagtctcagctactcaggaggctgaggcaggagaatggcgtgaacccaggaagcagagcttgcagtaagccgagatggcgccactgcactctagcctgggcgagagtgcgagactccgtctcaaaaaaaaaaaaaagatacctgaagtctcaaataaatagtttaataaaaattatgtacacatcagcagacataaaattacaactaaggattcaaaataatattataaacctactacgtaccacaaaacttaaaacttaaaaaatatatactgggccagacacggcagctcatgcctataatcccagcactttgggaagctgaggtgggaggactgcttgagctcaagagtctgagaccaagaccagcctgggcaatacagtgagatttcatgtctttaaaaaaaaaaaaaagtaaaaagaaaaaatatatattaattttgctttaatagcagatatcattcgattccctaagatcgtttctttgcatagtgacactctactgtactataaatttatcagcctacactttataagctgagaggtaactagcctacacagaaagttatgctacagatatacatggcttaaaaccaagactcaaccctctgatagttacaaaacactgaaatcaggatgttactaaaggtcagtgcaaaagcgatcaattctctcgtaagaaggcttagaaggggttcatgttcttccccaaagaaatttagagtcctctagctattatctatcaaccaaataaaaatcaataggcagcaaaagaaattaaccagatcaattatgggcacagttgacctagctggtaggtattgtctgataaataactttgtttaccaagggccatcatttactagccatagccacagccactcacaccagtatttacgtgttgcacaatactgccatgaaggtcaggccatctttctttcatgttgcctcactccatactgccacagggcactgaaaaaaggcaggctagagaagctaatgacatcctcccccttttgctaccaccctccgccaggatcattagcaattctgaactgattaattgctgaaatcccagccttgaaactgttcagttagaagagcaatgctgaactgctgaaaagatcatcttaatatgggcttcagaattaatcatgtgtaatacagtcagtagctttcatcataaatttaccacacttcaccaagtctgaatagagctcaaagttttcctcttcgcttgtttaaagacaacatgtacccaagccacttgtagtctaatctgcagctcagaattgcctttgccaagaaagattagaccattttagccatctctaaaaagctgaacttgcaaaacaaagggataaagaacgctaattttcaatgaataaataaggaattctggacgtgcaggcaagtgatcaagagccattgaaacagacacaggtaagagctttcagagcaaattgctggtctggacatgggattatgagatgaaaacatttatagccatcactgtgcacttactcattgtatctaccagggcagccacagcttactttgcccttttagtagtgggatacatctggccacagagatgttatgctaagtaactacctatggagaagttaggatgaaaaatcctaggaaggatatattaataaagatatttcagaatgacttggtcatctctcagtgtgcaataaatggcacacccactactgaatccatttgataatctggtatgttatctcatcatagttttaaagaaatattcacgcaattcttcttcttattattgagacagagtttcgctcttgttgcccaggctggagtgcaatggtgcaatctcggctcaccgcaacctccgcctcccgggttcaagcaattctcctgcctcagcctcctgagtagctgggattataggcatgcgccaccacgcccggctaattgtgtatttttagtaaagatggggtttcttcatgttggtcaggctggtcttgatctcctgaccttaggtgatctgaccacctcagcctcccaaagtgctgggattacaggcttgagccaccatgcccggccatgcaattatttttattatgaagtgatgacaatgacaattaattacaggggtggtaaacttctcaggatgtctgaaatccacaaatagcccaagcagaaacgaggttttactggtcttaatattttaatgggtatttttccacagtatgaagcaattcccatttctggcattaaggacccaaggtgatgccaaaatcctaatagcaagggatattgcagggcagaagtggcagggcattcttacaagccaggatgaaaacaaacactagagaaatgctactatctggcagtacatttggaaccagtctgaatttagttaaatatgctggtaaattcacccatgtgagacaagggggagaaaaagatgccttctggggaataaaactatacctacttgcttttacagatagaaaggaaaattccaattcgaaagtcctatatcatacccaaagtatagcttttccactaatatttaataattattttctcaagtaaatatacataaaataatccacactatagctttatctagatctaaattttcagaaattagtaatcgaaattaaattacacagaactgtgattgttttctagatttcttcctctaggttattaattgacaatacctacataaaactctttccagaatgttgttaagtcttagtcattagggagatacatatggatacactcacaaattcttctggggtcaggccagacaccaccatggacattcttttgttgaccctttctgttgaagctgtcaattctggcttctccctgctcacactttcttccattgcattatacccagcagtatcagtagtatgagcagcagctggactctgggcagattctgcaactttcaattggggaactttcaatgcagaggttgaagatggtatgttgccaacacgagctgactctggggctctgtcttcagaaggatcagattcagggtcatcagagaagaggctgattccagattccaggtaaggggttccctctgaaaggaatgggagaagtttaatttacacaacgatgaatgttgaattacaaagttctggtctctgttaagaattaaaaagaccaataaagttaggttaagagaaaaatgggtacatgaatacagtgttggtggaaatccaaagtagcttagtttcctaaaaaggaaatatggcattatgtagcaaacaccttaacacgtatttacactttcagtcaacaatgctagttttagaaatatatcctagggagataaaagatatatgcaaaggtttagtcataggaatagtataattttagaaacaatgtagttgtccaataataggagattaaattacgatatacctagtccaatggagtactcttcacccattaatttgaatataaatgttgatgtacaataaaacagaaatgttactaatatattaaagacacctaagcaatattatttatcatgacattattttaaaaataaaagtttatgggccgagcacggtggctcacacctgtaatcccagcactttgggaggccgagacgggtggatcacgaggtcaggagatcaagaccatcctggctaacacagtgaaaccctgtctctactgaaaatacaaaaaaaaaaattagctgggcgtggtggcgggcgcctgtagtcccggctactagggaggctgaggcaggggaatggcgtgtacccgggaggcagagcttgcagtgagctgagattgagccattgcattccagcctgggcaacagagcgagactccgtctcaaaaaaataaataaataaaaataaataaataaataaaagtttatgtaaaatgactaaagaaacacagaaatattttattattaaagaataagagtacaggccgggtgcggtggctcaggcctgtaatcccagcactttgggaggccaaggtgggcggatcacctgaggtcaagaggtcgagaccagtctgaccaacatggagaaaccctgtctctactaaaaatacaaaaaattagccgggcgtggtggtgcatgcctgtaatcccagctactggggaggctgaagcaggagaatcgctcgaacccaggaggcggaggttgcgctgagccgagattgcgccattgcactccagcctgggcaacaagagtgaaactccgtctcaaaaaagagtacgggtaatatttttttttttgagaagggtctcggtctgtcatccaggctgcagtgcagtggcacaaacatggctcacctgcagccttgacctcctggactcaagtgatcttcctgtctcagcctcctgagtagctgggaccacaggtgtttgccaccttccagctgattttttttttttttgagatggagtttcattcttgttgcccaggctagagtgcaatggcgcgatctcagctcactgaaacctctgcctcccaggttcaagcgattctcctgcctcagcctcccgagtagctgggactacaggcataagccaccaagcctggctaattttgtatttttagtagagacagggtttctccatattggtcaggttggtcctgaactcctgccctcaggtgatctgcccgcctcggcctcccaaagtgctgggattacaggcgtaagccacccaccacgcctggccccagctagtttttttttttttttactttttatagagatcaggtctcgctacattgcccaggctggtcttgaactcttggcctcgagcaattctcccaccttggcctcccaaagtactgagattacaggcatgagcagtggctgtaatctgtccttattttatcttttaagaggtggcatctcagcttggtgaagtggctcacacctataatcccagcactttgggaggccaaggtaggaagattgcatgaggccaggagttagagaccagcctcggcaacataacaagacccgtgtctaaccccaccccaaattatcttttttattccctatattgtccaatttgggggcaatgagcttatagcaattttgtaagaaaggaaaaaaaagttgaaaaatgtggcaaatgctttatttttgtttcttcatccaaggtaatgacaccattacttttttcacttaataaatcagcagatatcattaccaaattaaaaacagcagagatgtcatccttgaaacatttcagaaaatgccatggtatcaggaattaagcatagctaagtagaatgtatgagattcctaaaatgaccctaatgaacatggccaaataccacatttgatgccaaacagtgtcttttatgataacgtgtttttgaggattaaaaactttctttactgattaaaactctgatttacaagccataaaacaccattcattaaaagtgatttttaaggcataaaatatgtagtcatttatattcattaactcataaaaaaaacttgctttgggatttgactcattttctaataaaggactggcctaaaactttattctttggcctttggactcttgtctaacagttgaaataaaatatatgtgtgtatatatatatatatatattttttgagatggagtcttgctctgtcacccagactggagtgcagtggtgtgatcttggctcaccgcaacctccgcctcccgggttcaagtgattctgctgcctcagcctccagagtagctaggattacgggcatgcactagcacacccagttaatttttttgtatttttagtagagacagggtttcaccatgttggccagacaggtcttgaactcctgacctcagctgatccacctgcctcggcctcctggagtactgggattacaggcgtgagccactatgcctggcctgaaataatacatttagagtacaccaagactccctcatcctcaaaatcattagttaaaccattaattaaaatatagatggattaacagtttcaataattttcaagtaaaccttgattaacacttgagctatttttctaaagtgggcttaattaagtataacaaaagtgtccatgatagactagtacatctaaaagttggttaaccagaatatctttatgtaggattcagagtaaaatcaaagtgtttgttccaatacagcagatgaaatattacctagatcttgccttggcaagtaagatgtttccgtcaaatcgtgtggcccagactcttccagctgttgctcctccacatcaacaaccttaatgagctcctcttgagatgggtagtttctattctgaagactcccagagcaactgtgcatgtaccacctatcatctaatgatgggcatttagaaggggatgacctagaaagataaatggaaggagaaaaccatcgccaccaattgtgaaaggacaaatcatacttgctgggcagccaaagcataaatgaaacagctcatgtcagagagatcagaaatgactggcaaaaaagagcccgcaagacagcctagaagtctggattcatgttgcctgccaatatgtcagggttgacatataacatggggttgggttggtctgaggcaccatatctcccagctgtttaaaagcaggtcagtagctgggtgtggtggctggcgcctgtaatctcagctactcgggaggctgaggcaggaaaattgcttgaacctgggagacagaggttgcagtgagccgagatcacgccactgcactccagcctgagtgacagagcaagactctgtcaagaaagaaaggaaaggaaagaaaggaaagaaaaggaaaggaaagaaagaaaagaaaaggaagggaggaaggaaagaaaggaagaaaggaaagaaaggaaagaaagaaggaaagaaggaaggaagggagggaaaggaaaggaaaggacggaaggaaggaaggaaggaaaggaagaaagaaaggaggaaagaataaaagcaggtcagcaaatttttaccaaattactcactgccactcactctatacacaatattctacttgagtctaaatggatatgttagaatcagatctcttatgaagatagaaagttgatcaatgtcgacatctctacactcattctttctactcagttttagcagaattcacagaatcatccctattgcctgccttttcaatgttcaaattcattctaaaaacaaaagccagctataaaatattgttagaaaagcatacacacccagtaaatagttcctctgctcttccaagtgcttaggactttgcaaaataagatacttatcaacagatttaaagggcctcagaggttaattaatttaaacaattattgggtgcttactatgggtcaaatactaaggctaggccccctggattgaagatgggtgagacctgaattactgctctctctctctttttttttttgttttgagacggagtcttgctctgtcgcccaggctggagtgcaatggcacggtcccagctcactgcaacctctgcctcccaggttcaagcaattctcctgcctcagcctcctgagtagctgggattacaggcacctgccaccacgcctggccctccagtaaggaaaagaatagtactggactacatagtccagtactggactgctatacagccctgtgttaatagtggtgtaaatacacatctctgaaagatattctaaatgttttctggctttgggagggcaaggcgggcggactacttgagtccaggaatttgagaccagcctgggcaacaaggtaaaactccatctctaccaaaaatacaaaaacttagtgggtgtgggtggcgcatgcttgtggacccagctactcaggaggctaaggtgggaggattgcttgagcctgaaaaacggaggatgcagtgagccatgactgcaccactgcaatctaggtgacacagggcgaccctgtctcaaaaaataataataatagtaattattattattattttctgtggtaaatcaacagctagactttttctagaaagacaagaattttaattagggcaagggctgccttgaagaagtctaccatcagtttccaagcttgttcaggttttacctccattatatttttttctgaccttcagaagggacatatctatctaaccgcacatttctcatgttgtagcttatgttataggttcaaaaaacctatataggattaaacaaaagaagtatcctagagcaataaaagtgtataaatgcctgtatgcaaaaaactggagaaagtatggtgaaaaaaattaacaatcagagttcaatataaataaagatgtcagataccacagcatctttacattgatgtttcttacctttccactcctggttctttatttttactggtagaactatctgcagacacctcaaacttgtcagcagaaaggccttctggattctggcttatagggtattcactacttttctgtgaagttaatactgctttaaatggaatgagaaaacaaatctactttactgctttgttctgatagtgataattcaggttagaatactgatttttttcaaaagcatcaatctatgatacacaaattggtttttaaacaagtatatcaggcagaattttataaacacaagcaatgcaacagacagatgctagcaccaaatggaattcaatgattaaaaaataataatgataataaaaggaacactttaagacagagtaaataaagacacccagctgagacaaggctgaaaaaaaaaatctatattccttggccctgaatgataaaaaatatatataacaaatttttatctctgcagcaaaataaattatgcccaaatcccctcagacaataggaaagaaagagtaccggagagcacaaagtacattattttctccatccctactgcctccacattgaagactgtatgaaatggggatttcagcttctgcatgtcgggggtaaacaagacatgagtgtcagacatgaaagaaaaaacaggtgacattttgcttcacattttcaattaccgaaaaaaaagaaaaaaacaaataaaccccctaaaccaacacatacacaaaaaaatcccaaggtgctggttgataagaaatcttaaataatacatggaactaatgatgaaatggcacaagaagggaaaaatcacaaaacatactgaaggcaaagttctggcatgttagttctttttttttttttgagacggagtctcactctgttgcccaagctgaagtgcaatggtgcaatcttggctcactgcaacctccacctcctgggttcaagcgattctcctgcctcagccttcctagtagctgacattacaggtgcctgccaccacgcccagctagtttttttggtatttttagtagagatgggattttaccctgttgatcaggctagtctcgaactcctgacctcaagtgatccacccgccttggcctcccaaagtgcggggattacagacatgagccactgcgcccagcctaattcattttgtaatatatttactcctccaaatgtatcactttgtgccactgccttctaggaagtggcttaaaggcagaagtacttatttatttatttttatttatttattttttttgagatggagtttgctcttgttgcccaggctgcagtgcaatggcatgatcttggctcaccacaacctctctgcctcccaggttcaagctgttctcctgcctcagcctcccaagtagttgggattacaggtatgcaccacctcgcccaactaattttgtatttttagtagagatggggtttctccatgttggtcacgctggtctcgaactcccgacctcaggtgatctgcctgcctcggcctcccaaagtgatgggattacaggcgtgagccactgcgcccgaccgttatttttcaacgagatgggtgtcttgctgtgttgaccaggctggtttcaaacttttttttttttttgagacagagtcttgctctgttacccaggctggaatacagtggcatgatctcggctcactgcaacctctgcctccaggttcaagcgattctcctgccttagcctcccaagaagatgggattataggtgcccaccaccaccccttggctaatttttgtattttttgtagagatggggttttaccatgttggccaggctggtcttaaactcctgacctcaggtgatccgccaaccttggcctcacaaagtgctgggattataggcatgagccaccatacccagcctggtctagaactcttaaactcaagtgatcctcctgccttggcatctcacagtgctgggattataggcgtgagccaccatgcctggccaaggcggaaatatttaataagtaaaaacaaatagttaaaaattgcaaaagtcttctattcattaaaaagtcactgatgactgtaattcattttgagcttttattagaaaagctaaaagccataaatataggtagaaaattgaaacaaaagattgtattaattaaactgtttttttaagacactgggtagcctggggggaaataatcattgatttcctgagttagtcttcaaatgcattatttatagtttcctttatgcttgtcttttctggacctgtgagtttctaggattgttaagaactctgttgaaagtaagtaggatctaactatgaagagaggtatcatcctccccacccccaatacagggtgataattgataaagggtaatgtgcaagttccaaggaaccatatcaaacggaattaaccattggaaagagttaaaaaagtggccaggtgatgtggctcacgcctacaatcccagcactttgagaggccgaggtggacagatcacctgaggtcaggagtttgagaccagcccggccaacatggtgaaaccctgtctctactaaaaatacaaaaattagctgggcgtggtggcgggtgcctgtaatcccagctacccaggaggctgaggcggacattgtaatgagccgaaatcacaccattgcactccagcctgggcaacaaaagtgaaacttcatctcaaacaaaaacaaaacaaaacaaaacaaaaaaaatgaaaggcagagggaaggctcagatacaaacacagctattaaaaagtcattcctccttttggccagaaccaccatctttcagtaatttgccaaaatgacgaacacaaagggaaagaggagaggcacctgatatatgttctctaggccttttagaaaacatggagttgttcctttggccatgtatatgcgaatctgtaagaaaggtgaaattgtagacatcaagggaacgggtactgttcaaaaaggaatgccccacaagtgttaccatggcaaaactggaaaagtctacaacgtgacccagcatgctgttggcatcgctgtaaacaagttaagggcaagattcttgccaagagaattaatgtgcgtattgagcacattaaacactctaagagccaagacagcttcctgaaacgcgtgaaggaaaatgatcagaaaaagaaagaagccaaagagaaaggtacgtgggttcaactgaagcaccagcctgctccacccagagaagcacactttgtgagaaccaatgggaaggagcctgagcagctggaacctattccctatgaattcatggcataataggtgttaaaaaaaaaaaaaaaagacctttggactgtaaaaaaaaagaaaagtcattctatcaccagaacatttagcatataaattcctcttcttactacaatgggcctcatgcaatgaagcaaataagataacttgttagaagttaacaactcaatagaacctgaaaaacagagcaaaacctttctgcttttttttctccttaatccttaattcattctctgaacagcaagcccaacctaagccttgtgacatgatgatctacttgctggctggtttaggaaagtctaaatgcagagatccagagtccaagtttcagaatattattgtagttcctcttaaatcattccctcatctagatgtcttaacatgttacattctttgtggataggaagtatgggccacaccaaacatttaataaacttacagactgcccactgtgtgctaagcattgtacagggtattgtgaagaattaaggaagacactggaagacaacagatattaagaaataataaactaggccaggcaccgtagctcccaagtaggtgggattacaggcatgtgccaccacgcccggctaattttttgtagttttagtagagatgtggtttctccatgttggtcaggctggtctcgagctcccgacctcaggtgattcgcctgccttggcctcccaaagtgctggggttacaggcgtgagccaccgtacccggcaacaatattctttttactagaagttctggccaggtgccatggctcacacctgtaaccccagcactttgggaggctgaggtgagaggactgcttgagtccaggagtttgagaccaacttgggcaacatagggagaccttgtctctacaaaaaataaaaaaaaaaattagctgggtatggtggtggacgcctatagtcccagctacttgggaggctaaggcaggaggatcgcttgaggaggtcgagaggctgcagtgagctgtgattatgccactgccctccagcttgggcaacagagcaagaccctctctataaggtgaggctcaggtcggggaggatggctcaagatcaggagttcaagaccagcctagttaacagtgcgtccctgtctctacttaaaaaaaaaattaaagaaaagaaaaaattatttttaaaaagttcatttgagtttcagttagactcacaccagatttagggagaaaaaggctcaaaacttatgttggtattaagttgtgatatccaaaacaattcagaaattaagcatttcagttacagatctccagaaaaaaataaacacacgtatataccaaagaggagatagtagatttacacagatattcaaagtcacacaataataacattttaaatcttacacattataattgaaagtctagtctgtgtttagactgaagatggtgaaagtaccctaaagaagagtattatactggggatgggactctgatctctcattatctgagagatgaactaaatgaagatagttacaaagaaagcatttaaggaaatacattttgaagcactgccatagcaacagagtttctagctagcttctttatccaagagctactgtttcttcctgaacacaaaaatactgcaaggcacaactggggaccaaagccactgttctgtataagtagcagacttgagttcctagaaagactccaagaaaggtcttaaagttcccagttggactgtggaacggggtgctgaagaaggaactttaacactcagataagaatcactgagctaggaatgaagtgtactttgggagtactcaccacccctgcatgtttctaagcagcatcctagtggggaccccatgcctagcatctcctatgtgtctgtttgtttgcccctatttaaaaatctgcctgatgtattgtctttccaattaaaaactcaaatttccatctcactttccttcatttatgccattattcctcagctcagtgctcacttcttataggaagtcagctctgatcaactgcatctgcctggttactccaatggcatcctctcagaggtccatctggattttttttgataactgtaacattgctataaagcacttgactctattgcataattaggctttctgtgttgttcttttcttttccttttgaactaacaggagctctacatcactaggctttctgtggatcaaagtgcagttcctgaagtataggatgtctctccctataaatcagaagcacattaaataggtctttgtgatgtgacaccagtgttataaggaatatgtctgagtactttttcatagctttctgaaattatggggttgcctgtcaccaatttctcccattccacttagcttccaatagagcaagagctatgttgtataccatgtatcttccatgggctccccatagcatctacttgttgtaggtactcagatgacaacatgaatgactgccttgggtccctctgactggtatattagttgtgagcagggacaagaaccaaggctccataattacccatgtgctgagcaaggatcataaaatgttggagctaggtccttactcttcagaaggagataaaggggaaggaaagaattttgcttaagatatcagtgtttggccaacaatacacacctttttctgatgtgctttgttctggatttcgcaggtcctcaagggcagaagagtcacttatgatggaagggtagctgttagaaggctggctcccatgctgttctaacacagcttctagttcagccatttcctgctggagctttatcaggttatgttgcatggtatccctctgcttcaaaaacgataaatggcaccaagaaaatgaaatactttgagaagctttccattaaatgaaaatatatcatacaaattaattttagcacaggaattgaaatcacctagtatggaactacaagttctagctgaacaccttttaatctaaccacattcatgcaattaatgcccatgaaattatttccaaatgatgttagtgagggaaaaaatcctcaaattcccccaaatagacttgatgttattgtgatgtccttttgaagttggttattttcttttaaagctagggagtgaaaaaataattaaggcatttaaacactatcgatatttaaaattagcatgaatctgttaacattttatttatatgggcacatttcaaagacttggtgttgtgagattcatcagacatttaggttagttcatataaaaatgtgtgatttttagactgatgtaatgttgaaaaaagccctctatctatggcattttataaaaatacaacaaatataaaaatactatcagtaatcctgcctagattactggcttgtgaggactcttccttttctgggattctttgaacctttagtttcttttctttctttctttctttttttttttaagtctccctctgtcacccaggttggcaccatctcggctcactgcaacctcttcctcccaggttcaagcgattctcccacctcagcctctcaagtagctggcattacaggtgcttgccaagacgcccggctaattttggtaatttttgtagaaacagggttttactatgttggccaggctggtcttgaactcctgacctcaagtgatcagcccgcctcggcctcccaaagtgctgggattagagacatgcgccattgtgcctgacctgaacctttagtttctaacagaaaaagcaaaaagctaattcatgaatctatctgtttgctcagttaattagacaactatttactatctattaagcaccaggcgctgtcctagtactgaggatatagccctcatggtgctgccattctagacagggacatctcatctagaatgtgtccacctagagatcattagcaaggacctgtgagagggaaggatccaacagaaagagccctgagaaagcctgtaaggatagttactgtttttaaaataatgagttctttttgcttatgggctcctgttgtttattggtccatttcaaagaagagtgtgctaagtccaagtatttgataaacaaagaatttaggtatgtaaggagttttccaaaatatccttcttaagaatttattttatttatttattttttttgagacagtcttgctctgttgccccaggctggagtgcagtggtgcgatcttggctcactgcaacctccgcctacctggttcaagcaattctccctgcctcagcctctcaagtagctgggattacaggcacctgttaccatgcccgactaatttttttttttttttttgagacggagtctcactttgttgcccaggctggagtgcagtggcgcaatcttggttcactgcaagctccgcctcccaggttcaagccattcttctgcttcagcctcctgagtagctgggattacaggcgcccgccaccatgcccagctaattttttgtatttttagtagaaatggtgtttcaccgtgttagccaggatggtctggatctcctgaccacatgatcctcccgcctcggcctcccaaagtgctgggattacaggcgtgagccaccacacctggcctaatttttgtatttttagtagagacggggtttcaccatgttggccaggctggtcttgaactcctgacctcaggtgatctgcccgcctcggcctcccaaagtgctgggattacagacgtgagtcactgtgcctggcttcaaaatatacatgtttaaaaatcacttttagaaggaacagcaatggttgccaaaaagtccagtgggggagtagggcaggaacacattgtttcactctccgtttcttcttctgatccttaaaaatgactttgccctttactaaaaacaagccatcttctttctcctgctacactgagttcacaattttcaggaggtttttatgaccagaaaatgtattcctagcttcacaaaggtttctactgctactctaacactgctttgctgccaaggtctgcagcaatgccattgccaccacgtggtactcgtgagtagttacatcactgatcaaaccctagccaaagtcttgcctcagtcaacctggaatgaaagcacatagatatctgaccaaaatgcttcacaggctgtattagtcactactgtcacaaccatcacatctaacctctacgtggccattacataaatcagaaaaagtagtggggtaattattaatagataactttcctttgggtttcccaaaggaattattttttataacttagacaaattccccagcaggtaagtggccaaatacattagggagaataaaaccaataggtttctaagacttcttgattctaattctgaagtgctccttcaattagctctagccttctacttctactatgctgctctgatctctacttttaatacagctacattactgtagaagttccctaaaagccttgtttatcatgtctttttcttccataaagacccttagtgctccatcctggccatcacagtgaaacactggctgaggcagaagaatcacttgaacccaggtggcggaagtgcagtgagctgagatcgtgccacggcactccagcctgggcaacagagcaaaactctgtctcaaaaaaaaaaagaaaagaaaaaaacccttagtggtataccactgctgatttatactttttgaacactatataattgttagtcattactgccattaggataaaattcctcaacatagcattcaaaaggccctttataccctggtattatctctcatttctcccaacacccctcacacaagttgttttcctataacacatgacaactttacgtttcctgggaattccatgactctgtacctttaccttacttgctgccactcctctttttccacttggaaaaattctcatctttcaaggcctagtttgaatgtctccttaagtccccaccaggaggagttgtgaaatatgagaagtaagggcaagtgggcagaatgtggctaattctaataagactcctgaaatgtgcagcagagcagccggaactggtctggagggaagcagagtgtatatctgacccttgtttgttcacattcattacatataaatatatatataaaaccttcccataaaacatgtgtatttaatgagttaaaactatttctaatgttcctactactacataataagcctaatccagatacaagctgaagtcttagcacaaatagtggctttatcatgctagttttgtcgacatgttgtgaatattttcaaatatacagaaaacttgaagcaactttgcaatgagtgtttatatatctactacttagaatctataattaacatttcctatatttattttatcacatacatacacacacacacacacacacacacacacacacacacacagaagtccccaccaataatccatctcctatcgggaacagatgatctctcactacttgatttacattgctaatgcattagtatacccaaatggaacacatgaccttgataggaggaagcttcccttaatcatatttgtctccctaatgcctagcagacagtaagcactcagcaagtgtttattaatgagaagataaattaataaataagtatagttaatcagtcttctgtaaaaacaaacaaaaacccagatatcaatgataccaaattaggaattctctatcatctatatactttttctcggttcagtacaaaaagggaaaaaaaaatcccacttcaatagtttttcctgcctgtgctactttagacgtaagacagcctgaaatctgacttcaacggttttgggtagatgcttagtaaaaacacgttgcaaaatgaatcctgaacaaatagacacatctctgggaataagattagaaatacagaaaaacaaggacattgtatattgaatgtcaaatataatacagtatggctaaggcagatgtaatcagaaattgcaaccttaaactttaaaacacaatggacagaattagatgatgggtatattgacagagtcccaaacccacattcaaaaaggatcataggaattgcaaagagagaaaaggcctcctaaatcttttcatcaatttagttgccatggcaatcctgaagaagtggagaatactggtgacagctcagatacagagtggggagtcatctcaaaggtttcttgacaactccaaggggcttcaggtctagagggatttgctctgtacagagaatgggcagtagaagataagccttctctaattgtagttctcatagcaatgcaagatttagattttaaaactggatatcacccagtgttggcaaggtacaggaaaatgggaactatcatataccacaggggctggaagagcataaactggtttaatctttctaaaaaacaatttagtaacatgtatcaaacaccaaaatcctagtcccagtaatttagactaaggaaataatcagggatgtaggcaaatatttagctatcaggatgccactatagtgatgtacataatagcaaactgtgcctcttaccctgaaacctccaacattcagcaataggtcaaataaatcatgatacactggaaagatagaatcccatatagtaattaaaaatgaagtcacttaagaattttaacgacccaggctgagtgcggtggctcacgcctgtaaccccagcactttgggaggccgaggtgggtggatcacttgaggccaggagtttgagaccagcctggtcaacatggagaaaccctgtctctactaaaaatacaaagttagctgggcatggtggcacatgcctgtaatcccagctactcgggaggctgaggcaggagaatcgcatgaacccgggaggcagaggatgcggtgagccaaggtcacaccactgcactccagcctgggcaacaagagtgaaactccatctcagaaaaaaaaaaaaaaaaagaaaaaagaattttaatgatccagtaaaagctagattataatgcacagaattatctggatttcttgtttttgagacagggtctcaccatatcacccaggatggagtgcagtggcaccatcatggctcaccacggcctcaacttgctgggatcaagcaatcctaccccagccactcaagtagctgagactacaggtgtgcaccactaagcctcactaatttttttttttttcccagacaggggttgcccagaacagagtgcagtagcgtgatcacaactcactgcagccttgacctccggggctcaggcaatcttcctgcctcaccctcccaaagtgctgggattacaggtgtaagccactgtgcctagcttcctggatatattttaaagataaagtatatacaagcacccctgtgcacacacaggaatactaaaagaatatacaccaataaattgctaaccatttctggataacacaaattacaattaacttatcattttaatcattttaagtgtacagttcagtggcattattttcacactgttgtgttaccattgccactatctatctccagaactttttcatcatcccaaactgaaatctgcactcatcaaacagtaactccccatttccccctccccaagtccctagtaaccactattctaccttccatcctatgaatttatcttttttttttttttaactgctccttgtggagcaaggcttatctataggcaatgtacccagagtaaccaaatgtaactattctaggtatctcatataagtggaagcatataacatgtgtcctttggtgtccggtttatttcagttaacacaatgtcttcaaggttcgtccatggatgatttttgtttatctgtattttctaagttttctatgatgcacatatataactttataagaatatcaggcttttctcaacttcatctaatctgacttcagaaagttcataaaaaaacatcattcacttactagcagctaaaagggtatttaagatttaggtgggaaaaagaagccacagcaggatgaatcgagggggtctgaacagcttcattttaagaatgtgcctacggcaggtcagagaacataagcaaactgtctaagatcacatagcccagtacagaactctcaccaatattattgccagcaactgctgtgtgtgtattctgcatagaaccctgtgctgggaatacaaagaaccaacctaattattagaagttgtcaatttagtgggagataaataaatgaaaaaaataaactgagatgagcctgaatttttgcatgagaacttggaaaattttggtgccacttctacaaataaaaattaggaggccaggcctggtggctcacgcctgtaatctcagcactttgggaggctgagacgggtggattatttgaggtcaggagttcgagacgagcctggccaacatggtgaaaccctctctctactaaaaaaatacaaaaaaatgagctgggtgtggtggcagtcacctgtaatcccagctacttagaaggctgaagcacgaaaatcacttgatcctgaacctgggagctgaaggttgcagtgagccaaaattgtgccactgcattccagcctgggtgacagagcaaaactccatctcaaaaaaaaaaattaggagaaagagcctggttctatgatgaagatgatattcatttttagacgttgtgatacagaatgttttttctagactattctgcctttagtacataaacatttcatattacattatcaaatggtcatatatatggtaaagcttttatttatttcataggtgaccaaattattggccttgaccattaggtccagaaagtaaaattgtgtactttctttttttttttttttgagatggagtttcactcttgttgcccaggctggagagcagcagcatgatctcagctcactgcaacctccgcctcctgggttcaagtgattctcctgctttagcctcccatctttcttttttttaaagaaaaaagatgatttatgagcaattaaaaaaaaaataggccaggcgtggttgcacacacctgtaatcccagcattttgggaggctgaggtgggatcacttgagcccaggattttgagaccagcctgggcaacatagtgagatgttgtctctagtaaaaacttaaaaattagctggaggtgttggtgggcgcctgtggtcccagctactcgggaagctgaggtaggaggatcgcttgagcccaggaagtcaaagctacagtgaaccatgactgcactactccattccagcctgggtaacagagtaagagaccctgtgtcaaagaaaccaaaaagaaaaaaataactagattttaaaagggaaaaaaaaaaagaagaagagaaagaagtatccacaaaacagtgaaaggctagatggtctctattaggaagagaaccctatagtctccaacttggtaccaagaataaacaccaaaattgcgattgctggcaataatattggtgagagttctgtacctggctgtgtggccttaggcagtttgcttaccttctctgacctgcagtaggcatattcttaaaatggagctatgcagagtcccttgaatcatcctgctgtggctcctttttctcacctctcttgatacagtaagtgccgtcatgtttttgctataggggaaatgatgtgtttttgtttgtttgtttttgagatggagtctcactttgtcacccaggctggagtgcagtggtacaatcccagctcagtgcaacctccgcctcccaggttcaggcgattctcctgtctcagcctccagaatagctgggattacaaggcattggccaccacgcccagctaatttttgtatttttagtagatgtggggtttcaccatgttggccaggctggtctcaaacttctgacctgaggtgatccacccaccttggcctcccaaagtgctgggattagcaaatgggtttcgaaggtttagcttattcattaaaatcagtatttagtatgctacaatgagctaggcagtgtatgtgtaggctgtgtgtgcgcgtgtgcgtgtgtgtgaaataaaaggtagtatgagttccatcaaggtgcttacagtctaatttaaggagacaatgaaccacaaacaattgtgccattaattcaaagagatgatgtcagcaaacctaagaatgtgggatacatactactgaatgcaaaggacaccacacacacgcatgtgcacacacacacacgctttttacctgagtggttaaaatgtcactctgagaggatagccctgagcagtcttcagagacgcttgtttcactctcacacccagatgctgcttcaccttaaataacaaaaacagaggttcagatgtaaaagcagactataaacgctgcaacttgctgtgtctttttcttctcattggcaggactggatttactttcatgtcacacaaaatgattaaattccttgctttgggacacctggatttgcttttataaaatgaaaccagaagtaagtccaccagtaattaggatgttaaagctcattcagtcaaagatgacgtcctagctgtgtgaaggacttttttctatgaaaagcaccttaggaggaacatgtttcaagtttaagaagcagttcctttaactatacttggaaatttgtaaaatgtgctccccaaaagcataaacatttagctcacttctataaatagactggggcaaacacaaaaacctggttccaatacctaagtttgaatccatgctttgctcttcttgattattttcttccaagcccgttcctctttcttcatcatctgaaaccaattccttgtcactcagaccaactccctggctttcagactgatgcctcatttgtttggaagaaccaatcaagaaaggatcctgggtgtttgtatttgcagtcaagtcttccaattcactgcactgtgaagaaaacaagctagcagaacattttgtttcctcactaaggtgatgttcctgagatgcctttgccaatattacctggttactgcagtcatttaagctattcttcaatgataataaattctcctctgtgttcttagacagacactcggtagcaacggtgctatgcctagtagactgagaaggtatattgtttactttaccaaataacaagtgttggaagcagggaagctcttcatcctcactagataagttctcttctgaggactctaatttcttggcccctcttcggtaaccctgagccaaatgtgtatgggtgaaagggctaggactcctgctaagctctcctttctggacgcttttgctaaaaacagcagaactttccttaatgtcattttcagcaaaactagtatcttcctttatttcaccatcatctaacaggtcatcaggtgtctcagaacaaacctgagatgcatgactacttcccataggctgttctaagttatctgaaatcagatatggagagaaatctgtattaacagtctgaactacttcttcatattcttgcttttttatttcaggatgcttacaattacttccaggaagactttgtttatagacctcaggttgcaaaacccctaatctaagcatagcattcaattttggccctctgtttctacctagttctgcttgaatgttttcatcactggaacctatttcattaatactggagcccacttcattagtactggaacctacttcattaatattgcttgagctggcttctttaaaaacattttctctaatgttattacggctaattgtgctcactgtacttggaatgttctcatttcccatttctctttcaggtgacattgaatgttcctcaaagttttcctctagcagatttttcttacatttagttttaacaaatgacttgatgggaaaaagtggtggtatacgatatgggttttgtaaaagtccatgtttatttggagtaatgagtccagtttcgttgcctctgaactgagatgatagacaaaacctagagcctcctttgatactacatttggcattatcaactggcttatctttctgaccaaccacaggaaagcctgcagtgatattaactgtctgtacaggcttgatattagactcattctttccttgattttcttccttttgttcacattcaaaagtgacttttggactttgtttctttaaggacccagagtgggcagagaatgttgcacattcctcttctgcatttcctggatttgaaaacggagcaaatgactggcgctttgaaaccttgaatgtattctgcaaatactgagcatcaagttcactttcttccatttctatgcttgtttcccgactgtggttaacttcatgtcccaatggatacttaaagccttctgtgtcatttctattatctttggaacaaccatgaattagtcccttggggttttcaaatgctgcacactgactcacacatttatttggttctgtttttgccttccctagagtgctaacttccagtaacgagatactttcctgagtgccataatcagtaccaggtaccaatgaaatactgctactctctacagatctttcagtttgcaaaaccctttctccacttaacatgagatctttggggtcttcagcattattagacactttaactgtttctagtttctcttctttttcttctcttggaaggctaggattgacaaattctttaagttcactggtatttgaacacttagtaaaagaaccaggtgcatttgttaacttcagctctgggaaagtatcgctgtcatgtcttttacttgtctgttcatttggcttgttactcttcttggctccagttgcaggttctttaccttccatgagttgtaggtttctgctgtgcctgactggcatttggttgtacttttttttctttatctcttcactgctagaacaactatcaatttgcaattcagtacaattaggtgggcttagatttctactgactactagttcaagcgcatgaatatgcctggtagaagacttcctcctcagcctattctttttaggtgcttttgaattgtggatatttaattcgagttccatattgcttatactgctgcttataggttcagctttcgttttgaaagcagattctttttcgagtgattctattgggttaggatttttctcattctgaatagaatcaccttttgttttattctcatgaccactattagtaatattcatcacttgaccattctgctccgtttggttagttccctgatttatcatttcaggagtcttttgaactgccaaatctgctttcttgataaaatcctcaggatgaaggcctgatgtaggtctccttttacgctttaatttatttgtgaggggacgctcttgtattatctgtggctcagtaacaaatgctcctataattagattttcagttacatggcttaagttggggaggcttgccttcttccgataggttttcccaaatattttgtcttcaatattactctctactgatttggagtgaactctttcacttttacatattaaagcctcatgaggatcactggccagtaagtctattttctctgaagaaccagaatattcatctacctcatttagaacgtccaatacatcagctactttggcatttgattcagactccccatcatgtgagtcatcagaacctaacagttcatcacttctggaaaaccactcattaactttctgaatgctgctatttagtgttatccaaggaacatcttcagtatctctaggattctctgagcatggcagtttctgcttattccattcttttctctcacacaggggatcagcattcagatctacctttttttctgtgctgggagtccgcctatcattacatgtttccttacttccagcccatctgttatgttggctccttgctaagccaggctgtttgcttttattacagaattcagccttttctacattcattctgtctttagtgagtaataaactgctgttctcatgctgtaatgagctggcatgagtatttgtgccacatggctccacatgcaagtttgaaacagaactaccctgatacttttctggatgcctctcagctgcacgcttctcagtggtgttcaaatcattattactgggttgatgatgttcagtatttgttacatccgtctcagaaaattcacaagcagctgaaaatatacaaaaataacaaggtactcaaaaactgaattgtcattaaaaaaatacatacttcatacaccttggaggtggaaatcaaccaactggctatattagagaaactaacctcataaactaccaagtatactgaagatgtagctcatactctttcatttaattcctatttacctagattatttccacttaggatccattaaatttttaatttcagaattttccctatgcagaaaccacacctatttctctaacgtctaagagtgaattaaaagcagattggccatcagaaaactggttctgatgtactctaaagattactggccattaagtctacttaatactctgttctatctacagacttaccactccctatatttaaaaaccagtaggtaaaagatgaaacacaaatacaccaattaaaagtaaagggcaggccaggcacagtggctcaagcctgtaactgcagcactttgggaggctgaagtgggcagactgcttgagtccaggagtttgagaccagcctcggtaacatggtgaaaccccatctctataaaaccacaaaaaattaaccgggtgtggtggcatgcgcctgtagtcccagctactcaggaggctgaagtgggaggatagcttgagccttggaggtggaggttgcagtgagccaagattgcatcactgcactccagcctgggcaacagagtgagaccccatctcaaaaaaaaacaaacaaacaaacaaaaaaaaaaacgaaagggcaacaatcagttacagaaggtcttattataggtacattagtctagtaccatttaaatctatcagaccataccacgacatttgacagagaatgatactctaactctgccaagagattttgtgggttgtaaaggtcccaaatggtcttcagaataatctaattacagtactgtatctacccactctcttttcagtgcctgttaagttggcaaactttgccattacccttttttgcagaatccaaactgatttcatccctggttccttgaggggtgatttgtaacaattcttgatctcccacactatagggaaaagacagagtcctaataagaaacactagttacatgtatgcagaactgtcaaatgaccaagatcaaacattttagctctttcgattacagaaagctgaccaatcttatttagttagtgaaagctgctctctcctttagaaacttctagttgaaatgaaatggttgctgggcacggtggctcaagcctgtaattccagcactttgggaggctgaggcgggtggaccacttgaggtcatgagttcaagaccagcctggccaacatggtgaaaccccatctctactaaaaatacaaaaattagccgggtgtggtggcgcgcgcctgtagtcccagctactagagaggctgaggcaggagtatggcttcaacctgggaggcagacgttgcggagaggtgagatcacacctctgtactccagcctgggcaacagagcaagactctgtctcaaaaaaaaaaaaaaaaaagagagaaagaaagaaatggaatggtcaattaaccgggcgtggtggtgtatacctgtagtcccagctactcgtgagattgagacaggagaatcgcttgaaccagggagttggagattgcagtgagccgagatggcgccactacactccatcctggcaacagggcaagaccccgtctccaaaaaaaaaaaaaaaaaaacctgggtcaagcaataattcctaaggaaggtaggtaacatagttggggttgcttgtagtttattatataacatacagacaaagcttgagagatatgtggaaataaggaacagaggaaagaaagagttgaaaatgaagtccttgaacattttcatcagtcacaattactgctgtgtcaatattactgtatatgaggaacttagagaacaatctgctagaagcaagcatgtgcagagttctactgttatcctaaattcctttggacagtgctaataactaaatccaacaaacaaaaagggtatttcctccactataaaatgagagaactaaactagatgatctctaaggtttcttccaataccatgattctagtctggagaaacaccagcctacttgagggaggaaggtgggaagagggagaaattcagaaagaaagcaaacaaaaaactgtggggtatgcttagtacccggatgatgaaaaaaatctatacaccaaatcccaagtcgtgtgtttacctatataacaaactgcacatacatccctgaacctaaaataaaagttaaaatatttttaaaaagagagaaacatcaatccttaatattaactaaataggaaaataccagcttcatagacaaaggttctctttgactcacctgcaataagttgccttattaacggtatcttcagaagaatcagatcctaaaaaatttccccccaaaaaataaatcaataaaagttttcttaattaaaagggttaaaaaaatgtacttgttgaaaaacagatattcaactagaaatatttactgagcatctactgtggcaggtacaatgctagttaagctagtatgtaatacagagaagtggttaaaggcatgggcttcgccaggcacagtggctctcacctgtaatcccagcacttgaggaggccgagatgggtggattatttgaggttaggagttcaagaccagcctggccaacaaagtgagacccccgtttctactgaaaacaaaaacaaaaacaaaaaaaaagcacaggctctgacatctaacttcctaggtttgaatcatggctcagccacttactaggtttaataccttggaaaaatttcataacttctctgtgccttaattttctcatctgtaaaataagtataataggaacaatctcagaggtctgacaagcatctaatgagttatacaagaaaagcacaatagtgcctggaatatagttaagtgctcctaaatatcaactactataactatttttacaatgcctgttgtctaggaatttatgatcataaggggggaaaacagtaagtgttatgataaatagatggtggtgcctgggagctcaaaagatggctatcctttttaattataaatatattctaaaagaaaatccaatttgagagcccagtttgaattctgagctcagcagctcttttttttttttttttggaggtcttgctctgtcacccaggttggagtgcagtggcatgatcatagctcactacagcctcaaactcctgggttcaatgtatccactcacctctgcctcctgagtagctgggactacagatgcacaccaccacacccagctaatttaaaaaagaaatttttttgtagagatgaggtcttgctatgttgcccaggctggtctcaaactcctggcttcaagcaatcctctgccactgctgagattacagatgtgagctactatgctggcctcaacttttctttttataagcttaaaaaaatttattatttttaaaaattattatttttttgagatgcagtctcactctattgcccaggctggagtgcagtggtgtagtgttggctcattgtaacctccgcctccctggttcaagcgattctcctgcctcagcctcccaagtagctgggattacaagcatgtgctaccacacccagctaatttttttttttttttgtatttttagtaaagaggggtttcaccaggttatccaggctggtctcgaactctgacctcaggtgatctacctgcctcagcctcccaaagtattgggattacaggcatgagccaccgcaccggccaaaaatgtattattattttaaaaatagagacagggttcccctatgttggccaggctggtcttaaactcgtggactcaaccaatccttctgcctcggtcttccaaagcgttaggattacaggcacgagccatcctgcccagccaagattcagctctttttttttttttttgagatggagtttcactcttgttgcctaggctggagtgcaatggtgcgatcttggctcactgcaacctctgcttcctgggttcaagcgattctcctgcctcagcctcctgagtagctgggattacaggcataagccaccaccccggctaatttttttttttttttttttagtagagatggggtttctccatgttggtcaggctggtcttgaactcccgacctcaggtgatccgcccacctcggcctcccaaagtgctgggattacaggcgtgagccactgcgcctggcaattcagctcttcttaaaaggcttcctcatctagtacaatttatcttggaactaaatactgtagcaatccatcatgttttttcttattgctactctccatctttccaaaacatatttacacatatttaaaaccagatattctttcttttgctctcttttttttttttagatggagtttcgctatttttgcccaggctggagtgcaatggtgcgatctcggttcaccgcaacctccacctcccgggttcaagtgattctcctgcctcagcctcccgagtagctgggattacagttatgtgccaccacacctggctaattttttattttttggtacagacagagtttctccatgttggctaggctggtctcgaactcccgacctcaggtgatccacccactttggcctcccaaagtgctgggattacaggtgtgagccaccatgcctggcctcttttgctccctttttaaagtaagattcttcaaggtgggaactgcgtcttttacattttttataactcaccatagggctcataaaattcacttcccaaagctgcctaccacaaatacaaattatgaccaagatttttggcaaaactataagataaggaatccagcaattattattaaatacttaaaaaacctgagacccttacccaattcaatgtagacagacgtcttttgaggttgtatccgctgctttgtcctcagagttctcacagttccaaggttagagagttggacactgagactggtttcctgctaaacagtatggtaaagaacagtcaagcaattgttggccagttctgtgcttttcctcctgaagagaaacttgacaccatggacaaaataaattgaccatcatcagtcagctaacatgtatgatgcctggaaaaaatgcccaggaatttacacactaaaatgtctggggctgggagcggtagctcatgcctataatcccagcactttgggaggctggagcaggactgcttgaggccaggagttcaagaccagcataagcaacagagtgagacccagtctctacaaaataatagtagtagtaataataaaatgtgtgggatatgtgtgatttgaatttttttttctgttgtcttaaatttttcaaacctgattatgtattatttgtgtaatttttgaagtattaatatagcatattttgaagctgatacttgatatacattccaatcacatctgataacttttttttttgttttggggggtgtacagagtcctgctctgtcacccaggctggagtgcagtggcgcaatctcagctcactgcaacctccgcctcctaagttcaagagattctcctgcctcagcctcctgagtagctgggtctacaagcgtgtgcaactatgcctggctaatttgtgtgtgtgtgtgtatatatatatacatatatatgtgtgtgtgtgtgtatatatatatataacatatatataacatatatatattatatatatataacatatatataacatatatatatgttatatatatataacatatatataacatatatatatatatatatataatatatatatatatatatatatatgtaatcccagcactttgggatatatgtgtatatatgttttttttttttgagacagaatcttgctctgttgccaggctagagtgcagtggcgtgatctcggcacactgcaacctccacctccctggttcagttgattctcctgcctcagcctcccgagtagctgggactacaggcgtacaccaccacgcctagttaatttttgtatttttagtagagacaggtttcgccatgttggccaggctggtctcacactcctgacctcaggtgatctgcctgcctcggcctcccaaagtgctgggattacagccatgagccaccgtgcctggccaataacatttttaaaaaggataaatgatgacaataaaaccccagcactcctaagaacatttagtataggaacgagtatttaaaagcccaacattactttttttttccttcctttttagctctatatcttttgaaaaatgaatgctggtactgtgagaactacttttattttatttgtatttttttagacagagtcttgttctgttgcccaggctggagcgtggtggcgtgatctcggttcactgcaacctctgtctcctgggttcaagtgatcctcccacctcagcctcccaaggagctgggactacatgcgcacgccaccatgcctggctaatttttgtattttttgtagcgatggggtttcaccacattgcctaggctggtcttgaactctaggactcgagatccacccgccttggcctcccaaagtgctgggattacaggcaagagccactgcgcccagctagaacaattacttttttttcttttttgagacagagtctcactctacggcccaggctggagtgcagtggcgcgatcttggctcgctgcaacctccgcgtcctaggttcaagcaattcttgtgcctccgcctcccgagtagctgggattacaggtacgtgccaccacacccagctaatttttgtatttttagtagagatgggtttcaccatgttggccaggctggtctcaaactcctgacctcaaattatctgcctgcctcagcctcccgaagtgctgggattacaggtgcaagctactacgcccagccccagaatgattactttttaagatctccatcattcatgcacatataagtaacaacagagcaaatcactacattttctttaacaattacaccttttaagttcaagtaattttccctttttttaaaagatagggtctcagtcacctgcgctggagtccagtggcacagtcatagctcaactgcagccttgactctctatgttaaagcaatgctccagcctcagcctcccaagtagctaggaccacaggtgcataccaccacgcccagctaagtttttttgttttttttttgagacagagtctcactctgtcgcccaggctggatcgcagtggcgggatctcggctcactgcaagctccacctcccgggttcatgctattctcctgcctcagcctcccgagtagctgggactacaggagtccgccatcacgctcagctaatttttctgtgtttttagtagagacgggctttcaccatgtgagccaggatagtcttgatctccacacctcgtgatccacttgactcggcctcccaaagtgctgggattacaggcgtgaagcttttttttttttttttttgagacggagtctcgctctgtcgccaggctggagtgcagtggcgcaatctcggctcactgcaacctccgactctcaggttcaagtgattctccatcctcagcctctggagtagctgggattacaggcacgtgccaccacacccagctaatttttgtatttttagtagagaccgggtttcaccatgttggccagggtggtctcaatctcctgacctcatgatccactggcctcagcctcccaaggtgctgggattgcaggtgttagccgccgcacccagccagttctttttttttttgcaactagatcttgctttgccgcccacgctgaagtgcagtggagtgatcatagctcactgtagtctacatctcctggactcaagtgatccttctgtctcagcttcccaagtagctgggactacaggcacacaccaccatgcccagataatttaaaaaaacttttaatatagacaaggacttgctatgttgcccaaactggtcttgaactcctgagctcaggcaatcctcaagcctcctagtgctggaattacaggcgtgagccacggcacccagctacttttttttttttttaattgcagagacagtgtctcactgtgttgcccaagctgggctcaaaggacctcctacctcagcctcccaaagggttgggattataggcatgagccatggcacccagctgaagtaatttccaaatgcttaaaaatatcagtgaccttatggctattttagataagcatcacagagcagataaagctccaaagcaaggaagggcctataagagctctcttttttggccgggcttggtggctcacgcctgtaatcccagcactctgggaggccaaggagggtggatcacctgaggtcaggagttcgagaccagcctgaccaatatggtgaaaccccgactctactaaaattacaaaaattagccaggtctggtgtcgtacccctgtagtcccaactactcaggaggctgaggcaggagaatcacttgaacctgggaggcggaggttgcagtgagctgacatcgtgtcactgcgctccagcctgggcgacagagcgagactctgtctcaaaaaaaaaaaaaaaaaagaaatctgtctttttggtgtatctgatggggatcttgctatgttgcctgggctggtctcaaacctggactcaagtgatcctcccatttcagcctcctaagtagctgggattataggtacattcacctcacctggctgtaaggtctctctcttgattatatcaggtaccctgaccttctctgaactctaactgattagaacacttgtctaaccacttaatataccatctttccttcttcactaactttttatataaatctatgagcatctagcacattcactaacatattcacaatgctcaataaagagatgttgccagaataaatgaaaatggttttaccggccgggcacagtggctcacacctgtaatcccagcaatttggggagccgaggtgggtggatcacctgaggttaggagttcgagaccagcctggccaacatgatgaaaccccgtctctactaaaaatacaaaaattagcctggcatggtggcgcgtgcctgtaatcccagctactaagggggctaaggcaggaggactgcttctagcctgggccacagagcaagactccatctcaaaaaaaaaaaagaaaaaaaaaagaaaagaagaagaagaagaagaagaaaacaaatggttttaccaaggaaggattttcgggttcactctgtagaagtcttttggcacggtttctgtagcccatactttggatgatagaaacttcatcttttagatgttcaggagagttattttccttttttgcaaaattatagctgtttgcatctgtaaaatacaagggaaaacattatgtttgcagttagagaaaaatgtatgaattataatcaaagaaaccaagagaaaccctatgtatgctctttgttgtgttaagacaatgcattaaggttacctgtgattttttttaaaaatcaaattttaaaaaatcaactggaaattttactcctaggaaacaaaaacaaatacacagaccatcaaagttatttagagtccttgttttctaccttaacactaagaaatttgcctatcaatactgtatttcactaaagctaagacaccaacaatgtaagttgcactattattttctgtatcactaagaaagaaagcacacaaattaaacaaatgacacaccctcaatagtaaaatgttcccaatttcagagatgttaagatgtgaaaaatgtgcaccttacgattgataaaataaggtgtgagaccagtgggagtaattttttaaaaatagattacagatacagaactaaaattaacctagactaaaaggtcttatcaccacgtcatagaaagtaattgtgcaaacttcctgagttttcatggacagcacttgagtgtcattcttgggatattcaacacttacactccaaacctgtgtcaagctgaaaagcacaaatgattttcaatagctcttcaacaagttgactaaatctcgtactttcttgtaggctcctgaaattaaattgtttgagaaacacactcagcaagtgattatcaaccttttaaggacactaaaataagaaaagacatgtaaacaaataaaaataagatgcagcaacagtagaaaacctctataatcaatacatcattgacatctgtataaaccgtgtgatggcagtgatttagtaactttttgtcattcatttaagcctaccaaatgcctaaaattatctgatataatactgccctaaatccacagcagatataatgcattgcatagaaaactagagtacttttttttttgtttaatttagagacagggtcttgctctattgcccaggctagcatgcagtgccacaatcatagctcactgcagcctcagacttctgtactcaagctatcctcccactatagcctcccaagtagctaggactatgggcatatgccaccatgtacatttatttatttattttgttggtagtgatggggtctcactatgttgcccaggctgatttcaaactcctggcctcaagcaatcatcccacctcagcctcctagagtgctagggttataggcatgagcaatcacaccctgctgagcttactgttcttaacatctgaaccctgcccaatccctcacttagttctgcctctcaaggatttctgtcaaattatgattatacttctttgaaaacacatagataacaatgtccaaagggagatttgggtttagtaaagtggaattaaagcacaattcattcattcctttaagcatctgagtgcctactatgtaccaaacttaggaaaaacagtgttgagacagacaaaattactactctcatagaatttacattgtagcagaagagatacacaatatataaatacattgtgtttgtgtaaataattagatagaaataaacacacacctgtgaaccccagcactttgggaggccgaggtgggcagatcacctgagctcaggagttaccagcctgggcaacatggtaaaacctcatctctacaaaaaatacaaaaattggccgggcatggtagcgtgtgcctgtagtcccagctatttgggaggctaaggcaggaagaggctgggagacagaggctacagtgagccgagatcacgccactgcactccagcctcagtgacagagcaggaccctgtcttaaaaaaaaaaaaaaaaagaaaaggaaacacaatcaaaaatataaaaacaagattaacagacaatgggggcacggcgatacagccctactttacataagtctgcaagtttttacactagaagcattagagaaaggcagtaagtttctaatacctgtataaggcagatgtcccataaaactttcaggaaaataactttggaaataatttactgtgtgctaaaaactcttttataaatttttctgatgaatggttttataggaacgctatgttattaaataatttctactttttcctactgtggttgcttccaacctagcatcattaccaaattatataccttttggttatatcattcttacataaaggacactgtgaaggccctttcttctggttgagaagtttcagcatgcaaaatctataaattataaagaaagaaagaacaatttaatttacttccttttgtagaaagaatactcaaaaggcaaatagccatgaaaagataatctcacaactgcccttaagagccatttaaaaagtaatggcaggtgaattacaagcaatagtttcctaattgtttttggatgctgcataagcaaaaacctaaactacataagcaatgatctatgaaaactgaacttacatgcatatggcttactgttatgatcacataaaacttaataaaagttaatatggcatatttaatgatatattcataattatttcatgctgcataatcaaatataaacggtaagtagttcatgtaagatgcttataattagtttaaaatctcaacacctcaccacaaagctatagtaatcaagaaagtgtggtaatagcataagaatagacacatacatcaataaaatggaattgacagtacagaaataaactcatacatacatctgtgatcaagcgattttcaacaataataaataccaagacaattttttttttttttttttttgagacggagtctcgctctgtctcccaggctggagtgcagtggcacgatctcggctcactgcaagctccacctcctgggttcacgccattctcctgcctcagcctcccgagcagctgggactacaggcgcccagcaccatgcccggctaatttttttatttttagtagagacggggtttcaccatgttagccaggatggtctccatctcctgacctcgtgatctgcccgcctctgcctcccaaagtgctgggattacaggtgtgagccaccatgcctggccgacgatttttattttcttaattttttttttttttttttgagacagactcactctatcacccaggctggagggtagtgacacaatctcagctcactacaacctccacctcctaggctcaagcaattctcgtgcctcagcctcccgagtagctgggattacagacatgcaccaccatacccagctaattttttgtatttttagtttcaccatgttggctagtcttgaactcctggcctcaaattgatccatctgccttggccttccagagtgctgggattacaggcatgagccaccgtgcccaggccaaagatgattaaatgggaaaataatactttttgtgtttttaacaaacagtgttgagacaaaagtataaccacatgtaaaagaatgaaattatactcctatctcacaccaaataacaaaagttaactcaaagtggatcatagaccagaagtagagagagcaatggtgatgataattaaaagcagcgattcactcatacaaccaatatttactatgtctagtactattctagatggaggggattcaatagaaaagcaaaataagatcctgcaaaataaaacataaaggacataatatactggtgaagggggtgactaggtagggagtaaatagcagacactgacaatgaagagacccaggaaagaaaagattaaggggctaaaaaaaaagtcactagggctgtgcacggtggtccacacctgtaatcccagcacttgcggggtgggtgaatcacttgaggccaggagttcaagaccagcctggccaacatggtgaaaccctgtctctactaaatattcaaaaattagctgggtgtggtggtggtgcactgtagtcccagttactcgggaggctgaggcatgagaataagttgaacctgtgaggcgggggttacagtgagccaatattgcaccattgcattccagcctgggcaacagagtgagattgtgccaaaaaaaaaaaaaaggcattgggaattgtgagaaaagacacttagagaatattttttactagccaggtaatttaacatttattaccctctcttggccgggtgcagtggctcatgtctgcaatcccaggaggctgaggcaggcagatcacttgaggcctggagtttgagaccagcctggctaacatggtgaaaccctgtctctactaaaaatacaacaaaattagccaggcgtggtgggcacacgcctgagtcccagctacttgggaggctgaggcatgagaatcactggaacccaggatggcagaggttgcaatgagctgagaagagtgccactgcactccaccctgggcaacagaggaagactctgtctcaaaaaaaaaaaaaaaaaaaaaaaaaaggccaggagcggtggctcacgcctgtaatcccaacactttgggagaggtcaggagttcaagaccagcctgaccaacacggagaaaccctgtctctactaaaaatacaaaaattagccgggcatggtggcatatgcctgtaatcctggctactcaggaggctgaggcaggagaatctcttgaacccgggaggcggaggttgcagtaaactgagatcgcgccattgcactccagcctgggcaacaagagcgaaactccatctcaaaaacaaaacaaaacaaaacaaaaaaaccccaactatatctatatctctatctatctacctacctatctatctgtctacagtcttgaactcccgacctcaagtgatcgcctgcttcagcctcccaaagtgctgggattacaggtgtgagccattgcgctgggctactttctatctttatttttgtacagatgtggtttcactatattgcccagtctggtctcgaactcctgacctcaagtgatcctcctgccttggcatcccaacgtgctgggattacaggcatgagccatcaagcctggccttatcttcatttttatagagtagaggcttgtcccagatcacacagtaattaagcaatgaaggttatattggatccagaattggattgtagcaaagcccacaatcttccttttttcttttttgacatggaaactaagtctggagagaggcacccacaatcttcctaccagagaaagtgaatgtaggtaggtaaggtcaaggagacttgggtccttcttcgccgatatagatgcttcaagtaccatattgcactcaacaaaacaatgactctatagtttggaagatgaggctgtcaaaaagctacctccactgtacataagtacctttaaaactcagaatagaggctcccactccttcagaatctacaaatactacatatactctagtataatggatcaagaaggcatcaagcattactccagcaaatagtacaattgaacaattcagagcaggggtagggaggaaattcccttatgatagtactgcagaatatagtacagtagagtgacaagctaagctgtctcgtgctgtagtctatacaattatataaataattcagtggaactagatacgcaaaaatcaaccaagataaggattcgaatctttttttttttttttagacggagtctcgctctgtctctcaggctggagtgcagtggcacaatctctgctcactgcaagctctgcctcctgggttcacgccattctcctgcctcagcctcctgagtagctgggactacaggtgcccgctaccacgcctggctaactttttgtaattttagtagaggcggggtttcaccatgttagccaggatggtctcgatctcctgacctcgtgatgtgcccatctcagcctcccaaagtgctgggattacaggcgtgagccaccgcacccggcctcgaatctttctttatgctagaaaaagaatacatgtataaaggttgttaactaaacttaaaagaaaatgaacttgtatatgacttgaaaagacagagctaactaaaatactggccaggcatgatgactcacacctgtaatcctagcactttgggatgcctaggtgggcagacgggttaagcccaaagttcaagaccagcctgggaaacatggcgaaaccccgtctctacagaaaacacaaaatttagctggatatggtggtgtgcacttacagtcccagctacttgggagactgaggtgataggatcgcttgagcctaggaggtcaaggcaacagtaagcctcatgatcgcaccactgtactccagctgggacaacagagtaagaccctgtctcaaaaaaaaaaaaaaaaagtagctgttgaaaaatttaagttacatttattgctcacattctatctctttgaacaatgtggttctagatcttcaaaaaagtattacaggctgggtgcggtggctcatgcctataatcccaccattttgggaggtggaggtgggcggatcacttgaggtcagctcaagaccagcttggtcaacatggtgaaacatggtctctactaaaataaaaggctgggcgtggtggctaatgcctgtaatctcagcactttgggaggctgaggtgggcggatcacctgaggtcaggagttcgagatcagccttgtcaacatggtgaaaccctgtctctactaaaaatacaaaaattagccatgcatggtggtgcacgcctgtaatcccagctacttgggaggctgaggcaggagaatcacttgaaccagagaggcagaggctgcagtgagccgagattgtaccactgcactccagcctgggcaacagaacaagactccatctcaaaaaaaaaaaaaaaagtattacacattgcatttttttgtttggaaagttcaaactaatgcatgactgccttaagaaatattttctagattggtattattatctttttttataggcttcataaaagatttcagaactggctgggcaaggtggctcatgcctgtaatcctggcactgtgggaggccaaggcgagcagatcacctgaggtcaggagttttggaccagcctggccaacatagtgaaaccccgtctctactaaaaatacaaaaattagccaggtgtggtggcacatgcctgtagtcccagctactcgggaggctgaggcaggagatttgcttgaacccaggagatggaggtggcagtgagctgagatcatgccactgcactccagtctgggcaacacagtgagactccgtctcaaaacaaaacaaaaaaaaacagccgggcgtggtggctcacacttgtaatcccagaacttagggaggccaaggcgggcagatcacgaggtcaggagatcgagaccatcctggctaacacggtgaaaccctttctctactaaaaatacaaaaaaattagctgggcgtggtggcaggcgtctgtagtcccagctacttgggaggctgaggcaggagaatggtgtgaacccgggaggtggagcttgcagtgagccgagactgcaccaccgcactccagcctgggcgacagagcgagactccgtctcaaaacaaaacaaacaaaaacaaacaaacaaacaaacaaaaataaaaaaaagatttcagaactttaggcttgcttgggtcaataaagttgttttatttttagcaattagagtttatccgtagaaaatacaattaatacaacaaaagcatgggggtatcgctcccaggctcccagctttctcatcatatagatcaaagtgttattcagattatattgatattacagaagagatttcatgaaaaagtcgatctatcacatgggcattatactggactttttttttttttgagacggaatcttgctctgtcgcccaggctagagtacagtggcacgatctcaactcactgcagcctctgcctcctgggttcaagaggttcctctgcctcagcctcctgagtagctgggactacaggcatgtgcccccatacccagctaatttttgtatttttagtagagatggtgttaccatattggccaggctggtctcgaactcctgacctcgtgatccgcccacctcagcctcccaaagtgctgggattacaggcgtgagccaccacacccggctttggacttttaattctaatataacattcaaaacacaatttaaaatatggctggcccatctctacaagaaacttaaaaattagctgggcaaatgccatgtacctgtagtcctagctacttgaggggctgagatgagagattgcttgaacccagattgcaaggtaaaagtgaactatgatcacaccactgaactccagcctgggtgtcagagggagacactgtctcaaagaaacaaacaaaaatatatatgtgtcacacacacacatatatataacatatttatatgtatacacacacatatatctttatgactggttctttcctgactatcacaatcctgactatcacaagcttgaaaccaagcttctcactcttctccagttgccaactctaatcctctcaatctcaacagctgttttttgttgttttttttttttgagacagttttcactcttgtcgcccaggctggagtgcaatggcgcaatctcggctcactgcaacctccgcctcccaggttcaagtgattctcctgcctcagcctcccaagtaactgggattacaggcatgcgcctccacgcccgtctaattttgtatttttagtagagatggggtttctctatgttggtcaggctggtcttgagctcctgacctcaggtgatccacctgccttgggctccaaaagtgctaggattagaggcgtgagccaccgtgcccggcctcaacagctgtctttacctccaacttcactgggctcaaagcacctcagcatcttcctgtagaattactctccttttccttcattactgtttatgagtaataatcaactctttcttacatcctttttctatttccaatcccttctgcctcctcttggaccttctctttcttgcaaatggcttcccatctttgagggcttcttccttttctaacacaactcctatacacatatgcaaagttagcttatttttcctggatgtattttcttttcttttcttttttttcagacagagtctcactctgttgtcaggctggagtgcattggcatgatctcggctcagggcaacctctgcctcccaggttcaagtgatacccctgccgcagcctaccaagtagctgggactacaggtacgtgccaccatgccaggctagttttttgtgtgttttagtagagacagtgtttcgccattttggccaggatggtcttaatttcctgacctcgtgatccgcccacctcgacctcccaaagtgctggtattataggcgtgagccaccgcgcccgtcctctattttcttttatttgtacatttgctcgtattattatctctgcctataagcctataatttccttcttccacaagttctcaaagcaactatattcataacttaatctctctttttttgttaagagacagggtcagccaggcgcggtggcttacacctgtaatcccaacactttttaaggccaaggtagctgaagtcaggagtttgagagcagcctggccaacatggtgaaaaccctgtctcgactaaaaatacaaaaattagctgggtgtggtggcagatgcctgtaatcccagctactcaagaggctgaggcaggagaatcgcttgaacccaggaggtggaggttgcagtgagccgagatcacaccactgcactccagcctgggcaatagagtgaaacaccatctcaaaaaaaaaaaaagacagggtctcactctgtcatctaggctggagtgcagtggtgtgatcatagctcactacagcttcgaactcctggccttaagtgatcttcctgccttggcctcccaaagtgctggggttatgggcaggagctaccacactgggcccttgagtccctgtaataatagtatagtatgttcagcatttgttactcaagctgacaagaaaacatacagttcattccagaaagattctcatccagataaattgaaagccccagggctttaaaggttaatctttagctctctgtagtaaatactgggacttttttttttttttttgagtctccctcttgtcgcccaggctggaatgcagtggcatgatcttagctcactcagatgaaaattatggactatcttcccagaaaaatgtacatggccatagttttgaatacaatttaaatataattctaggaaattcataaagactattcataaaccccaagttaagaactctggaatttaaaaattcctcaaaggatacataagaaattgatcattgtggttgtctggggagggaacagggaggcaggggttgtagggtaagagggaagtatactttgcatcatatacctttttgtgctaataaactttttaccaagtacatagtttgtacctggtaccaggttatgtaccaggtacataaatacttaaaaacaaattagttgacatttaaggtaagatgtgagccatagcttaacataaagaaaaggagaaagcccacttgttctactaaattacctactctactttttctgaaattcttttattaagaaacaaacattttcatttcaaaagacaagatcatcaaatacgtaaatataacttgaatcactgctataaatgaattttggcctaaatagaaactggtatcaggtcctttcctgtcttcacaatgattacaaagcgggcaaacactgacccttagaagggggaatgcataaggatatgcagaaatgaacagaaaggagaaactgggaaggctcaaacacaatgtgcttatttcaaaactgcttgcagtttgctttcactgatggacacaaaaaatacaaaacactgttcaaaatgatgttacatcctaatagataatatatgtcagtcgggtgtggtggctcacgcctgtaatcccagaactttgggaggccgaggcaggtggatcacaaggtcaggagttcgagaccagcctggccaatatggtgaaaccttatctctactaaaagtacaaaaattagccaagcatggtggcgggtgcctgtagtcccagctacctgggaggctgaggtagaagaatcgcttgaactcggggggcggaggttgcagtgagccaagatcatgccactgcactccagcctgggcgacagagcgagactttgtctcaaaaaaaaaaaaaaagataatatatgtcaaaactttaccaggaactatgattacaaccaacttttgataactatatactctctgagaaagaatgaaatggagttggatttttcgttctcacttaattgaagaaagtaaagcttctataaagttaggtgtttcctgggttatgaaggacaaaaacaaaagctaataatggagccacataacacattcaaacttacttgcaaaatatgtggtcacactttgtggagacaggttccttgatcaactccagactagcagggtagggggggagaaaaagaaaataaatgaggctcaataatttatttaaaaataaagctattcttagtgaataagttcaactttgagctgttatgactgagtcaacataaggcctcaagttcgttcaatatttattaaatgtctgctgtgtcaggaactgagaatacagcagagaatacgatccttaccttcagtgagctttcagatatcaaaacagaattatattgatcccttcaatactctatactatcatcagcatttaaaagattagttgataatagttcgtacgaattcatttccagtgatatatttttctgcactatcactgtgggtgcacatctcatctttaagctccataaagacaaaattttctgcttatatttcttttgaattccttcctagaacttttttttgtttactgtaaatgcctttttaacttaatatggaaaatttcaagtatttcaaaatttcaagtaaataaaataataaaatgaactatatggaccatcaccctggtccaacaaccatcaactcatggccaagctgtttcacccatatccacccctaccccagattattttaattattattacttttaagataaggtcacactctgtcacctaggctggagtgcagtggtgcaaacatacctcactgcagccttgaactcctgggctcaagcaatcctcccagcacggggtttacaggcatgagccaacacacccaaacccaagtgtcttcttttttttgagatggggttttgcttttgtagcccagactggcatgcaatggtgcgatctcggctcactgcaacctctgcctcccaagttcaagtgattctcctgcctcagcctcccaggtagttggaactacaggcgtgcgccaccacgcccggctgatttttcgtatttttagtagagttggggtttcaccatgttggccggctggtcttgaactcctgacctcaggtgatccgcctgccttggcctcccaaagtgctgggattacaggtgtgagccaccatgcccagccccaagtgtcttctgatctataggtgtctcttactttttctcccttgtcatttatttttaaaattaggtcatttgacctgtggagtttcccccattctggattttgctgattgtataaccctatggtgaggtttaacttgttcctctagccttatttcctataaactagacttacaggcttaatcattcaggttcaactttctggcaagaacactttacagatggtactgtgtactcttattagatcacttcagaagaggcatgatgtttggtttgtgattactttgtaaaaacagtgtaataagtactcactaaaggaaatttagaaaatgataagcttaaggccgggcatggtgcctcatgcctgtaatcctagcactttgggaggctgaggtgggtggatcacctgagctcaggagttccagatcatcctggacaatatggtgaaaccctgtctacgctaaaaatacaaaaattagccgggcgtggtggcgcatgcctgtggtctcagctactttggagactaaggtagaaggatcacttgaatcctggaggtggaggttgcagagtgagccaatatcgtgccactgcactccagcctaggtgacagaggaagactctgtctcaaaaaaaagaaaataaggccagacacgggggctcatgcttgtaatcccagcacttgggaggccgaggcgggcggatcatgaggtcaggatttcgagaccagcctggccaacacagtgaaacgctgtctctactaaaaataccaaaactaactgggcatggtggcatgcgcctgtaatcccagctacttgggaggctaaggcaggagaatcgcttgaaccggggaagtgcacgttgcagtgagccaagatcgcgccactgtactccaacctgggcgacagagctggactccatctcaaaataataataagcttaaaaataaaaacttcagaaaatacatcacccaagttcccatccctacctgtctatccacaaaaccaaggcattcctgagattagttcatttattatactaatataacaagtgtttattaagtatctactactatattcaagtactattctaggagatagaaatgtagcagtttacaaaataaagcctgctctcatagagctcatattctagtgtggtagacagttgatacggaattaaagaatacatgggaataagtgcattaaagagaaaaattaagcagggtaaggggaaacaggtagttcaatatctatgtgggggtgagatgtacatggggggagtcaggaaaggtttcactgaggtgagactagaggatagcttaataatgtaaagaaacacactatgcaacaattaggggaagagcattccaagaaagagggagcagagaaggcaaaccctgagcaggaccatgcctgtgtatgcaggacatcagataggtcaaggtgctaaaatgtaataatccaggaggatattgtagggaaagactatcagagaggtagctggtaacttctggtaggaacctataggctattttaaatctttagctttattctggtctttttaattttctttttttttttcagacagagtctcgttctgtcgcccaggctggagtgcagtggcaccatctcggctctctgtaacctccgcctcctgaattcaagtgattctcctgcctcagcctcccgagtagctgggactaaaggcatgcaccaccatgccttggcctcccaaagtactgggattacaggagtgagccaccatgccagccatctttttaatttttaatgttaattaatttttgtagagacaggatctcactatgatgcccatgctggtcttgaatgcctggcatcaagcaatcttcctgcttcggcttcccaaagtgctgggattacaggtgtgagctactatacccggcctttagctttcttctgaatgtgaacctttttttttttttttggagatggagtctcactcactctgctgctcaggctggagtgcagtggtgtggtcttggctcactgcaacctctgcctctcggattgaagtgattcttgtgcctcagcattccaagtagctgggactacaggcgcgtgctgccacacccggctaatttttttgtatttttggtagggaaggggtttcaccatattgcccaggctggtcttgaagtcctgacctcaagtgatccatctgcctcgaccgggattacaggcgtgagccactacacttagctctaaatgtgaatttttgaaacggattttttggataaagtccaggcaagatatcaaagaacgactaacctggcagtgtgacaagaatgtggttttttccttaaatatttaactttttagaaaaggatcacaagggccaggtgcggtggctcacgctgtaatcccagcattttgggaggccaaggcgggccagcctgggtgacagagaatccatctcaaaaaaagaaaaaaaaaaaagaaaaggatcacaagaaaagcttgtggacagtaaccttattgtgaagggttgtaatacaactcttgtaatcatggggtttttgacatagcacagggcagtgaaaagaaaaacaatgaactaagtcaggaggctgggtttctactaccagttgtgtatataagcagagccaccttgggctaaccactctacctgaacctgtttccttctcttgccattcaccctgccagactccttgggctattgcaagaataaaattaaatgctacttgggaaaatgcttcacaacctgagatgacttgggaaaaatgcttcacaacctgagataacttgtaccaacattggtattattactgggaccaaatgtgactttaaaaagaaaaacaaccttgacaaagaaaactctgattggttactaaatccctatttctgagataagctacatttcaaagaaattctccgtaaaagaaaaattggattcagttatcataccagatggctttcattctcaccactgactcaattctgaaacaattatatttcagtatggtaattataatctaaactatataaacacactgtaaacacaaactttgaacagatgaaaactccgatatgtaaaaaggtaatgaatgttgaaggaagactgtgaaaagggaaaagaaaaaaaattaaaatgttccccttctaggtcctgatgagagtaaatgtttactataaaaatgattcaaatattttaaacacttttcaaaccaggcaatattttaggcctactgtatatttgcattttgagcttccaatacggataagtgactggaaaaagcagctaggtttaggttgaaaaacaacaacccaccggggaacacattttagcaaattcttctgaaagtcaaaaatgttatagtcataggtaaaaagttacaaagaactaccaattgtcagaaatagctgccaatattgacttagaagacagcagaaggaattttagttcaagaaacctaaaacaggctgaaaaccttacctaccctatagctaccacaaataacactgtttccagtcatgatcattcctgatcacatattaagacataactgcaaattgtgctatactgtactatattaaaaggaagtgaaatatgatccctatcctagaactttccatacaaatgaatgtaaaacaccataaaaattaatcttaaggccgggcgcggtggctcacgcctgtaatcccagcactttgggaggccgaggtgggcggatcacgaggtcaggaagtggagaccatcctggctaacacggtgaaaccccgtctctactaaaaatacaaaaaattagccgggcgtggtggtggacgcctgtagtcccagctacttggggggccgaggcaggagaatggcgtgaacccgggaggcggagcttgcagtgagccgagatggcgccactgcactccggcctgggtgaaagagcgagactccgtctcaaaaacaaaacaaacaaaaattaatcttaagccaggcgcagtggctcacgccagcactttggaaggccgaggcgggtggatcacgagatcaggacttcaagaccagcctgaccaacgtgatgaaaccctatctctactaaaaatacaaaattagccggccacggtggcgtgcgcctataatcccagctactcaggaggctgaggcaggagaagcgcttgaacttgaacctggcaggcggaggttgcagtgagccaagatggcgccactgcactccagcctgggcgacagagccagactccaaccccccaccccgaaaaaaaaaggtccaggccgggcgcagtggctcaggactgtaatcccagcactttggaaggctgaggcgggtggatcacaaggtcaggagatcgagaccatcttggctaacatggtgaaaccccgtctctactaaaaatacaaaaaattagccgggcatagtggtgggcgcctgtagtcccagctactcgggaggctgaggcaggagaatggcctgaacccgggaggcggagctggcagtgagccaagatcgtgccactgcactccagcctaggcagcagagcgagaccgtgtctcaaaaaaacaaaacaaaacaaaacaaaaagtctgggagcggtggctcacgcctgtaatcccagcactttcggaggccaaggcaggaggatcacctgaggtcaggagttcgagaccaacctgaccaatatggagaaaccctgtctctactaaaaatacaaaattagctggtgtgatggcacatgcctgcaatcccaggtactccggaggctgaggcagcagaattgcttgaacccgggaggtggaggttgtagtgagccgagattgtgccactgcactccagcctgggcaacaagagccaaagtctgtctcaaaaaaaaaaaaaaaaaaaaaaaaagaaattaatcttaacaggaaacagaaaaaagcaatgaaaagctagaaaacataatagttgattgaaaataacaatttagcattttcattcttacatctttaatttttatgtatctgagtttttaattgatggtttaatttgccagaatgagaaagaacatcctatttttatgactctctcccatggaaatgaaacataaatgtatccaaatgccacactattgaggattttcctgatcactgattgtcatgagtaagttttgtgctttttcaaaagcagttttttcctacaatgtcatttcctgcttctctggctctgattttcaataaattgataaattgtgaatcctgttttcctcttatttttgtttagctataatgttgaagggcaagggagaggatggttatttataaatcttgtatcgctctgaaaacacaacatacattttccttaatctgattaacttgacttcaaatatgaaaaacaactttcataaagcagaaaagaatttacccttttttattgtgggtaagaggcaatggtacaacttttcaacttattttttgaatgttactcactactaaccatcaccatatttaaaaaaattaaagaactaatttagtttagtttattatttatttgacaaatgtttattgagtggcaactaggtcccaagtaccgttctaactactgaacatacagatgtatgtaaacaaaacaaaaatcccatcctggagtttacattctgtgggactagagataaaaaatggatacattacatagaatgtcagctagtaatcagtgttatggagaagcagcaggaatagaagataaagtgtgtgctgggggtgtggtaattttaaataggggtgtctggaaatgaaaaggtggtatttcaatcaagatttttagaccatggctgggtgcaatggctcaggcctgtaatcccagcaccttgagaggccaagggagggtagatcacttgaggtcaggagtttgagaccagcatggccaacatagcaaaaccctatctctacaacagaaaaatacaagaatggctggacgcagtggcttatgcctgtaatcctagcactttgggaggcccaggcgggtggatcacaaggtcaggagatcaagactatcctggctaacacggtgaaatcccgcctctactaaaaaagaaaaaaaaatacaaaaaattagccgggcgtggtagtgggtgcttgtagtcccagctattcaggaggctcaggcagaagaatggcatgaacccgggaggcagagtttgcagtgagctgagatcgcgccactgcactccagcctgggcaacagagcaagactccatctcaaaaaaagaaaaaaaaatacaaaaattagctgggcatggtggtgcacacctatcgtccctgctactctggaggctgaggtgggaggattgcttgagcctgacgaggttgaggctgcagtgagctgtgatagcaccactgcactccagcctctcgacagagatcctatataaaaaaaaaacctctgcatttcattgtatgtaaataagtatgtaatttcattgtatgtacagagccagtttcaaacaaaggttcttccaaatacctatcctctcaacgacaccgatcatccatgtttttttttttttttttttttttttgagatggagtttagctctgtcgctggagttcagtggtgccatattggctcacagcaacatctgcctcctggttcaagtgattctcctgcctcagcctcctgagtagctgggattacaggcacatgccactacgcccagctaatttttgtatttttagtggagagggggtttcaccatgttggccaggatggtctcgatctcctgacctcgtgatcctaccaccttggcctcccaaagtgctgggattacaggcataagccaccgccctcggcctcatccatgattttattttgccatttcaagtgatggagcttgttttagagctggaagaaaagccaaaatgccagttaatctaaactagattcctgccccagtgcagaaccaatcaagacagagtccctgtctttcccggaccacaggatttgtgttgaaaaggagaggagtgggagaggcagagtggatggagaacaaggaatcattttctatatttttaaagttcttcagttaagaaaatcagcaattacaatagcctaatcttactagacatgtcttttcttccctagtatgtaaggtcaattctgttcatttgcataggagataatcataggaatcccaaattaatacactcttgtgctgacttaccagatgggacactctaagattttctgcatagcattaatgacattttgtacttcttcaacgcgaagagcagataaatccatttctttctgttccaatgaactttaacacattagaaaaacatatatatatatctttttaaaaggtttataaaatgacaacttcattttatcattttaaaataaagtaaatttaagatttggaaggttttagaataatacaaaccaaagaactaatgacaacgtcctttatttttaaagattctagaagttgctttttgtaattagacaacataaattctgaattttttcacatattgctgccaaccccttgggtcttttcctttctccaagaaagagaaagctacagaggagtgactgaccgggtaggtggtggtagccttagctttctccaatgtttctggttgttttctttttcttgcataaaaccaaaatcaacaacgaccaaaccaacaccaatcaaggcctccccgcccctaacctttcccagtgacctgctctcatctctggatcctcctcaagcacatccctgccggcagcatctgttactactgacgctcctctacttccctcttgcgctttctcaatggcgcaaatggatccagttcttaagttctccctcccacaaaatcctgtctcctccccttcccagacatattcctggcacctcttcttccacaaggtcccatcctctcatacataccagccggtgttttttgttttgttttgttttgttttgttttgagacagtctcgctctgtcgcccaggctggagtgcaatggcgcgatctcggctcactgcaacctccgcctcccgggttctagcgattctcctgcctcagcctcctgagtagctggagcggcaccacgcccggctaatttttgtatttttagtagagacggagtttcaccacgttggtcaggctggtctggaactcctgacctcatgaccagccgacgtttttaaagacatagtgtccccctcaaggcatattccagttcctatcacgaggattcccccacggacactcagtgcccccttcctgatcctcagcgcttccctcgcgacctacaaactgcccccctccccagggttcacaacgccttacgcctctcaggttccgcccctaccccccgtcaaagaatacccatctgtcagcttcggaaatccactctcccacgccagtaccccagagcatcacttgggccccctgtccctttcccgggactctactacctttacccagagcagagggtgaaggcctcctgagcgcaggggcccagttatctgagaaaccccacagcctgtcccccgtccaggaagtctcagcgagctcacgccgcgcagtcgcagttttaatttatctgtaattcccgcgcttttccgttgccacggaaaccaaggggctaccgctaagcagcagcctctcagaatacgaaatcaaggtac

SEQ ID NO: 103 - DNA, 21125 bp, Homo Sapiens
ttatatcaaaacatttattttttgtgttacaaaaacacaaataaatccaagcagataatgaaataaacacatttttttagtgtcccatcctgggttctctgccctagaatgtattaagcaggtcaagtttaggttacttcaacacttcttctggatgctatgaagtctccatcttataaccatgtttctctagttcagctctaagataaaacagaaagaacatcactaggtattctttataataaacattcttttagaaacaatacaataaataaacaaataaatgagctatgcctgagacatcaatttacaataccactgaatagttttacttttgtctctgaaaaaaaaacataagaaaattggatatgagtcaatataatactataaaattttgtttttcccattatttaacttgtattttatcttccttaattttcttataagtctatttgtggaagaaatgtgagggacttactgctatccttcaaatactttccaaatgctatatgaatgttctgttcctaataaatatttaaacataagttttgagactcattaacctcaggcaaagtacacatcactatcaaacctttagggattttacaatgatcataacaggtattactatattactgttgtatatgcagaaagaataaacagattgctttccatattgacatatatgtattgctctaaccttatttgccacaattcaaagtttatgacaaaattagtagatggctaatccatgataaaacactgagtaaacttaaagtatgattaatatgctttacatcattacatccaataagatagacatttgttctcaagtaaatttggcttagacaccactacactattccaatgcaaacacatgaccggaataatgtatagtatttagcattcatttctcaaaactcctttgctttcctaaaatttttagttatttagaatacaaatagtgagctaatttccataaattatatcaaggccacagattgttcaaatgaatcatccttgtcttctgctatggggtggtggtataaaccctggattaggagtcaagactccagtgcaagactctgactctggcccttcctttgctaactaatttgcttcctttgggcccttcccctgcccctcaggaaactggagattatagtatctgcccttcatttataacaacttatctccattgttttgagagctaaatgagagaaagttatacaaatgtaatgtagtatacattaaaataagagtcaaggctgaaaggaaaagctaaaagattctgatgatcacagaaaactcaaatgtttcatacaaaaactcttgctgccaatcttgagggaatgtggtaactgtctttgaattttatctcatgttaaaattttataatttatttaaaataaaagtaattttacaactttcttaaaccttagttttctactctgtagaatattcactttaacagcagcaacaaaaacaatgaacaaaaaaaccccaaagttcaacctacaatttaagtaacaagtataccaaatctgtccttcaggtttgtgtctattggctttcctaatgggaggtggctggtcactaactgcatgtataaattgtttacaatcacaaacaagatgatgaaatgctcttctatcagctaaattcttagaaaagatgaaaaattctttgctagaatttaaaaaaccaaaagaaaaaaattgaggccaccaagtacaaaacaaaaacactaataatcatgaggctgctgagtggaaaaatcaacaaagacaaaaatagaaaacctcagcacaactgttaatatcatacgacatacacagtgaacatacactatctgaaacgaaaacagcagcagtctttgtgcaacaaaacaagaaaaaagactaatggccactagtaggtttgaaaagtcctcttactatccaagaaactactcagctttatgacaatggctatatctgatttggtaaatcaggaactatactggatttttttgttgttgttgagatggagtctcgctctgttgcccaggctggagtgcagtggtgccatctcggctcactgcaagctccacctcccaggtttatgccattgtcctgcctcagcctccctagtagctgggactacaggcgcccgccaccaggcccagctaatttttttgtatttttagtagagacggggtttcaacatgttagccaggatggtctcgatctcctgacctcgtgatccaccggcctcggcctcccaaagtgctggggttacaggtgtgagccactgcgcctggcctatactggcttcttagagtttttatgtaagacgtgaaatagggttgagaaaaatcatactactacctatttctcttaatacataaacaaatgatatcagaagctgcaaaatcagaatgactttgagttacctggaagaacaaagtggccttattctttctacttctgttaaaggtaattacacggaaagagaaagacgaatgtggaaagtggggggcctgcgacatggacagtttttatttaacacacacacaccacagtctaagcactctacacatgttaaatcacttaaacgttataataactctagcagtaaagcactaattatcatctgagttttatgtgtgacaaaagtaggtcacagaaaggctaagtgagttgcccaaggttcatatggctaaataggaggcagatctggggttggaaccccagcaatctgattcacactagagtctgagatgcctctccactgttaaataggattaggaccaaataacatcagacaacagtaaactccattctttaccatgacttatgatattatgttaagggtttccatgtactttacagaaaagactaggaagaataactttgtgtgagtcttttaatcaagacaaattttttaaagcaaggattgtgcgaggctgttttattcaatatggtagtcatatgtggctattttaattgaataaaacaaaaaattcagtcccttagctgtgctagccacatttcatgtgcttagtagccaaatgtaactgattgcttctatacagcagcttctcaaacatttccatcactacagcaagttctatttgacaccactggcaatgtggcaacaatcttagtgaagaaagaactcatgactcaaatggggaaataaaaagaaaaatcttattcactaatggaggcatcaagatttatatacctcaggcaaaaaacaacaacagtgaaaaaacaacaaaaatagatttatatacctatagaaatccacaaacctaaaggcagaaacacaagagtacataatggcactgtgggggtgtattataaaaacagtaagccacaaatatataatgttctatttctaaagcaataaaaaggcaacatgtaatgatgtgaaatctaattatcaatacatttactactgaaagtttcttggtaaaaattatagtattcaacaatgtatcaatcagttttaagagaaaagtgctaatgaaagacataaaagaaacaaaacttcaaagaaatttgactattttgaatgtcaaaggaagaaaacttgtttagcctcaatttcaaaatgtcaaaaacatatcaggaagaaaactctgacacgtgattaaaaacacagagtagagatcaacagcatttggaagacctgaaaataaatagtctaatagcataatgatgccaaggcggaacaaaagggaatgtatatttttcaaaagctagtagggtgttctctaatgtggctcattttttgaaggacataaaacaaagacagatataaaaagaaagggcatgagcttgtacacatagaattaatctgatcctcgaaataaactgaaatctgtaaaaagaacagaaggggcttctaagagccatatactgatcatgaagaatgagaaagagcaggtacaatgcttggaacagatgatgtaacattaacagattttagagaaaaagcaggattattgttcaatagctatcatttttatcttgtccataaaactataaaaggaaaaacaacataattaagacaaaattgaaaactaagacaggtaagataactgcattaaggcagtttaaaatctcaaggctctggataattacatctcagggtactagaagaaccaaaagatgtagtcaaaaatcagtcagcaatatttgagacacggaaatgaaaaactgtagaagtatcagtataacagtgaaaggtaaattatactatttctaaaaatgagaaaaaaagtagataggtaaaattattatcagtctccagcaaaattctaagtctttatagagccaataaaaaaaaatgcagtgtaggagctggtgctactgcattactattagaaatcaaagtttaaaaatttattataaactatttcactttctgtttgaacaagcttactagactagtaaattagaagactggaatacatatatcttctatatctttacttgagcaaagtatatgacagtctatttattcttgtagccaagacaaataaatacagcctgaatcaaaataaaattaggagggaaaaaagtctcttcaacaaatggtgctggaaagactagacatctatatgcagaagaatgagctgaagccctatttcataacatatacaaaaattaacccaaagcaaagactgacatgtaagagcaaaaactataaagctcttagaagaaaacaaagataaatcttcattacattgaatttgccaatgaattcttaaatatgacaccaaaagcacaaataacaaaagaaaaaatagattaaaatacggctataatttaaaacaaaaaagaaaaataagttttggcaaggatgtggagagactgaaaccttcacaccctgctagtacgaacgctagtgagaacataaattgttcaactgctgtagaaaacagcttggcagctcctcaaaaagttaaatatagaattaacgtatgacccaacaattccacttgtgtgtgtgtgtgtgtgtgtgtgtgtgtgtatatatatatatataaaatttcttttcaaaagaattgaaaacaggtactcaaatatatgtacacgtacgttcatagcagcactatccacaatagctaaaaggtggaaacagtctgaatgtccatcaactgatgaatgtataaaacgtggcatatccatatagtattattataaattggaatatacaatatggaacatgtatatgaatattattcagccataaaaaggaatgaagtactgatgcatggtacaacatgaatgaaccttgaaaacattatgctaagtgaaaaaaggtacgcacgcaaggtcacaatattgtatgatttcatttatatgaagcttccaaaacaggcaaatacttagagatagaaagcagatcagcagcggccagggattagggcaagaaagaacgtggaatgactgcttaacaagtactgtgtttccttttgggatgctgaaaatactggaactaaatagagatgatggttgcacaatattgaggatgtactagaagccactgaactgtacactttcaaatgcttaattttatgttacatgaattttacctcaataaataaatgaaatcaggtagatttatacatgaatatgacacagtacattctcacaaccccaatctccattccagtttgagaatcaccaatctattaggtcccagcactctatgattctaatttctgctgagttatttgatattggtagaaaattaacattgacagaattaaattcctaaggataagaaatagcaaatatgcttctattttactacctttgtaaaaagaccagaaagaataaaagttgtatgcaattacacaaagtgttcatgtttagaatcacaggagatgaagacaatatgtcttactttacacagttcaaaaacctatttcaaagattaagtagcttttaagaggttaatcatctatgtaaattacatattccatgcttataattaatactgaactacaataaaaatctggcttaaaacttaccgtaactgattagagaagtcatcctctacattgtcatcatcccaattatcctcccagacatgtgcatcttcatcttcatctaagccagcccagtctaaaaatagaaacagatgctgtctaaatatttctcatacattatttccacaattacaaaaactttgaaaagcttgctactgaacactcacaattcaaaaacagctaaaaccatatctatgaaaaatggtatcttccttaaatctgagcttatgctgtctagttctctcaattcttgagtttgcagataacctaaaacagaagttaatacaaaaaattctacttgccaagaaacttacaatttcaggaggatatttactttactgatttttctttgaactcatttttagaaggtcgacttcacaatctttcaaaacacaacaccaacaaccctaaagcaagttgaatggcaggaagataccagtgtgaaattcaaaactgcaaaacgtaaggataacttatatacaaatatttaaaagtagaccaaactgtaagccaccactagtatctgcctaatacaactgatacaaaatttatatttttaaaggaagaataaacataaatatgcataaagaagaatattgtagtttttagttttctagattttcttcctccctttggtagtggtagaggggaggtttagattgagatttcagcttttgtttagaatggtgagaaagtacgtacgtattaccactattctctaacctcaaatctcaagctttaaatatgctatgtgggttgagcctggaaatagaaattatctatttgatagttattttaaggagtctttataaagatgtctaatggagttttatgttacaaaaaaataatttaaataaagactagatactatgttcttgagtaaagggggtgacataactcaaaatcacaacagaactgtttcaaggttctaagacaacaagcagattctactcagcttgaaccacttccaaataaccagcttcctaaactgttaagtaggtcgcttccatctgcattggtccctaaaaaggaaataatcatgtgtcaaaagattcaagccagaaatataaaataatattttacacttttctgctaaccttgtaagtctttgaaaaatactgtagagccttatcttttaaagcaactatcttttaagaaacaaaatttttcatctaattatgatttgattcaaaatgttatttcaatagttattaagtgatgtcttcaagttgactttacttcttttaacttagagaggggaaaaatatttaagaatggtacaatttttttagtttataaagttaaactctgatgatcatttacaacaaagataaagcatctctccctcgtctaataaccatctcaccctattttaatggctgggaaaggaaaggaaaaagtagagataaagtcccaggaaaaaggaactggctcatgaagagggggaaaaagaatactgtgagcaacattttaggtagaacatataaaaaagattcataacaatacctctatagttctttcgtattactatacagtacttcatagttatgacactactgagtaaacaaagacgaaagagctggccaaattcttcgttaattatctgataaatctagataaactttgtagccttaataccattatcttaagcagtaagaagcactaatgtctacgtaatagcataccacccttccaattatcatagatgaggaatctgagaaataacctttctattacaacttattaagcagttaaaattaatatgagcactgttaagaaaaatagtgctaacactgacaaaccagaatctattttggatggatattttaaacagtgtattaacctggattatgtacttaactatattacataaaaagcttatgtgatagggtataatgccccaaaatagtatgtccaacacttacaaattctctatactatacatacatgttacaatatatgtaagttacaatacatacaaactctactcaatgtataacatgaaaaagctgtaactattgtaatctctgggtttagctgacatcttcttggatctctgaattgtgttttaattttcaactctaacactacactgacaaccaagcaattttaatcactcagttttaaagggttaactccagaaatagttttgaaaaggacaaaatataaccaaacaatgatacccatgatatctgatatacctcatgtctaatgccatccttcaatatgtagatggccttataaagcatacactttaccttaaacactaaatgcattgccagaattgtgattaatcatgtaaataaccacagctgtatttgcttcaatgtgtatgcctccagatgtgtactggtttaaaaaaaaaaaaaaaccctacattttaaaaagtcagaattggaaataaccagtaacagatgcctaatacataagtttctagcaattcttattttagacgttgtcccaaattgggctttcttcactttggctagttgagaattacatctgtgactagctttaaatttaaaaaatctgagctatccaagatctaagacatacttcacctaagtatcaccttgacatttaagtacaaaaagaatcttctttcaacttagaaaattcttttaatacttactttcccctactctgcaacatacatttccaaatttctgaaaggcatgaaatatagcatttttgagaaaagtaaaaaggaaatcccactcatactaaatagggttgcaaatgttctattctacaccaattttcaagagtatcgaattcttattccataaaaataaaggtattctgaacataaacaacctaatctccaaccaagtttcttcaaatacaaaacatgcaagtatatacagaacattacatgaaaagaaaaatactaaattgaacattcaccatcttaggtgtgtgtaaaagagaagagcaatacttacaaacagcatcactatactcatgagtatgataatgaagccacaccatatccagtgattctgagataaatttacaagtgttcctgctgagggtgtatgaaacaaattattttttttgaaaatttcacttctgtaggttatcataatgcaaacacccgtataccctgcagatctaatgtctagtcagtgactaagaaatcaatacgtagcacggcaccactttgctactatattttctctaacaaggaccaaaactgttagtggagaacttcaaacaaaaagcaagtcataaacaatgtttttattggcaggctgttggtgagctttcagttgtggcagagtctgaaacaaaggatcaaaataacttcataatcattcataactattcttacattttttaaaaaggaaatccaaacccaattattttcatcaacaattaaaaaaaatataagtctggcagaatggttccactttgttggttctctttgttgatttgggattttttttactttaagttctgggatagatgtgcagaatgtacaggtccgttacataggaatacatgtgccacagtggtttgctgcacccatcaacccatcacctaggttttaagtcccacacgaattaagtatttctcctaatgccatccctccccttgcttcccaccccgacaggcccaggtgtgtgatgttccccttcctgtgtctactatgtgttctcattgttcaacttccacttatgagtgagaacatgcggtgttaggttttctgttcttgtgttagtttgttgacaatgatggtttccagcttcatccatgtccctaaaaaggacaagaacccatccttttttatggctgtatagtattgcacagcgtatacgtgccaccttttctttaaccagtccgtcactgatggccattgggatcggttccaagtctttgctattgtgaatagtgcttcaataaacattcatgtgcatgcgtctttatagtagaatgatttataatcctttgggtataacccagtaatgggattgctgggtcaaatggttatttctagttctagatccttgcggaatcaccacattgtcttccacaatggttgaactaatttacactcccaccaacagtgtaaaagcgttcctacttctccacatcctctccagcataaatttttaaaaatgtatttgttttttctttcgcttcctgaacctggtagatttgtggctttaattttaattccataaaatttacaaaaaccattactctcatcttttccaagcccttatgccctagattcatctcatcttggtaccctcattctgatctacccttcaaattactgagtcaagggtatccaatctcaacttcaccatgcatattcttaagacacgcatgggcaaaatcacaaccccagatttcttcttattctcaacaccccatatcaaactagttgctaatgcttcatcacttctacctcccttactgttgtggcatcattctcttcacttcatttctaataataatttatttcgcccttagtcctcacctgagttatttcgacaatctgctaattaacctccctgactctagtctttctatcttttcaaattaattctgctgggttaatgtttcagcatattgcctaaaggaaacttacacatatcactgtcataagcaaaacaaacaaaacattttaaaaaccacttctcatctagttaattaaggattaagtccaaactggtcagaggcttaaagctttccatgctgaggccacaaaccacctgcatttgcaactactatttcataagcaaatacaatatacatacacatttatttttcacttcaaagcacctacaccttttcccttcttttgaaaacccctttcctacgtttcttttgaaagccctgttcaaaggttgctacctcgcactgtacataactggaagtaatctgtttcttttgaactgctgttgcactttactatcagttgaaggaaaccaaattacatcttactcagaagcccaacaggtaagagaaacaaaggcaatgttgctatggtttaattggtggtagggagaaaagggctttgagtcccaccccaggataaacacttccaaaatactaaagcactctagcttggtgttaaaaccactgattcttctctcccttaactactacttactaagttcaaagacaaatatctatagaagtcaaatttgcttcaagacagcctctaattaactgtgaccttgggtaaattaaatttttctgatccctaggtataaaacttatacctcaaagagctatgaagactcaatgacactgtgtatgtaaagcacttagtactgataaatggcagctaataccattctctctgtacttttcagtaccagatttataggaaacactcaacaaatacatgtcaaatgaataaatcctttattacatacatgctaatcactggaaaggcaatttgtgggatgagagaggtgagtagagaaacatgtcctagaatataaacaatacaatttccaccaaacattacatgtacaccagagtacacaaccagacaaaggattaaggatatttggtaaattttaaatacttatgaagaagagtacactcatccctcggtatactcggggtacttgttccaggacagcccaagtatacccaaatctatgtatattcaggtcccatggttagccaagtggtagtcagccctctctacaggtgggttccatatcctgtgaatatcgtacttccttttcccatttagttgaaaaaaatctgtgtataaatggaccctcacacttcaaaccatgttgttaaagggtcaactgtatacagtttttgaaacttattttcctctcaatgttttcgcagttcatcacatctttcaatgagtaatgtttaacaaacaagtagtaacattaaacactacttaaaccacaattgcttactgcttgctcattccatagaaccaatgaaatagctaaccaaatagtttttcaaagagtttttcagtgtttaatatcctggttcacacctctcactatcccttcccaagcaccagcatcttgatttgggggtttttcattccaatctgtatatacccctaaataatgtatgttactattttatgtgtctttctatgaataaccacattattaagtacttgtggaaaaacatttaatggcaatttttttaaatttacaagtttctaatactgcaaaataaatcaattatcaaataattcacaaatttaacaagcttaattttgaatatattcaaaattactaaatacatgtcagacacagctcaaattctaaataaatattaaacatcatccaaaatccaaactcctaagtacattagaggggagagaaaaaaggagactaatgtttactgaataccaactttgtgccagactctgtttacatatgtatcattgttctggactaaatctttgtaccctggccccccaaaacccccccaaaaattcttatgttgaagccctcatcctcaatatgatggtattcgggaggtaatcaggattgaatgaggtcttgcgggtagggctcccatgatgggattagtgccttaagagacaccagagagcatgcactctttcattctgccacaagagaacacagcacaaaggcagccttgtgcaaggcaggaagagtggcctcaccaagaactgtatcgacctacactttaatcttggactccacagcctccagaatgggtgagaaaataaatctctgatgtttaagccacccagtctatgctattttgttatggtagcccaggccaaccattacaataatgtaattctttcatgactctaataaatattattagccatatattacagataatgaaattgaggattaagatggtaacagctcagagaaaaacataatggttaatcttacttaaaaaaatcaatccaaatcaaaatgatacaattttatttttcattcatgaggtcagtaatgactaacatgtttactatctagtgtagcaagcttatgagggaaaaggtgaactgtagatgaaaacataaattggcataacccttctcaaaggcaatttgagagtatctgtcaaaatttaagatatgccaggtctaagatgaggtgtctaagcccaagtagagcaaggagggcattcctggagaggggcagcatggtgtggctggtgtgtcagagcctggacagaacgaagtcacccacactagaggatgggagggtggcctggcataaaatgtggagcccaagttgggcaagaagggcacctgttgggggcagcaaagattggttaggaagggggatgaccaaatagacaatacattgaagataatggaagccaggtttctcactattggagaagggaataacaaatgtagaaagggaaaaaactagaatgaatccagtggtgttgaactgcaattggagacatctgtgtgaacccatggttttatacatacacacacacacacactcctgtacatccctagttccttccacttagagggtctgggagcaggaatatcccaaatgcaataaacataagcaaagtgaagaccctgcattctaaataccattctccactaaaaagaaatcacattggagcaacggctgatttcacatataaaattagtttggaatacaccttgtgccagaatgctaggaaatgcacaaagaataatggagacatggcaaaaggacacagaagacagcctgaaggagttctgcatgttcaaatatgggacaatctgagaatccaaataatagttacaaattataacctactgagtcagaatccactagtccacactgctatacattttttaaaagatgaacaagttacaagtttgatgatcactggaatactgtatttacatagtttcaaagtccctcccccaaaactgcctattaggaagggaaaattagtaacctaacaatggaaaggcctaacaaacaccaccttaatagtgattgaagtgaacatccccagtaatggaacaaatgagaataatgttccacctaaaaagatgtcattagaacagagcaccaggactacaatgtagaacttctatcatgaggaaataggcacaggtgaggaacattctacaaaatatctggcctgtagtcttctaaagtgtgaaaatcattaaagttaaagacaaacaggaaatgctctagactaaggaagactaaagagacaggacaagataatgtaatccaggactctatagtaagacattattgagacaatgggagaaagctgaaagtgatctgtgggttagatcatacaggttgagtatcccttattcaaaatgcttgagaccagaagtgtttcaaattttgtatttttttgaattttgaaatacttgcattatatatttacaactgggcatcccaaatcccctaatctgaaatttcatgttggtactcagaaagtttgagattccggaggatttcagatttgggatgctcaacctatagtaatgcatcagtgcgttaatttcctgattttgatggttgtcttgtgactatgtccttgtaggaaatacacattaaaatactcaggagtgatggccatcaggttggcaacttattcacaaatggtttagagaaaaatgtttgtactgtactttcaactattctgtaagtttgagattatttcaaaataaaaattatattataaaaaatgagtctgccaattcaatttggcaattcttctctaggagtttatcttatagattagcacacacacaaaaagatgtaaacatattcattatctgtaacagaaaaaaaacaacaaaacccaagcaacaaaaaccctaaagctataaggttattcactgcagcatattccattttttttttttcttttaaaggccaggtgcagtggctcacctgtaatcccagcacctgggaagactgatgggaagactgctgaggccattagttcagtaccagcctgggcaacataacgagaccaaatctccacaaaaaatttgaaagaacaaattaggtgagatggcacatgcctgtactcccagctactagggaggctgatagggaggctgagacagaggatcactcaatcccaggagttcaaggccgtaataatctgtgacagcgccactgtactccagcctgggtgacagagcaccagagcaagaccttgtctcttaaaaacacacacacacacacacacacacacacacacacacacatacataaaagaaccaaagaaaaaaccctaatatctatcaagaagggactagttaaatagactatttaagatgaacacaatgagggcatgaggtagatttttatattgatgcaaaaatgtacctgagatacattaaataataaaaatcaagtaggaggaaatagtatatatcgtatgtcttctgtgtatgtatttaaaggatacatacaaacaagtacaatttataaatacattctggaaggatactaaagaaaaaaacatttaacgttggttatcactgggacataaataacttttttggggaattgtagagggaaactgtgtttttactttttaatttatactctcattaagtttaaatttttaccataagcggttacttatacaattatcctatataatatactacaaaaatattttaaagaggaagttaagtaactagcatgaggtgactagctgaaagtttatgaatggtagatttgaacctaggcctaatcctagattcatcatgcttattctatcctggggttcaaaaactttcttcttgcacacaattatcaaaaatggacattcaacaggtactcttcgaatcattatacagattacacattttttcttaaaaatttttagtaacatgagttctccatttcttgctaccaccatgtaactaattcaaatgtttaatggttatgtccactatattacatttaataatgcaaaaacagcaaaagccctttttggcactaggtaaactgactagcatggtgtgtgacattatcaatactggtcacatctatcttctacatttaagattctaaggaatcctcctattgaatgtttagtcctgttggtatatgctgttcacataaatatttctcaatagcatttttcacagggcagttcttcctcgtgcaggcacaaatataaaatccttgacctctacccactaaatgctggcagtttttctacactcctacctgtcaagtcagtgtgacatccaaaaacactcccttggttaagaaccactgtaagatgtcatactttttaaggcacaggtgataatgcctcatttattccagaatgctggcagcattaggggatcaccagtctgttgtctgcctcaacagacagattcccatcataacactgtcttatccagaaatttctccaggggccagagggtgggaaggtgggtagtattctgctcctgatttcttcagactatatagaaatttcacctaatacagaaaaagtatagaatacttagtataatatcactcttgtaaacgctattgctgctgcaggcaaactcaatttcattctaaatattctaaaaaagcttctctctcaaaaaaaaaaaaaaaaccctttcaattctggcacaggaagagaataaaagaatctaaaggagcacttgttctcttccctcttttactcgaatccacatctaattgtcagagaaactaataaaaatattttttaaaactctttcaataatttgatatggaaaagtagtcaacgttttaaataaattaggctgggcgcggtggctcatgcctgtaatcccagcactttgggaggccgaggcgggcggatcaccaggtcaggagatcgagaccatcctggctaacaccatgaaaccccatctctacaaaaaaaattagccgggcgtggtgacgggcacctgtaatcccagctactagggaggctgaggcaggagaatggtgtgaacccaggaggtggagcttgcagtgagccgagattgcgccactgcactccagcctgggtgacagagcgagactctgtctcaaaaaaaaaaaaaaagttttaaataaattatagactacttcagtttttgactctatcaccaccaacctgaccgtatgatttgaaaaatgaaatcttctctagacttttaagttgccctccggtcctagaattctaaccatttcaaagcttccaaaatcatatcaaaatcaatcacacccaggaccttgaatgtcttcctaataaaggctgttctaaatcagtttaagtagtcaagaagttggaggctgtatatcacaaagatcctaaatatgattttttacagctcctgcttaatgaccagaagattacacacccaccaattagaataattgtgaggaaatgccaatgtagcaccaattcacaggctatagaatgggggaaaaaataaaagcagcatttgtaccttcagagactccttccagatgttgcactttacattgaagggctattgagaagaaactatgctgacatggtgcctcacacctgtaatcccagcactttgggaggcagaggcgggtggatcacctgaggtcgggagttcaagaccagcttgaccaacatggagaaaccctgtctctaccaaaaatacaaaattagccgggcatggtggcacatgcctgtaatcccagctacacgggaggctgaggcaggagaatcgcttgaacccaggaggtggaggttgcagtcagccgagatcgcgccactgcactccagcctgggcaacaagagtgaaactccatctcaaacaaacaaaaaaaaaaaaaaaaaaaaaaaaagagagagagaagaaacaataaaaattccctttccttaaaatgattaaatgaacatcctaccaaacatattcttatgcaagatgggatgtagcaacgccactcccaaaagaaagacccactcccaaaagaaaatctattagtcgaaccaccagtaacgactttcatgtggcaacctctatactccaagttacccgagagtggataaaatccactttctggagcactgacactcaacaaagcgtttgaaagtaagatctgttatagactgcagagatgttcataggctgccttaacaacaccaattttaatttgtatctgttagtgaatttgtcaatggcatacttacaagaaaaataattttccaaagtacagaaagaacttgaaagtaaatcagggcattaatacttgaagtgaaaactcaaataccaaaagattgaaaataggtcactgttttaaagtaatacttttcaaactttaatgttttttcaaacatctctcttaggaatcctggtaaagcccacactgattaagtaggtctaggtttgaggaatgatgagatgctgcaattttaacaggctcccaggcaatgccaagtctgctgtttcatggatcacattttgaatagtaacagactctaaaccttgactagaccaaaacatgtcggaaatgtagattctcagaaaagaaataattctttggtgatattttctgaagtgtttttcttttgcttttgttactcatcagaacaactttcatgagtaaatattgagtggtttcaccttgtgggatgattttctcacaaattcaaattaagaaaaacctctccaaatcataaaccagagaagagaaacttgaacaaaataaaggcattaaaaatgtttctcactctaaaatggaaagtttcctgaatgaattaattctacacatttatacctgaagacaacaaacattctgtaaggagacccataaatggtcaattacttaatgttaataaacaagtctgttgtgagtcttttgtccttagaaagaataatttttttttgcttttccttttacctttttgttttgttttactatataactactgacactttgaaaaattgctgctcacatataaacttagaacaagcacaaactacactcgcaaaagctgatgaaagttgctgaaaaaaatcaagtgtaccatcaggtacatagttatctctagatcgtttttaagcagtcaattatcaactaactactcattttaaatgcgggttcattcatcattcattcaacatgcatttattgaccacctactatgtatcaggcactttgctaaatgttacagataaagtttggatcagggagttagacctttcagatcctggcttggacataatggcaagttttgtttgtttgtttttctttttgtctctaagcctccatattctcaaggtgatagtgataattagattatgtaatgcaaataaagtgcctaacattccaccctgtatatgataatgaagaatgctatttgaagtattaagtttgagtaagaagtagatcctaccttcaataggccagctttctacgacacagctctatgttggcggattatgaagcaacttgaaagcgagctaaagaaaacatgactgaatagataaatccattaccaaaacaaaaaactaagaatgcctacaacacataattaattccagaactgaaaagaaatgtgctttgggttagtttaccagtttctgtagcatgtacactaatgttctcttccactaaacaaagtaacagtacattataaatagaacaaatgttccagctatgtggttttatgcacaataggatcatcatagggtatacaacttgggacaattttagtgaagtagtaattgcttgatgcaacaggatgtgtaccccattaaccacaattctctttctaccaccttcagaaagtaatctccttttcttataaggtaaatatttacaaatcctactcatcaaccatcagccaataaagcagcctattttgaaaacctaactggcaacagcaatctcacaaacagaagcagtacagctgaagttaagagctttggtgtcaatcaggccaggtttcccagttccagttctattatttctaactagttatgagacatcagaaggtttcttaaccattccgagcttcagtttatctgaagaatggcaatactgaggcctacttcttatatttatgaaagtggaatatgctattacaagtaaagcacttagacaagttcctgaaaacaacagccactcaataaatgttagcaatttgctattatctacaatgaaaaaaccaggtctttagttttgaagctaaaaaaaaaaatgtgtaaggtttaggttcttttaaaaaaatattttatttttgtagggacagggtctcgctatgttgcccaggctggtcttgaactcctgaccttatgtgatcctcctgcctcttcctcccaaactgctgcgattacaggcgtgagccaccacacccggcaagttttagggtcttataaagcattaagttaggtcacagttaagtgatcaaaatggtgaggaacaggaatgaggcaataatgtgtattaagcaccccgtatcttaccctcctatcctacttaatgaggcttcatttgtaacatcctaaaagttaagcagcattggcgtaactactgacaattcaattctggaaaggtttaaagacaaagaaagactgctaaaacaaaaagaaaaggaggttatgtagacttgaactaagtttaagtggtgagtaacccaggtgaacagtaaatggaccaaccatcacagacgcggggctatgggtccagactcacggtggctcctcccagtgaggaagccgaagccattgggcctcaccagtgagtcccagcgcaacaccccaaacccgaatctggggcgccactgaggggtgagcgttagcgcctcgagtgccggccctgggagtccaaacttcccgccggtgcccccagctgggcccgagcacccaagctacctccacacggaggcctgagtcaccgttcgcgcgacacagaaaccggggcccagcggttaccttcggcagggaactcttcaaactcgtcgtcttcctctaacagacctaagtctaccggctgctttttctctgacatctcgactgtccgcgcccaacacctcccagataagcagaaaagttggaaccctcactcttcctcaaggaaacgccaccgtcactaccgcctccgacgctgacgctaccatagagacttggggaaagaat

SEQ ID NO: 104 - DNA, 87698 bp, Homo Sapiens
tttcccggcgtgccccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacggtaagtcttcagtagccgccttcagtttacaggtcgctacatctttcggagaataaaatgggaagttgagaactctccttaggagcagaagcgtccctagggctccacaggtgtaggcccttaaagtgccttagggtgtggcctgcaggctacagcgaccttaggagtttgcctgaagcagtctcggaaggatgtccggacctggcctggggacaaggtttacttaagaatcccacgataccgggagctgtcgccgctcactcagagttcagttcccactggatgccctttggtctgtattgatgtttttaacgctgtctccttgctttcaaagcatagcattcacttcccagtagttgtcccatacaagaattcctttaaaagttataaaatgatacatacatgactaaagagtttccaagtatgccaactgtccagacataatacatggaaaataaataaattcaaaatgtaactgatgtagtggggcttaacttggaaaacttctcttcttaaaactcagtcaaaaatttaacgttggtgcacgactgacttttttttttttttaaagccgtgggaatatttataaatttgaatggaaagaataaccaagaggcattctggtcaggaatagtggcttaagaaaaagcaagacgatgtcagtatagcagggagaagagtctaaaggaaggatttgtgaagagtgtagaaagagagaaggttgagaattgaatgccaaacttgtttacttttgtttttgtaaaaatgttatttgttgaatgcttgttatgtacttaggattgtactaaatactagcagaagggagagtagtactgtatagtgtttatgaggactggctgcctcaatacagctttttcgcttcatttattagttgtctgattgtttgcgagtgacctcactgctctgtgccttagttttctcatttataaaatggagattaaaaatagtttctacagctgggcacggtggctcacgcctgtaatcccagcactttgggaggccgaggcgggtggatcacctgaggtcaggagttcgagaccagcctggccaacgtggcgaaaccccatctctaataaaaatacaaaaattagccaggcgtggtggcgcatgcctgtaatcctagctactggggaggccgaggcgggagaatcgcttgaaccggggaggtggaggttgcagtgagccgagatcacgccattgcactacaccagcctgggtgacagagggagactctctccccccacaaaaaaaaaaaaaaaaaaaaaaaagtttctacaggctgggcatggtggctgacgactgtaatccgagccgtttgggaggctgaggctgggggattgcttgagcccaggaggtcgagaggtcgaggctgcagtaagccatgatcatgcagctgcactgcagcctgggcagcagaatgagaccctgtctcttaaacaaaaagttcctacagcctggagttaatgtgagaattaaataaatgtatgtaagagtgcttagtacaatacagtacttaactgttagccattcttattattaacttaaattagtttaaagggtttcagttgaaaataattatttttttcccaagtaacaattcttcatattaggataacttcttagttatatagcatttctgtgaacttacagcattaacacttaatcatatttttattacaggttttataatgtcagattttatcttttatagtttccatgataaataatatttttgtaatgaattcatattttatggtaaacttctgtggttctcttataacgaaataatgtaattttctatttctttagaccatcattgaatgtctaaaatatatttgtactggagatttccctcctggaaccaaaggaaatacatttgtacacgatcccaaggtaatggtgctagtacaattttgtatttttataattataaaaatgataatagcttattatagaaaacttggcactggaaaactataaagagaaatgaaagtcagccccacacagttttagcacccagtagtaaccgttgttgacattttcatgtgttttcctcctcctttaaatactgttttatatagctgatgtcatactcttaattttgtattctgggtttttttccccacttaacattatcatgaagtcctatgtcattaaaaaactatcatctgggtgtttggtatgtaagtgtttcttttaatctttatactgctttgtatgtctgagatattttctacttaaagtgcatgaacactttagtagttatgtaattttcttacattagattgctttcagtttttcattaaaatgtaccatgataagccaggcttgggggtgtgtgccaatactcccagatagctctagaggctgagatgggaggattgcttcagcccaggagttcaaggctagcctggacaatatagtgagacccactgtctagaaaaaaaagtatcatgataaaaatctttgtgtatgaatcattgtttgaattatggtgtttatactattcgtatgtgtaaaggacatagaatttggtctataggtttgtttttgcacatatagaagtgaaacaacaatacacacacacacacacacacacacacatatatatatagtttattcgtttttagtggggtcatgtgcctctctagccgctccctgaccccagttccactatgttttcgttacgtattcttccaagcttttttctgcttataaaaccatgtctacgtgagcacataaatgcattcacacatacatattttagcacattaatataattttatacttctattttattgtttttaattagtaaattgtattccattgagtttatatcctgtagtttattaaatgaccccctgttgattattatttgtttctaccttagtgtgattaaagataactctgtaattatgaaaatatttatgaattttcctcttagaaatgtaatagtatttagtacatttactgagtcctctccataatgactgtttcccaccttctctctccttaaatctacaatctactttccttaattgatgatcttgctttgtactttattgagaaataggaagaatcaaatgagaattcccttattttccaatcatcacatctacgaaactactgtacatacgtgcccatactgttttttcttggataaattatttgttgttttatctaaacatgaaccagctccttggaggctagatctcattgatccctcttatccacccaaggattttgcccttcagtttttccatctctctcctggatcagcagtttctcttgatggatcattcacatcagcatataaacatgctctggtatctctagtcttcaaacaaaaaactctccctttactccaatttaccctctagccattaccttttctctgttccaatatatttcaaaattcataagatttgtatgtcctcattgtctttacttcattgactcccatttttccctcaatctactccattcaggttttctttttttcctccactaaaagtgcctttgtaaggtcaccaataatctcaatgtgccagatagagtggtcagtttctaattctcattaacatcttgtcagatttgacacagttggctatttcttttttaaaatatatttccttcttggcttttgtgacactataatctcatagtttccttctttctcactggctatactttagtctttgttgggtctacctttgcttgatttctttttttttatgagacggagtcttgcactgttgcccaggctggagtgcagtgtggcatgatcttggcttactgcaacctctgtctctcaggttcaagctattcttgtgccttagcctcttgagtagctgggattacgggtgtgccaccacacccagctaatttttgtatttttagcagagacggggtttcatcatgttggccaggctggtctcaacctcctcacctcaggtgatccacctgcctcagtctcccaaagtgctgggattacagatgtgagccactgcacccaacctgcttgatttctaaaagccagtgtgacacaagagttggccatctttgcattaaccctcttccctatctctcttggatgagcttattcagtctaacggctttaagtactggttatgtgctggtaactaccacatttatatatttgaccctgacttctttccttaactctagacatatatgtctagctgtttgtttggatatttaatgggcatctcaaatttaacatgttcaaaacagaactcttgattccttgtacccacttcctgcctacattctcagctctgttactacctcagtaccccacccccgccagttttgtaaatgatgtcatcatccctacataagcaattcttacctacccttctaaaatatgtcagaatttgtctacttcattccatcggccactgtgttcctgttccaagccaccatcatattccctttcaactattagaatcgtctcctaacttattttcctgccctcattcttgaagctctctctttctcacagagtaatcagagttgtcttttaaatattcattcaagagggaatgagttgttcaaaatctgggaagaaaacatttcattcagtctagttgcagagtccctgagcatggttggtgtgttcaaggaatgacaaggaagaacaagggaaaatggtagaaaataaagttagaaagataggagagactagatcctgtaggtccttggattctagtcttatttaaataggaatctgtctattgggagattttgagcagggaaaggacatggtctgatttatcttttaaagtgctcagtctggttgctgagagaagactgtccgtaggtagcaaagatagggcagagacaaattaagaagattttgtgatgatccaggtgagaaatataggtggcttcattaaggtagtggtagaatggtgagaaatgtttggatttaggatgtattttgaagatagaaccaacaaattagctaatggtttggataatggtgtatgaaagaagtaaaagcatcaagcataactccaaagtttttggcttgaacaactggataaaatagttttgtcatttattataataggggcactatggaaaaaatatttgggtggatctggtttaaacatgcaaattagggatatgtgttaaatatccaaaggagatgtccagttggcaagcagaagtctgttcaggaaagagattaggactggagaaagaaaattaggaatcattagtgtatacaggtagttccacatagttaatttttaaagcctgatgagatcaaatagagagtgaatatggaaaagatattcaagaccttaacctagagcactagagccgatgatgcctttagaaattgggaagaggaggagaagctagtaaaagagcaattcgttaagtaaggaaaactgagagagtggtgtcttggaagacaagagaataaagtgttataaggaggaaatcatcaactgtgtcaaatatgttgatagctcaagaaagaagaggagtgtttggatatgtggagtccgttgttgctcttgacaaaaccagttccagtaatcagagaaaagataaagaagtgaaacagaattattttatgaattttgttgtaagtggacacagacataggacagtagctgaagaggttaacaggataaaggaaagttttgttgttgttgttttattgtgtttttaaaagtgggatatactagagcatttgtagactgttgggaatgactctggacagaaacattgatgcaggagaggggataattacagagcacaattcttgagtaggcaaaaagagataagatccattgcccaactggaggggataccaggaacatccactgttatccattgtaacagggatttaggcagattatatgattggaaactttagtggtgaaagaatgagtaagttctcttttgattgcttttatattctcaaatgaaaaaagaaatgaagttactggttgagagtggcagaaggggttgattgagcctagaaaacatagaatagtttttaacctcagtaagtaaattgattaagggaggtgttctgggattacatgacagtgtcaggggttttgtgaaaatttaaagagagaccagccatcatggttatgtatgttttttcagtcttgttcagcccaagcactgaataaattggaaagttgcatttatccatggttggggatttggtaaatactatgaaggtaatgagaagcaaggaattgagtaccgatatggtttgaatttgtatctgcccaaatctcatgtcaaattgtaacccccattgttggaggaggggcctggtgggaggtgattgaatcatggaggtggatttcccccttgcagttcttgtgatagtaagttctcatgagatctgattgtttaaaagtgtgtagcacctcccccttcactctcttcctcctgttctggccgtgtaagatgtgccagcctcctcttcaccttctgccatgattgtaagtttcctgaggcctccgcagtcatgcttcctgtacagcctgcagaaccgtgagccaattaaacctcttttctttaaccagtttcaggtatttctttgtagcagtgagaaaacagactaatgcagaaagttggtaccgagagtagggtattgctataaagatagctgaaaatgtggaagtgactttggaactgggtaatgggtagaggttggaacagtttggagggctcaaaagaagacaggaagatgaggaaaagtttggaacttcctagagacttgttaaattattttgaccaaaatgctgacagtgatatgaataatgaagtctaggctgaggaggtctcagatggagataaggagcttactgagaactggagtaaaggtcactcttgcgatgctttagcaaagagactggcagcattgtgcccctgctctaggaatctgtggaactttgaacttgaaagagatgatttagagtatttggtggaagaaatttccaggcagcaaaactttcaacatgtggcctggctgcttctagcagtatatgctcatatgtgcaagcaaagagatctgaaactggaacttatatttaaaagggaagcagagcataaaagtttggaaaatttgcaccctgatcatgtggtagaaaagaaaaacccattttctggggaggaattcaagccggctgcagaaatttgcataagtaaagaggagcagaatgtttaatagccaagacactggggaaaatggctagaaggcatttcagagatcttcacagcagcccctcccattacaggacactactccctgtgtttcagccactccagctccagccatggctaaaagggccccagatatatcttaagctgctgctccagaggctgcaagctgtaagccttggcagcttccacatggtgttaagcctggggttgcgcagagaacaagagttgaggcttgggagcctccacctagatttcaggggatgtatggaaacgtctggatgtccaggcagaagtctgcaggacttgttgcaggagggacctggttggggtgattggatcatgggggtagatttcccccttgctgttctcatgatagtgagtaaattctcatgagatctggttgtttaaaaatctgtcacaattccccctttactctttttcttctgctccagccatgtaagatgtgccagcatcccctttgccttctgccatgattgtaagtttcctgaggtctccccagtcttgcttcctgtatagcatgtggaactgtgagccaattaaacctcctttcattataagttacccagtttcaggttttttttttatagcagtgcaagaatgtacttatacaaccataatcttaatatattgacttaatcaatcctcctgtatgtaatcaatgtctcatcgttgcatcagggccctagcacctcatatgggctgactccatccctgtatgccagtcttccttatcctgcgtaggctcttgactcttcattctgactccctcatgggatgcttttccattctgtatacactttgacttctggtgctagatcatgtcctcattccccgcccttctctgataccaggtggcctcttgcagggatgcccactgtactctgacctgaatctccccagatctgtgtcactgagagggtcactcttctcagtctgatactttataccaggtggcttcttgcaagaatgccgtctctactctatgatctgacttccccctagccgacttaaccctcaggtgggcccccttctcatcattatcaggctctgaatccccacactattccctggcgtggacactctgcttctgagctggatcccccctatttgtggattcctctttcatcctgctggaactctgataccattggactcttgaaactctgtctatgccaagctgtttccccatgagggtacccttctcagcctactcaagctcatttattccactctaggctgagttataggtgccttaaccttcagctggcatgaacacgcaccttcttctgccccacctaatggttttacaactagattgtttggagaaagaagggtttttcttattttttattttattctttttgatagaaattgttctgaagtataatacacatttctttgttttaataattcaatctaaattacacttcacttttgaagtgactcttcttcaataagagtgtcaacaacaatgtagtgatagaaatgctacaagatagcccttgcttgaattctatttactaatttgatgtttgccgggtagctaggtcctcgaaaagtagatgccatggagaaagagtatgtgtatttggcttgctactcaggaacactgtaaacaaattaattttttgctgcataaatacatagctccttagttcaactactgtggattaaaccttcagcagaatgctctccttatgatgaaatgacagagtcaagtctgggctttcaaagctttatactgacctctggccacctcctcattgaaatgtctgtatcctaagaggctgtttctgagtagccagttcagcgacttcttcctctttacctccatcctcaacccttgtccaggctgccttcctatctctcctcgattattccctgcttcatgtcttgtctcagttcactctgttcaccctaaagacaaaataattcttctaaaatgcatatctacttcatgcaattcccctggttcaaaccatttagtgccatcaccttaaatccaaaagccttaccaagtttagaaggctgttaatttctgaaacattttaggttgatactcttcttttccctactttctatgccaaacattctgaaatttctgtagtcacgtagtgactcagatcttctcatctggttaacttctacccagattggtagaagtttcatttaaacattcacttcctttagactaccttccctgagctgtcctagataggttagatgctcctgctttgtactcccagattatcctgtgcttatgatggtgtttagcacaccttgtctacatttaacctatcttgcatgcttcaaaggaaaaaaagtctgtcagtttgaaccaaaacaacacatgaaacctacaaagtgcctgtaaatatttgttgaatgattaattgaattagtatcaaagttaaattcatgccaagaagtcattaaaaagtcagcaaaggatctttaatgattttttttttttaaagcagaatccagtacttgtgatttgggttgcaacaaaataatgagtatcacacttatactcgcaagatgaataactgtaacactggaaaagtatgtgaaacaactattttcaggcattggaccacagataatgcagggctatattctttgagaaaggagaaacataaaaggtgattctgcattcattccagctttctacctgggaacactttgtaaactttggcacatggaattggaatccagtagagagctgggcagaattgggcatcactaggcagatgaaacaaagataggattttggatttgctaaagtgactggaaattgtagagcagagtactgaagtagggttgttgtgcagagatggtgtaccagaaatctgcataaggatcttttgagtctttggccaaatactaagctatccatgtataggatgagatttaatgagggctagtagagaacaactaccaaggtggcaagtggggctgtgagtgttgtattctaaaggtcacacaatgctgtgagacatttgagtcctgatgtgccagaatggagtgaccttgtggaactctccagtgttcacttgagacctcagaaaggcccacctaacaaatactgaaaccaggttttgatagaatcaagctgagttgccagtaaattaactggctgctagaacaaaactcaagactttttaaaggaagcctactcagtcgaagctctcaatgtggcatctacaatgtgcagaatataattttaaaaattaatgggaatatgcaaaagaaaatgtggtctatacctgagaagggaaaagtgagtagaagcagatccagagatgacagattttggaattagcagacaaggatttttttttaaattttttttaaatttttttttttgagatggagtctcactctgtttcccaggctggagtgcagtggcacaatctcggctcactgcaacctgtgcctcccaggttcaggcaattttcctgcctcagcctcccgagtagctggaactacaggtgcccacgaccatgcccggctgattttttatttttttattttttatttttagtagagacggggtttcaccatattagccaacctggtctcgaactcatgaccttgtgatccgcctgcctcggcctcccaaagtgctgggattgcaggcatgagccacgacgcccgaccggatttttttaaagctatgatagataagctcaaggacttaaaggaaaagatggacataatgtgtgggaagacatctaaacagagtaataaaaactataaaaaaagacccaagaagctgaatgcatcacaagcagcataaacataactatgttgtacattacattcaaattgttcaaaactaaatataaaatcttaaaaacaggtggaggaaaaagtaacacatcatgcagagggaaagaataatgagtatgattacttcttaggaaaagcaatctaaacctgaaaacagtgggacagcacctttaaggtgctagggaataaaagttaaactcctatatccagcaaaaatattctttgaaaattggaggtgaaatggaggacattttcagatttaaaacaaaatggtagaggtaatttgttacagacaggcttgcactatagtaattgttaaagaaagtttttgaggctgaaggaaaatgtcgaaaatgattgtaaattagtcctagagtaaaagctgctctaggtccccctttacagaccttaacaacaaaggttcaaaagaatccaactgtttgttgctcaaaaaacttaactgcatgccagaacaaagttcagtactcattaaaggaataaaacaaaatctttcacccaacaatacaaaattcacaatcaaaagttaacaggcatccaaagaagcagggaaataggacccataatcagagaaaaatcaatcatatgaacagatccaaaatgaaagaaataatagaattagtagataagaaccctaaaaccttattataactcttataaatatgctcatagatataaaggaaaacataagcataatgagaaaaatggaaaataattttaaaaacccaaataaacggaataatggtgttttgtatataatggtacaaataggttaaaagcaaaaggattgaaaaaatatactgtgccagctaatgaaaagaaagctgaagtgaccatattaataccagacagaagacatcagaactagggaaaatgaaacattttatgatgagaagaggtcaatttaatgcaaggacacaaaaattctaaatgtaaaacttccaaatatatgaggcagaaacctatggaacagaatggagaaatacacaaatctgcaaggtcaattggagatctcaatacccctctcagtagagaaaagaagcagatgaaatatcagtaagtatatggaaaattttaacaacactgttaaccaaatcaacctgattgacatttataggacattccattgaacgatagcagaatacactttattttcaagtgcatgtggaacattctgtaagatagaccaacattctggactgtaaaacaagtgtcaataaatttataaggagtaaagtcatagataatgtattctgtgactacaccagaatcagtagcagaaaagtatccggaaaatccccaaataattgaaaaattaagcagcatacttctaaatattacatggatcaaaaaaggaatcacaagggaaattagaaaaaatactttaaatgaatcaaaaatatagcatgtaaaaatatgtggggtgcagctagataatgcttagagagatacggtagaaaagaaaccaatcagtataatttgccacattaacagaataaaaaagaaatatcatatgaacaccaatagatacagaaaacgcatttcaatttaatagtctttcgtggtaaaaaccctcagcataactgatggaggaatattaattcctgaataattcagtccaaaatccgttaggtgtggctgagtgaggaaggcatccacaaaaacaagctgtgacagcctggtgggggattggagcccaagtaaggaatctatgagtttatactgatacaagaaaatggggggggaaatggagaaagagcaaagccccttatactagaaccttaactaatataaaaggaataatggaactagaaaattactataggcataccttagatattgcaggttaagttctaatggatggcggtcttgtctacattgaaaatctgttgtttagtgtagctaccttcatcaattacctgagctagatcttctggataacttgctgcagctcctgcatcagcacttgctgcttcacctcgcacttttatgttgtggagacagcttctttctttaagcctcatgaaccaaccattgctagcttccaacttttctttgcagcttctttacttctctcagccttcatagaattgcagagagttggggctttgctctggattaggttttggcctgagggaatgttgtggctggtttaatctatcccaactactaaaactttctccatatcagcagtaaggctgtttcactttcttatcatttgtgtgttcactaaagtagcacttttaattttattcaagaacttttcctttgccctcacaactcagctaactgatgaaagaggcctaactttcaacctgttttggattttgacatgcttttctcaactaagcttaatcatttctagtttttgatttaaaacgagatgtttgactcttctttcgcttaaacacttaggggctgttgtagggttactaattggcctaatttccatattattgtgtctcaggcaatcaggttccaaggagagggagagagacgggaatggcaggtcagtaaagcagtcaggacacacacgttaatggattaagttcacctcttatatgtggatggtttgtggcacacaaacaattacagtagtaacatcaaagatcacttatcacagatcactataacagatacaataataatgaaaaagtttgaaatattgtgagaattaccaaaatgtgacacagagacacaaagtgagcacatgctgttggaaaaatggcaccgatagacttgttagatgcagggttgccacaaacctctgaagagcacaataagatggggtatgcctgtatttgatagctgtcataataataattcattcaggtaagaaacagtagatgctaaaactaatggaagaaagtttgatgaagtatgagatagttgtatggtctctgcatctctccctcaaattattaattaattgtaaagaaaaattttttggtgaagctaggagatacacctttatcaagagattgaagttagtctaggcaacatggtgaaaccacatctctacaaaaactacaaaaattggcggggtgtggtggcatgcacctatagtcccagctacttggggggctgaggtaggaggattgcttatgactcagaggtcgtggatgcagtgagctgtgttcatgccactgcactccagcctggatgacaaagtgagaccctgtctcaaaaaaataaataaagggattgaagttaataccctccgtaatgagataaatggaaatgatgtcctgtctgatgagatgcagtaaaaggaactcatcatcgcttgtataatattcttgccaaagatacataacctgattctagtcgtgaggaaatattacccaaattttgggaggtattctgcaaaataatggtctgtacttttcaaaattatcagtcatgaaagtcaaggaaaatctgagcaactatttcaggctgaaagaaagtaaagagacataaccaccaaatacaaagtgtaattctgaactgaatccttttgctctaaaggacgtactgggacaagtgaattaggctgtagaaaaagaaaaaaacaatcagtataatttgccacagtaatagaataaagaagaaaaatcatatgagcatcaatagatacagaaaaagcttttcaatttaatactcattcatgataaaaactctcagcataactaatggatgaatagttattcattcctgattaattcagtccaaaagccattaggtaggactgagtgaggaaggcatccacagaagtaccctagggatgaatagatgatagaattagtagataagaaccttaaaatcttattataaatcttataactatgttcatagatataaataaaaacataaaaataaaaacatgagaaaaatggaggacaataaccaaaaaaccctaaataaagtaaaaggaataacagtgtttttatatataatagtacagatgggtttaaaacaaaaggatggaaaaaatataccgtgccagctaatgaaaagaatgctgaagtgaccatattaatataagacagaagacatcagaaaaaataggtgattatatgatatttgaatgtctgttcattgttggtcttttaggtcttataagatgatggtcattttctactactttaagggagcatattaaatttttttcaacagactttaaactttattttgtagatcagcttcgggtttatagcaaaattgagcagaaagtacagtttctgtatattccctgcctgtacacacacaacctcctctactatcagcatctaactttttgtagatactttgcctcattcaaataatccagggtaatctttctattttaaagtcaagtgattgacaccccagttccatctgtaatgttaattctcttttgctgtgtaatgtaacattcacaaattcaagggattagaatgtggacatctttggagaaccattattttatatgccacagctgagttaatggtaacttatcacattttggaacaactggcaaaacttgaatgggatttgtggaccatgtggtaataatatatcagtatcagtttcctgatttttgttgttgaaaatgtccttgttttgtaggaaatactggtgttgggacatcagatcagcaacttactctcatgtggtttggggggcaggaaagctatgtatactgtagttctgtgtattactccattttcacactgctgttaaagacatacccaagactgggcaatttacaaaagaaagaggtttaatggacttacagttccacgtggctggggaggcctcacaatcatggtggaaggtgaaagtcatgtctcacatggtggcaaatgagagcttgtgcaggaaaattcccccttataatgaccatcagatctcgtgagacttactatcatgagaacagcacaggaaagacctgcccccgtgattcaattatctcccacctggtttctcccacaacacatggggattcaagatgagatttgagtggagacacagccaaaccatatgattccacccctggcccctcccaaatctcatgtcctcacatttcaaaaccaatcatgccttcccaacagtcccccaaagtcttattttagcattaattcagaagtccacagtccagagtcttacccaagataaggcaagtcccttctgcctatgcgcctgtaaactcaaaagcaagttagttacttcttagatacaatggggatacaggcattgggcaaatacagccattccaaatgggagaaattggccaaaacaaaggggctacaggccccgtgcaagtccgaaattcagtggggcaggtgtatcttaaagctccagaatgatctcctttgactccatgtctcacatccaggtcactctgatgcaagaggtgggcttccatggccttgggcagctccacttctggctttgcagggtatagcctccttcctggctgttttcacaggctggtgttgagtgcctgcagtttttccaggtgcacagtgcaagctgtcagtggatctattattctgggggatctaccagtctggaggacagtggctgtcttctcacagctccactaggcagtcccctccataggaactctgtggggtttcaaccccacatttcccttccatattgccctagcagaggttttccataagggccccacccctgcagcaaacatctgcctgggcatccaggtgtttccatacaccctctgaaatctaggcagaggttcccaaacctcatttcttgacttctgtgcacctgcaggctcaacaccacgtggaagctgccaaggcttcgggcttccaccctttgaagcaacaggccaagctgtaccttggcttcttttagttgtggctgggacacagggcaccaagtccctagaccgcacacagcagagggaccctgggcctggcccacgaaactattttttcttcctaaacctctgggcttgtgatgggaggggctgtcacaaaggtctctgacatgcccctggagacattttccttattgtcttggtaattaacatttggttccttgttacttatgcaaatttctgcagctggcttgaattcctcctcagaaaatgggattttattttctatcacattgtcaagctgcaaattttccaaacttttatgctgtttcccttttaatactgcatccctttaacagcacccaagtcaccgcttgaatgctttactgcttagaaatttctttcaccagataccctaaatcatctctctcaagttcaaaggtccacacattcctagggcaggggcaaaatgctgccagtttctttgctaaaatataacaaaagtcacctttgccccagttcccaacaagttccttatctccatctgagaccacctcaacctggatttcattgtccatatcctcatcagcattttggtcaatgccattcaacaaatctctagggagttccaaactttcccatattttcctctcttctgagccttctaaactgttccatcctctgcctgttacccagttccaaagtcgctttcacattttcggataacttttcagcagcactccactcctggtaccaatttactgtatgagtccgttttcacactgctaataaagatatacctgagactggacaatttacaaaagaaagggtttaatggactacagttccacctggcttgggaggcctcacaatcatggtggaaggtaaggaggcgcaagtcacatcttacatggacagcaacaggcaaagagagcttgtgcggggaaactccttcttataaaaccatcaggtctcgtgagacttactcactgtcacaagaacagcatgggaaagacctgtccccatgattcaattaccttcaactgggtacctcctgcaacatgtggaaattcaagatgagatttgggtggagacaaagacaaaccaaatcattctacctttctataaacttgcaatttttaaggataaaaaacatttttgatgcttacagagataaaattcatttatttgaaaaatctgcatacctgatctcctaatgatgctgaataaaggaggtagatagtatatcatttttgtaaattaattaaacagtattcttctatattttggatagcatgtaaaaatatcactcattttggatgtttttctttttgttccctcattttgggtaagattgcttatgcctttttctcagaaccaacactggtgcttattaaagtaacataagttttttctgtgttttccttcaaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagtaggtgtttatatgatatttgaatttctgttcattttcagtcttttaggtctgtaagttgatggttgttttctactataagtttaggggagcatattaaatttttttcaatagactttagactttatttttttagagcagttttgggtttatagcaaaattgggcagaaagtactgagcttccattttctccctacccccacgcacacacagcctcctccactatgaacatttgattttttgtggatactatttgtcagttaaatagaatgatcccatgaaagacttagggttatgttccattctcttgagtaatttctgaacagttgctgaattgaaagcacataatcactcaaatacaggttgaatgagtaaaaaattctagtgtcatgtttaagaatgggtgagatgagaagcagacaagtaggaaagaatgataaattgttcctttcaaccattatcattctgttagaggcaggtatcattttctaatggatatggatttggggattagactaccttagattcaagtctctgtctttgttgagcaaattacttgactattcagcttcttctcctcccttttatttaactagctaagtaattcctttatttaaccaataatgcacatctactatgtgctggaggcactatactggcttctcaagcaggttttcatcattgccattttaacacactcaagtatctctcataccctgggatttcattccactccagttactacctgtctccttcttctcctttatagccagtctctcaaaagagttgttgatactgtctccatttcttcacctcctcttcactccaattgcagtcccattcgtcctttgaaacacctctgactaaagttactaataactctgtttttaattagggtaatgctgctgctatacaaagtagacctaagagtgagcctctgtttatttcatttgtaaagtaggcattcattttcactgtgtgtatcttagatgttgtcaaggttgagctaatgcatataaaatgcttaacatgtagtaagagttcatgtattagtcttctatgactgctataagaaaccacaaacttagtgctataaacaatacaaatttattatcttacacttatgtagtttagaagtctgaattgggtctcactgggctaaaatcaagatgttagtagggttacgttcctttctggaggctctaagggagaatatgtttccttgttctttccgtcttttagaggccacccatattttttagatcatgccctcttactctgtcttcaaagcaagcaatagtgggcagagttcttctcatatcaaatcactgtgacctcttcttctctcttcttctgccttcctctctcacattaaaggacccatgtgattacatttgccccatccaaataatccaggatagtctattttaaggtcaaatgattaacaccctaattccatctgtaatcttaattctcttttgctgtgcaatgtaacattcacaaattcaagggattaaaatgtggacatcttggaggaccattgttccatgtaccatagctaagtaaatgctagtttattactttttatttgaaaatttctttttctagacctccatgatacaatactgttctctctttctatcacagctacatactacttcattcaccccatcaataaaggttggaagtctcattaggctcagtcctgtatcttctccttttttttgctctgtattttcttcctaggtaatcacattcttatccattgctcaaactactctgtgttcatagatgactcacagatttatgtcatatctccaaaccagacctctgtttccagacccatttacccagacctatttacccatttctgattttttttttttttttttttttttttgagatggagtcttgctctgtctgtcacccaggctggagtgcagtggtgaaatctcagctcactgcaacctccgcctcccgggtttaagcgattctcctgcctcagcctcctgagtagctgggactacaggcgtgcaccaccatgcctggctaatttttgtacttttagtagagatggggtttcaccatgttagccagaatggtcttgatctcttgacctcgtgatccgcccacctcagcctcccaaagtgctgggattacaggcgtgagccaccgcgcccagccccatctctgattttttttaccagttgtttcaaagacaacttaggttcaacgtttccaaaaccaaactcagtcctttctctttgacctccccccttaaaaaacctccaacaacttggtcttatggtatacctcaccttggtgaatgataccactatccgtccagtgacaaaagccaagaacctaagtcttgatatgtctttgccttccatatccagtctattactgagacctatgaatttaatctaaatgtctctggaatctgtttccatctctacaaccaccattctagtcctagtccaagctaccattgtctttccatgacctcatgtgataacctattgatttatctgtgtctattctagccctctgcaaagcattcttaatatattcagtataatattttttttctttcttttttttttttttttttttttttgagacagagtttcgctcttgtttcccaggctggagtgcaatgatgcaatctcagctcactgcaacctcaccgagttcaagtgattctcttgcctcagcctcccaaggagctgggattacaggtgcccaccaccacacctggctaatttttttgtatttttaatagagacagggtttcaccatgttagtctggctggtctcgaactcctgacctcaggtgatccattcacctcggcctcccaaattgctgggattacagacatgagccaccgtgcctggcccagtgtaatattttcaaaatacaaattgaaatgtataaaaaacagtaaagacagatattgcctctgctcaccagagcagtctgttactgaagaaagaaccccattctaagatgtttttaacttacctttgcctgtctgctattgatcatcatgttttgttttattctttgtctcttatttttaagacagttaatgctctatatagtatctctaagtattctaaattattatatttaaaagtccaaatatgtaaaaaataaattctggcttcctttcctgaactactttgttttacatatcttttcatctgtgaaccgttaaatagtttaagagttacactttttagcatgatgaagccatttctaacgggataggtgaagggcctttttttttattcttttaaagaagtacagtatgaattgattaagcaatagaatagatacactgaaggttattttacatatattcttgattttcattttctgtaggcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaaggtttgtaacccttaaatagactttgtagtccattaagttattgaactgtgtttgcaatttggatgcttctttttaacagaaaaaatttaaaaagcagaaaggtcatcagttactacctctcatccagcagcaaccattgggcatattttctttcacttgtctttctgtgcgtatatttatttacctgattgacagtataaatgtaatttttttcacttaccattatgtcataggcattttacaagttattaaaaactcattgtaactgtaatcttagtgacagcataatatcccactgtatgaatatataccataatttactttgccagaaatttgatttttgtttcatatcttcaaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaaggtaacttgattttatttttaattgacaaaaattgtatatctttatggtatacagcatgatgttttgatataagtatacatcgtggactggctaaatcaagctatttaacgttcattacttcaatttttttatggtgagaacacttaaaatctactctcttagcaattatatattgttattaactaaagtcacagtgatgtacagtagttaatttcttgtatactaaataggtagtcctttttttgctatagtagcattctccccttatttgtatatgaaactgaatggcttgtatatttcttgaattatcagggagctaatgttttaggtctatgttagtctttaaattgctgaaagagcttggatttgaaagaaaacaaatttgtagcatcacactaaattagtagtatagatcactaggtgttaaatagcaatatcattacccaaccttacagttctgtattaatatttttaaaaattgacatctttctagagaatttttaaaatttgcagaaagtttttgaagcattcaaaaattgcacagaatttggaattgatccataacatgttcatatatttgcaaatgagtataccttcctcaacccggtgatttataagaaaggcctacaggaaattccattcattcatttaataagcatttattgggtgtcttctttgtaccagggtatactgtgcttgggtacaaagaggactacaactgcacccctgtccttaaggtattcctagtctaaataagagcattcttaaaaatggctatttgctatgttttagatagtagattttttaaagtcattaaaaaatttattgatttggtttttaaaaaactcacctgtaaataccagtatagatctttgaatcatgaagtagaaaatatatatatatttttaatgatggccatgcatagaaatatattgcaagggcttctgggaggaggtagggctgaggtgggccttgaagaatgggaagaaatcaagtcagcaaactagaagacattttatacatgtttgtatttatttatttatttatttttgagatggagtttcacttttgttgcccaggctggagtgcagtggcacgatctcggctcactgcaacctctgcctcccgggttcaagcaattctcccacttagcctccagggtagctgggattacaggcatgagccaccacgcccggctaaataaaaaaaaaaaatagaattttttgtatttttagtagagacggggtttctccatgttggtcaggctggtcgcgaactcccgacctcaagtgatctgcccgcctcggcctcccaaagtgcagggattacaggcgtgagccaccgcacctggaaatgtttgtatttattttgacttttcttttaaaagtaatatgtgcccctagtaaaaaagttataaaaggatattaggtgaaaagtaaaagatagtcttccatttctcatctctaaccttccagagtatattttacctgcaactttttttaactgcatatatacaatacatatgtatatacaaacattcacttgtatgtatgtgcatatttacctttacaagcttaatcagaacaggattatgagaggaagagtctgggttaagtaaatcaatataaaaggagtaaatgaccaatatgaatcggggtcagattatagaaagctaatggatttcagacttagttcaatagacagaagagtggaagactatgttatattttaggatgagttgtcctgataactctgtgtgggtcccgtggtaattaccaagatattagaacagatttcctttttttttcttctttcccccttgccccactccacgttttattttcttgaggagcatcttggttggagagatgacaagcacatgtaatggtaaggcagagaaaaaaacaagacctgtaggagctctgaggataaagaaagagaatttctatctgaggtagccagagaggatttcataggactgaatttggccatgacttttttgatcataaatgagtaagtcattggagacatagagacagtaaaatccaagctgtctttgaacactgtcaaggaaatccatattgttgaaatgaagcatttatattggaaatgatgtcaaggtagggctaaatgataatacctaggatttagtgagtggtgccaagattctaaccaaggctgtagcagaggttgaggtatttatttacttgtttgtgtttaattgtgagtaattctccaagggtttaatattcttctctgtatcctcagagcctagcctagtgcctggcacatagcaggtggttcaataaatgtttattaagtagatgacttccaaagtccttttttttagctctgacatgtgaagattcttcccttcatagaacccaattaaagtttgggtcaaatcaccttcccagaaaagactacgtcctttcaaccatgcactagaatgcatcctttcccatttttactgattccctttatcttcgggaactctcactctctcataaactactttattaccatcccaccatatcctgtcctctttttttggcctacttagatctgttttcctttcttgccttaaatgggaattgctagaggaatatgtttctaactttttttttctgcacacaagttcatggtccttctatacttgatagcccagctgctctattttttttatctcatttcacactggcacctaagctttaaacccttggctgtttttgttattgttgtctgcctgcttgtcctagctccttttactaggtgtgtactctggggatagaacctatgttttgtgctctgagattagaaccaaaacacagatgtcaaagaaggaattcaggggatctggtgactggctggatttaaggaatgaagcaggtagagatgtcatgaaagatccaagcccagatgattatcataatgtttgtgctaccaagaggcagtgaaaacactgatggaaagaaactgagcactttgtagagtatcatagtagagctgttagtattcattgctcttaagtatccatccagttatatttgttagactctactcaaaaggtattttctgagtacagaatttttttcacaagtggtgcaaatggtctcattaattgaatgtttactgcctaacactaacccgagtgctttaaaatgtataatgtaaactccatagtaactgtgaggttgtataggcaggaaaactgaggtacaggtattcacagtggaaataagggttaaaggtaggatttgagtcctctgattcctaagtttatacctttttttctttttaagtcaagtttattaaggtataatatatatatggtaaaatccaccctttttagagtataaattctatgagttaggacatatgcatacagtagcataaccatcactaaaatgaagatgtagaatatttcagtcactccaaaaagttctctcaaagtccttgcagtcagtcctctcccctgctcccatccatagtaaccactaatttgttttctgtcattatagttttgccttttccagagagtggcacatatatagaatcatacagtatgcagacttttgtgtctgggatttatctatgttgctgcatgtgtgagtaattcattccttttttttttttttttttttgagacggagtttcactcttattgcccaggctggagtgcaatggcatgatctcggctcactgcaacctccgtctcccaggttcaagcaattctcctacctcagcctcccaagtagctgggattacaggcatgtgccaccatacccagctaattttttttgtatttttagtagagacggggtttctccatgttggtcaggctggtctcgaactcccaacctcagatgatctgcccacctcggcctcccaaagtgctgggattacaggtgtgagccactgtgcccggcaattcattcctttttattgtggaggagcattccttccattgtatgcatgtattataatttttttcctcatccattctgtggctgatggacattaagttgtttttggttgaactagtttacagtccctccaacagtgtaaaagtgttcctctttctccacatcctctccagcacctgttgtttcctgatttttattgatcgccattctaactggtgtgagatgatatctcattgtggttttgatttgcatttctctgatggccagtgatgatgagcattttttcatgtgtctgttgtctgcataaatctcttcttttgagaagtgtctgttcatatccttcacccactttttgatggggttgtttgtttttttcttgtaaatttgtttgagttctttgtagattctggatattagccctttgtcagatgagttgattgcaaaaatgttctcccattctgtaggttgcttgttcactctgatggtagtttcttttgctgtgcagaagctctttagtttaattagaacccatttgtcagtgtggcgattcctcaaggatctagaaatagaaataccatttgacccagccatcccattactgggtatatacccaaaggattataaatcatgctgctataaagacacatgcacatgtatgtttattgcagcactactcacaatagcaaagacttagaaccaacccaaatgtccaatgatgatagactggattaagaaaatatggcacatatacaccatggaatactatgcagccataaaaaatgatgagttcatgtcctttgtagggacatggatgaagctggaaaccatcattctcagcaaactaccgcaagaacaaaaaaccaaacaccgcatgttctcactcataggtgggaattgaacaatgagaacacttggacagacacaggaaggggaacatcacacactgggtcctgttgtggggtggggggagggaggagggatagcattaggagatacacctaatgtaaatgacgagttaatgggtgcagcacaccaacatggcacatgtatacatatgtaacaaacctgcatgttgtgcacatgtaccctcgaacttaaagtataataaaaagaaataagttgttttcggctttgggttgttacagataaaactgctataaacttctgtatacaggtctttggataactttaggactcgggttgctaggtcgtgtggtaaatatatgtttaaccttataagttaccagatggctgtaccatctggtaccacttcatagtcctaccaacaatataccaacaatttatgggaatgtaattgctctgcattctcatccccacttagtactgtcagtctttttcattttagccataacagtaggggtgtggtagtgtctcattgtgacattgtgaggttgtatttctttatatttttaatttgtgttttcctagttgatcagtcaattgattattgattttgagcatcttttcatgtatttatttgccacctgaatatcttcgttagtaaaatataaaagtcttttgcctatttttcaatgttatttatttattggtcattttattattgagctgtgagagttcttttttttttttttttttttcttgttttttgagacagggtctcgctgtcttacccaggccagagtgcagtggtgtgatcttggctcactgcaacctctgactcccaggctcaagtgatccttccacctcagtctcccacgtagctgggactacaggcacacactcaccacaccggtgagacttgtagaggcaaggtctcaccaggttacccaggctggtctcaaacttctgggctcaagcaatcagcctgcctcagtctcccaaagtgctgggattacaggtgtgagctacagtgccaggcagagagttctaaatatgttctggatacaagccctttatcagatattggttttgcagatatttcttaactgcttttcagaggacaggagttttaaattttgatcaggtacagtttataaacttttttctcttatggtttatactttttgtttattatttaggaagtctttgacccagtgtcacaaaaatattcttcagtgttttcctctaaaagttttatagtttgagttcttacaattaagtatatgcttcatttcagaatcttaatatgatatgaggtaaaagttgaggtttactttcttacatacaaatgtccacttcttctagcacccagagcctagtcattatgataccctgccttctaatcttattgttatcttgtctcccaatcttaactatacaattttgtacaagtcagttaagtcctttgaatttcctgcttagtatatacttttgtgaggattagagagaatttatagcagcacctagtacagtgtctggaacatagcagacattcaatcagtgatacctgtgactgttgctcttggtaaaattatttttttcaaatctctctttcgtttagctaacattgaacacctattgcatgttctggggatacattagggaacaaagtaaacaaagtttctgtttttaggttcatttgtatatgaacgtttacgttcatatacaaatcacaagctatactattagtataattttaataaattatgttaaagtcgaggatgcattttggtgcaattatgaaagcttgcaattgctgtctaagcattccaataacttcatatgttagtttaaaattaggttctgctgggcatggtggtacatacttatagtctcagctacttggaggctgaggtgggaggaacacttgagcccaggagttcaagttgtattgcactgttattgcacctgtgaatagccactccagccagggcaacatagcaagaccttgtctctgcatttgaaataataataataaaagtaggttgtaaaaatgtcttagaagaagagttggtcagttttggaatcatagaggcaaacactagaagaatatccccagcatcatccaataagagaatgccccgaaccagatcccagtattcctgggagatgaggcaaccagctgtctctggaagcgagcctcagagcaggccactgagctcccttgttgtactttacttgctcagagtcctctgtggttgagcaagctttggattaaagtatactcttcatgtaaatttgcctataggctcagaatgcattggtaactcaccatgaatttctagccttctcagtagtcctgacttaaaaaaatacattaaatagttacctttttaaggattaagtaactctaaatgcccaatgaatgaataatgacttttgtggcaggtgttgaggacaggacatggtgtttggagttagaagtggaatttaattcctgcttctctctactagctgtgaggacttgggccaagttacttaatgtctctgaacttcagtttctctaggcctgctctacagtgttattgttagccttaaatgagatcacttttactaaatgcctggacctggagtatcttacttgtcttcatctatcagccatgtaagctatagtgagttttatttatgtaatgtttctttattttcagaatcgtctaaaagaaattgaacataatctctctaaaataatgaaacttgacaatgaaattaaagccttggatagccgaaagaagcaaatggagaaagataatagtgaactggaagagaaaatggaaaaggtttgtggtggtagaattttgttctgcttcaaaattttgggattattgtaatgaactttatttgaatccattttgccatccacattggaaaaaaacaaatacagatcttgttacttctatgtatatgttaaaatgaaggatattgaataaggtttggtttatatttgatacctcaaagtgatcatattttcttatgtttgtacattaaagctttttattttggtgttacacaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtaggacaaaatgtttatttggtcgtttttcctactatgatgttatacattttctgtatgaatgaagaatctccaaggacttatgctgagtgaaaagccaatcttaaaaggctatacacagtatgtttccatttatataacatttttataatgtcaaaattttagaaatagtggagaaattagtggttgccagggatactgggtaagagaaaggacaggagggagctaggtatggttatgattagaacaaaaagagagtccttgtagtattggaactgttcagtatcttgactgccatagtggatatatgaaccgacacaggtgataaaattatatagaacttaatatacacacatccacatgctcaggggtacaaataaaattggggaaatttgaataagattgatgaattatatcaatatcagtattctggttgtgatattttactgcagttttgcaaaatgttatcattgggagaaactgggcaaaatgtacaagagacacactgcattattttttataactcgtgaatctgcagctatctcaactttttaagcaccagttgaaaaaaaaattatgagattttttttttaaaaggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatggcaagtattttgaaatacagtatttgttattttgtttgcatcatattctctacttgaattgttttaatttttggttggactccattttggcatatttttctattagtgttaggataaaatctgctacaaggcagaaaaacctttattgaagcaaatgttcttaagtgtataaagataaaaatatgaagaaaatgtaaacctacattttttatttggttttaagtaaaaatttttaaaaactaattgcagagaaaacatttgctcacagttaatgattatctctgggtaatggttttgattgtttttaaaatacagtcttgaaccacatgttttggtcagtgatagaccacatatttgacattggtcccataaaattataatactgtattttactgtatgttttctgtgtttagatatgtttagatacataaatacttatcatcatgttacagttgccaaagtattcagtacagtaatatgctgtataggtttgtagcccataaacaataggctataccatatagtctatgtgtgtattaaactataccatgtaggcttatgtaaatacattctgatgttcacacaatgataaaattgcctaatgatgcatttcttggaatatatccctgctgagcaacacacgactgtacttttttgtattttcttcagtgtacatatattccttttgcaattaaaaaacttaaattgtttagtaaattattaatgctcattctttacatatgcatttagaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgtaagatattgtttgaataatctaataattttaagatataatacttttagaagtattttgtctatttttgatcctaagattatagcattttaataaaaacatcaactttgtcttattctcatgtaaaatgaattcatctgaatatcttgatcttctgactctttggttctacaacccgatagcctgaaaattagaatcacatagggagctttttaaagatactgtactcagaccttaaagcttcagaccttccaaatcaaaatctctgagaatggggcatagaaatgtacattcaaaacacaacaaaactggctaattcttatgagcaccttgattaagaacacttaccaggccgggtgcggtgtctcacacctgtaatcccagcactttgggaagccaaggcaggcagataacgtgaggtcaggagttcaagacctgtccagccaacatggtgaaaccccgtctctactaaaaatacaaaaattagctgggcgtggtggcgtgtgcctgtaatcccagctacttgggaggccagggcaggagaatcgcttgaacctgggaggcagaggttgcagtgagccaagattgcgccactgctctccagcctgggtgacagagtgggactccatctcaaaaaaaagaaaaagaacacttgccaaagttttaaaaaagcaagtatttttcctctaggtcacacacgttgtaattctagatgatttttgctgtattattactttttctgtgttaaaaactttcttagccaatcttttcaggtatttccatattttctttcttgcttctagtctgtcctccttcttcacatctccattaccaaagtaagcattctaaagcatggcaaacttcttaaagcccatcttgataatttatgtaaacatttatttttgctccataactcaccattgtagcatacatttttgtcagtttagcacttcatcagtgttgtcttgttggggtggggagatacttggtcagggaccacatcacactatttttatagtttctacataccaggcaatatagtgaattacatggggacataataaatatttaattgttgactgaggactcactaatctgtgtacttagacacatgtctcctaattttacagtaattctcacatttctttcctgtttgacccttctaggtttatttactaattctctaccattataacatagtaaggtcactttaataagatataccttagagcatatatagtgccttatgtttttttctcttgttggatgcaaacagtaatatttggaacattctgaggagtagttaatttctaatacactttgtcattattttaattcttgcacaaaatatataacacctttgcatttgtatgaattattgactaggaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagtatgatttttctttttgttctaattatactgtctggtacttaaaatagcctaccttgcactcataagtcatagactataaggtattaagttggtattgactatattttagaggctaagtgagcttagtactctatataatagactttcaagcttaaaagttattgtttaattacaaaaagttaatacagaaatgtatatatatgtatatacacacatgcacattactgttaacttttaacatacacaaattttaaaattttatattgttcgacttggtactccactcttaaggcttagaaagaccatccccacttgaagactttaagaactttaagaaattttatattttattttcatatttttatagttttaagcttagaactttagtcagtctagaatttatttttgttcttgatataatgtggagatatagactttatttttaaaagattttttttttacctataggctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaagtaagttgcaacatttggagatgtaatagaaatctcttatttcatgcttacctgtttaattgttttaaaataatttattgtcatgaaatggtatgttatattgataaactttagttcttacatacaaggagacttcagaaagttcatggaaaaatggaattaaaagataaaaattttaaataaactgtatttctcaacataagctccatcaagttcaagactcttctgagcagtgataccagcaatttagttcagtcctaaagaactgagggtcctgggaatttaaccatgtcagtgtagtcttttttacattgctagcataaaaatgggtgccctttaaagatttttttaagattaagaaactagaagacaggaggagccaaatcaggactgtaaggtggatgcctaatgatttcccatcgaaactcttgcaaatggcccttgtttgatgagaggaatgagcaggaacattgttgtggtggaaaaggactctctggtgaagctttcctgggcatttttctgctaatgctttggctagctttctcagaacactctcataataagcagttgttacctttcttcggccctccagaaagtcagcaagcaaaatgccttgagcatccccaacaactgttgccatgacctttgctcttatctggtctgcttttgctttgactggaccacttccaccacttgttagccattgctttcattgtgctttgtcttcaggattgtactggtaaagccacattccatcacctcctgttacaattctttgaagaaatgctttaggaacttgatcccacttattgaggaagttctgctgttgtctgcagctgatctggaagcagtgattttgggcatccatcaagtagaacgtttactcaactttaatttttcagtcagaattgtgtaacctgaatcaattgaggtgtctatggtgttggctattgtttctgctgttaatcattgatcttcttcagttagggcatgaagaagatgattttttttcctcacaaattgatgtgaacagtctgtcactgtgggcttcatctttaatatcgtctcatcccttcttaaactgagttatccatttgtaaactgctgatttgtttggggcattgatctcataaacttgttgtaaagtatcaatgatttcaccattcttccacccacacttcaccataaatttgatacttgttcttgcttcagtttaattggggctcttttcaaactgatgtcttaaccttgttagtgccttaaactagatcctattcagacatgttataacaagttagtatgagtttgtttcagtgcaaaacattttgaacttcatgcatagttttttttataatacacattttccatgaacattttgaagacccctcatattttgcaaattaagtaaaatggtaacggatagtaatttaggcctcttgtcccttgaaaatttgtagacctatgaagattaaaatttaaaaattctattttcatttctgtgagtaatccattataaaaagtgatcatgtttctcagatgttaccttggatagtggttggataagcgggtcaaaaattccacacagatttttgaggaaagtagaaggacttggctttggtggtgtttaatctgtgtttcttgtggaagtatctgtgagggaatacaatattggagtttgaaattcaggagattggaagttgttgctatgtaagggatactcaaagtcattagtatgtcaccttgagagagttatgcaaagggaaggagttacaattagattcctgggaagcacaaacatttaaaatgttagcaggcaaaggaaaaggagcaagtgaaggaaactgggatgtgcccagggaaccagggtgagagccagatagctgtggtgtctaggtgccttgggaaaatagtcttcaaggagaaggtcaacagtgtttggtgctacgtagaggtagagtaagatgaagactgtacttggcacttaggtcactggtgatcttgatgagaagtgctcaagggagtctaggataatgaaaatatcatcatattagttacttttttccaaatgtttactgtgactcaggatgggtagtcatgatgaagaagcatgtgtgcagtcacacacatttatctgaaacaaatttctcaaagtagtacatatacatacagcctactccaatatattaccgtctattctgtttcatttttaaaaaatatgctgaatacattaaattgattacatggtagctaatgcatctaaacctgcaaattgaaaaaccatgttatgtgtgagtattgaggttggctaggatgatgtttaagaattaaagtggggataaattgtactagtaagcaaaatctttgatgaatgagagggaatgactgatctggacgcaagtggatgacagcaacaaggagggggaggatacaaaagaaacagtatttacaggagagtaaggaagtagtatttgtgaaaggactaaagggaattacggggatgttctcttgtcttctttctgtccaatagtcctagcaagcatcttgctgaggcttaacctgggatcaaagaccatgaacccccagaaaccaggcagaattctgtgtacatttttctgggagcaggcccatgagtaggactggcaggtgagtcagtgtcctagggggagagttaaggcagaagtggactagtccctcaacttctgaaaaaaattatttggtcataccaaactcttgtcatgatttgttggcagaatttgtcttgtttttgcctactcaaattttcaaactaatttctcctattttaaaatgaaaatccatatttgctcttattttagcaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgaggtaagttgtctactttatattatcaggatactttgacacctttgaattttcattcacaggtaactgttaaggatggggaatttaaaaacctggttatggagcctaatggcttggatttcagtcctggctctacaacttactcactgtgtgactttaggcaagttactgaaaccttcctgtgtttcattgtctataaaatgaggacacaactaccacctgtggtactgaggtgtgaatgagattgtaattataaagcccttagaacagtgcctggcacatagaaagctctcagtaggcattttgttatacttataatgtgttaccaaaaaatatttatacaaatctgaatgtatcatgctctttggaagcgaatatcggaattttaaatatcagaatttttatttcttttataatatatttataaagcaagaataatcatatatttatagaaaaagatacaaccgtattcagaatactgtattttatgtttttttctcattggtgatataatttattttcttaaaatagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggtaagaatgggatttaccttcactgtacatgtagcagcacattgtaaaaggtacccatctcatgcctgggcagatggtagttactcagtaaggactctgagctggtatgccctgtcttatatcacttctatgataagaagattcaattattttgtttaaagataagcttgtttcctgtctttttttctttttcttttttttttctgagacagagtctctctctgtcacctaagctggagtgcagtggcatgatcttggctcattgcaacctccacctcccagaagcgattcccatgcctcagcctcttcagtagctgggattacaggcatgtaccaccacgcccagctaatttttgtaatttttagtagagatggagtttcaccatgttggccaggctaatctcgagctcctggcctcaaagtgattggcccacctcggcctcccaaagtgctgggatcacaggtgtgagcaccgtgcatagccagtaagcttatttcttaaactatgaggtagacacagtctttacgttcttttgtatgtgtgtttaattcccaagacttagcttgtgggcatagattttcacagatttaggactgtctgttgacatgccactttctgaacccagcaaaagaatttaagtattgaaaagttctcccagaagacagattttaaactatgtttttaatgtcttttccacttgctaaaagaatgaatcatagatgattttcggttgtttatattttccatcacttatacaagaaattcgtgttatgttctgtttacaaacaaaaatcaagtcaggaaatatgtgatgattgccttagtgtctcccagaacatagagaacaaggctagtgccagagacctaagacatgaccctccaggagctaatggtctgattaagaagacaagctctcagaattcaacatttagaaagctaggcttaataaagtgcttaaaaaatgattcaaacagatgtgttaggtaagaagggaggagccaatggatacagaatgagaagaatattttgagaatgaggcaggaagaggaatataagacctggagaagttcattcagctcaactgagaggagacggaagtcagaacacggtgcaaagggaagaggagtatgacctatgctgcagtagaaatgttatctggagtttggggaattatttatagggattgagtcctgtatgttggggagatagggctacattatattcaggtctagttgtaactctgataggtgatgaggagccaacctaagggagttagtgaaagatgtattttaggaaaattaatctaatattaatatattgactgaaacaggctgagaaaagctcaggaagcagaaaaaccaggagagtgaaagtgattgtcctggaaaaccaaggaggagtttcaggaaaaggagaaagaaaggcctaagaagatgtggtttgtggcagccaacttctaagatggtccctagtaatctcggcctcttggtatttatactcttgtatagtcccatctcatgctgttgcatgattggtctatataactgataaaacaggcagaagtgatagcatggcctttccaacattaggttatttaaggtactatggcttcttctgttctcgcaatgtgcttgtacccttgtgtgaactcgctcactctcccccactcctcccctctctcactcactctgtctccctctgtctcttgtctgagggaagctagctgccatgttgcaagcagccctctggagaggcccatatgccaaggacctgaggcctttgagcaagtgagtttggaagcagactttgtagcagtcaagccttaagatgactgcagtcctggctgacagcttgattgcgacttcatgcgagaccctgagtcagaagcgtatctcttgatcctcatatctctgagaaataataagtgctgttattttaagctgctaagttttgggatactttgttatgcaacaatagataaccaacacaagcatcaagggtgaaaaccagattattggggccacagagatgaggagacagaggcagtagtttgagaataaaaaggaaggagaggaataaggtagtatcttgaaaagaaaaagatcaaatggataaaatttgaaattggtagaaagtacacgtagtagaaatatgagcttagttctgtgttagactgttatacaataaatggcagaaattaacatcgtattatattttaggaccctagctatcacggctccttttttttttttttgagacagagttttgctttgtcgcccaggctggagtacagtggcgcagtcttggctcactgcaatctccacctccccggttcaagcaattcccctgcctcagcctcccaagtagctgggattacaggcgcacgtcaccaggctcggctaattttttttgtatttttagtagagagagggtttcaccatgttggccagactggtttcaaactcctcacctcaggcaatcgcctgcctcagcctcccaaagtgctgggattacaggcgtgagccaccgtgctgggccacagtttcccctctaagagtaaggtgcatgtcttactcgttgtatctccacagttccttgtatattgcaactttgataactatttgctaaatgaatgagaactgtaatgtctgttccaattatttattgctatgtaacaaacctcaaatctgtctcacaataatttttcatggttctgtggtatgactgggctcagctaggtggctttcacttggggtcttacggttgcagtcagatgttggctgcagtcgtctcaaagcataaccgagctggatgttcttgatggctcacatgactgacagtgatgctcactattgtctgggagctcagctggggctgtcaaaataggacatcttcacatggcctctgcatgcgtcttgggcttttggcagcacagtgactgggttactaaacagagtatcctaagggtaagtattccatgaacaggaagtagaagctgcaagtcctttaaggcctagaccaagaaactggcatggtgacacttctttttctgttggttagagtggtcacagaaactcccaagattcagtgagggaggatactgtatctcttgatgggaagagtgtcgaagtacttgtggctgacttgaatctgcctaaccctatatctgcagtagcatctgtgtgccattctggttacctagagactaggcaaccacacatttgtatattctatattgtaactttgataactatttgctgaatgaatgagaactgtagtgtctattcccgttattgattgcttgtaacaaaccccctcaaaactgtctcgcagtgattagtttttcatggtttcatgggatgactgggctcagctaggttagccaggtaaatggctggttaccacacattttaagagaacctgaagctagaaaaggcctacaggaagcactgaaaatggaccaagatgctggcagggctgctaagtgaggacacatgtgtgaggaaaccatttttataaagaaaccaaaacttgaagacccgaagagcagggaaatgatgaacccctgtttgtttagcaagctctaacagaatgtcagtgggccattctggaaaactggagaaggatgagtttgggacaaatgagagaggaagtcttcttcccaatagtaggaaataacattataaaacactttttttaagtttaaataaatccacaaatgaaaggtcaataatgaattaagaggacttgattgattgatagatagggtcttgctcctgtcacccaggctggagtgtagtggtgtgattgattatagctcatcgaagcctcgaactcctaagctcaagcaatcctcctacctcagcctcccaaagtgctaggattacaggcataagccaccatgcccaaccaagaggactttttttttttttaaatatgggaaagcaattgcctaagagtgcagtcaggttgacttcaaattccaactctgctgggtgaccttagggatgttacttaacccatttgggccttcgtatcccccacgtaaagtgaggggattgatttacatgatcattaagcttccttccacctctggttaggatactactttcaaatatcccgtggggtcactttcagagacattgtggaggtctatttatgatagtcacttaggtggaaggttattggtgaagaggggtaaagtaacaagattaaatttatctgtgcaccatttgctttttcacctttagaatatgcccttgatgccaccactatcatgagaactgtctattcatgcaaccaatataggcagtctactggagtgcaggtaatacagcagtaaacaaaatggacaaagtccctgccctcatggagtttatatcccagtggggaggagatggatgacaaataagtaaatatataatatgccaggggatgatcaggggcattgagaaaactacagcaagataagggaatagggactagctgaagggtggtaggaggggacttgatgaaggtggcagtggagtggaaacttgagagaagtgagggagtcagccatgcagttgtccataagaagaatattctaggcagtgcaaaatctctgagacatatttgacctgaaggccaaagggaaaagttgtggaagatgagctcagagaggtagtggggagccatatcttgcttatcttctttgcgggaaatattttcatttaaagcctcaaattcgccagtatctaatataaacctaacatcatgactgagatctcagctgaaaatgtacctgtttatcattttgtctagtactgactcagattcatttattatagcacctcatttaaatgcaaactcaattggtatttctcccacaggtttttttcagtaccatatctgtgtgagcctttttacacacaatccccttagaaaaggaatgttgtctaaaaataggtgaattgagtttctgaaaaaacagaaatccaaagagtaaatttcaaatgtctgtctataaaaaatgataggcaggcaaggtaatggatatgttaaattacctttatttaatcattgtgcattgtgtacatatatcagaacatcacattgtaccccataaatgtttgcaattatgatttatctattgaaaataattttaaaaaaccttgtgaatcgtgagaaaaattaactcttgaaaataaaaaataaaatgtcataaatttaaaaaaaagaaaaacaaacccagagagtgcagtggcacaatctcagctcactgcaacctccacctcccgggtttaagcagttctcttgcctcagcttcccaagtagctgggattacaggcgcccttcaccacgcccaactgattttttgtatttttagtagagatggggtttcaccatgttggccaggctggtcttgaactcctgacctcaggtgattcaccagcctcagcctcccaaagtgctcatattacaggcgtgagccgtcacacccggccagaaaacttcttttaacatcttatgtaatcatcaaaaaagaaggcaccaaaacctagaccatattgatgaaagattttgtgtgtgtgtaggaaaatgtaaaaatagggttaaaattgtatgtatacctacagttcttcacagagatgtccccagtttaataaatgcttggccatcattattaggctgtcatagctgtgtcactttttagatattgggcacataatttaaggccaactactaatctgtgacaacagtgttcaagaggaaacattggcatggaattactcataacctgcataccttcatatttattatgtggaatacaaatacctcctatttctgtggtataaaaaaaaactgtaggtctgacatgcacacatatgtttattgcggcactgttcacgatagcaaagacttggaaccaacccaaatgaccatcaatgatagactagataaagaaaatgtggcacatatacaccatggagtaactatgcagccatataaaaggatgagttcatgtcccttgcagggacatggatgaagctggaaaccatcattctcagcaaactaacacaggagcagaaaaccaaacattgcatgttctcactcataaatgggagttgaacaatgagagcacatggacacagggaggggaacatcacacacactggggcctgtctgctggtggggggctaggggagggatagcattaggagaaatacctaatgtagatgatgggttcatgggtgcagcaaaccaccatggcacgtgtatacctatgtaacaaacccacacgttctgcacgtgtatcccagaacttaaagcataaaaataaataaataattaaaaaattttaaaaaactataggtctgttgccacaggtcaggttggcatttcttggtcatagtttgcatttttaaaaaatcattaagtaatagccacttgagtttctggttattctttaagtttataataagactcctattagagaccagtttaatttattctactgctttgtcatactaattcaatataattttaaataagaatttggaatatttctgaagtaaattttttttaaaagattaaatacatattattgtttcagaggcatcagcaaaaatagttgtcagtacctgccatggaggtggtaattcattagctacagtagtgagtaccagtaaaatgggttgacattttgtaccttaaacccatgtagcatttcacttagtggctggcttccttcctttttttcctgtaatttaaaaaatttttattttgaaataatgttaggattacagaaaaattataaaaataatacaaattattcatatatatccctcatccagctcctcctgatgttaacaatttatgtactctgttataatacagttatcaaaaccaggattaacattgatataatgctactaactaaattacagaccatatcgaatttagcagtttttccatcaatgccttttctgtttcagggttccatgcaggatcccacgtagcatctagttgttatttctccttaggctcctgcagtctgtaacaatctgtctttatctttcatgaccttaacacttttggtcaatatgaccagttcattagtagaatatttctcagtttgacaaacaccacagtaataattattgcaagcaagatctgtcagtggatactaaaatcagtaggcagaaagttgagaagcaagatatttacatagtctcaacatttctctcctaagatacttgttaattacaaagactaaaacagtaactttacagtggagaaacctggccaacaccatctaagccaagtgaataaggattaacatcatcagtaataagacatattgatatcatgattccatatccactgatatgataccctgaaaagaacacaatgtcacttctgtggtattcttcctaaaaatacataacctcagtctaactgtgagaaacatcagatactttatttttaattgtgttttctatttaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccaggtaagtttattgtagtttaaggcagaataaaacttgttccatggtggcttgaatttgaagtgtgagagttaaaaatagtagctagtattcaggtacaggttgtgtttagaattccccatcctgaatttcagataccctcagggagaaactgcttagtttacatccctgggtttaaactttttaattcataaatttaaaaattaagacagttctgtttgtttttcatctttagtcagcttccttttgtttacatcatttgaattgctgataattaatttcacttttatcctattaaactttgctaaaattgtatctagaaatggtttataagtttagatttaaaaaataaatgataagagcaattaatttttaaagattttgaataatgcagtaagtttattaaaggaaatcattttgttatattcttaagatggaacttaaagatgttgaaagaaaaattgcacaacaagcagctaagctacaaggaatagacttagatcgaactgtccaacaagtcaaccaggagaaacaagagaaacagcacaagttagacacaggtaatacagtctgtgtccttctgtactcatagagactttgacattgcgagcacatgccttttacagtcaattttatatctgttacatggacaacgaagttccttcctgtccacatatatttgctctttttttctgaaaagcatcacttctctttgttctcttactttgcacaacagattttgaacagtaggagagtatgaaataagctgtattctcttttccttttttttttttttaagatagagtttcacttttgtcgcccaggctggagtgcaatggtgcaatcttggctcactgcaacctccgcctcccgggttcaagtgattctcctgcctcaccctcctgagtagctggggttacaggcacacatcactatgcccagctaatttttgtattttttcgtagagatggggtttcactgtgtttgtcaggctgatctcgaactcctgacctcaggtgatccacctgcctcagtctcccaaagtgctgggattacaagtgtgagccagtgcgcctggccatgagctgtattctttctcattcatacctgccctgtaagctttccctgtgagtggccagcagggaacatcaagctgatttgagaactagcagggttctcattgtatttttgttgcagtgggtggggcccacagaaatagcatttgtggattccatagaccgataaaaatgggaagaatgatacaaatagtattttctatgcccttacattaattactgtgataatatgtttttgtgtagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggtaagaatatccatacatgttttttgtaaaattattttaattatttatttttatttttattttttgagacagtctcgttctgtcacccaggctggagtgcagtagcacgatctcggctcactgcaacctccatctcctgggttcaagtgattctcttgcctcagcctctggagtagctgggattacaggcgtgcaccaccatgcctggctaatttttgttcttttagtagagacgggttttcgccattggacaagctggtttcaaactcctgaactaaggtgatccgcctaccttggcctcccaaagtgctgggattacaggcgtgagccagcatgccccgccccattcttctcttttagagacagagtcttcatcagtcttccaagctggaatgcagtggtacagtcacagctcactcactgcagcctcgacctcctgagctcaagcaatcctcctgcctcagcctctcaagtagatgggactacaggcacacaccaccacgcctggctaatttttaaaatttttctagagacagggtctcactatgttgttcaggctggtctcaaactcatggcctcaagcaatgcagccttggcctcccaaaattacaggcttacatcacctcacccagcccatgtttctttaatatgaaatgctctttattagtgtaatggccagaactctcagcacctcatcgcacttattctaaaattgaccacataattggaagtaaaacactctcagcaaatgcaaaagaacagaaatcataacaaacagtctctcagaccacagtgcaatcaaattagaactcaggattaagaaactcactcaaaaccgcacaactacaaggaaactgaacaacctgctcccgaatgactaccggttaaataacgaaatgaaggcagaaataaagatgttctttgaaaccagtgagaacaaagatacaatgtaccagaatctctgagacacatttaaagcactgtgtagagggaaatttatagcactaaatgcccacaagagaaagcaggaaataactgaattcaacaccttaacatcaaaattaaaagaactagagaaacaagagcaaacaaattcaaaagccagcagaagacaagaaataactaagattagagcagaactgaaggagatacacgaaaaacccttcaaaaaaatcaatgaatccaggaactggttttttaaaaagatcaacaaaatagaccactagcaagactaatacagaagaaaagagagaagaatcaaatagatgcaataaaaaatgataaaggggatatcaccacccatcccacagaaatacaaactaccatcagagaatactataaacacctctacgcaaataaactagaaaataataaatggataaattcgtggatacatacaccctcccaagtctaatccaggaagaagtcaaatccccaaatggaccaacaacaagttctgaaattgaggcagtaattaatagcctgccaaccaaaagaagtccaggaccagacagattcacagccgaattctaccagaggtacaaagaggagctggtaccattccttctgaaactattcctaacaatagaaaaagagggaatcctccctaactcattttataaggccagcatcatcctgataccaaaacctagcagagacacaacaaaaaaagaaaatttcaggccaatatccctgatgaacatcgatgcaaaaatcctcaataaaatactggcaaaccgaatccagcagcacgtcaaaaagcttatccaccacgatcaagtcggctttattcctgggatgcaaggctggttcaacatatgcaaatcaataaatgtaatccatcacatgaacagaaccaaagacaaaaaccacatgattatcccaatagatggagaaaaggccttcgataaaattcaacaccgcttcatgctaaaagctctcaataaactaggtatcgatggaatgtatttcaaaataatacgagctatttatgacagacccacagccaatatcatactgaatgggcaaaaactggaagcattccctttgaaaaccagctattatgaggatcaaatgaaaatggtataataattatttgtgtggttcctaagtgatagaacttgtactagtaagtaaagatttctggaagaaggagtttgccataataaggaagaactggctgcctggttaagtagtaaatgttattggaggtggtcaggtggtggttggttaattctgtataaggattcctgcttgtacaggaggtttgtcttatctgcagatcctttatctatggcggtcactctcagtcatagcactctttccatttgattccggatgtggtttcagaacccttaccaatacagtgagcaggcactcagttgccactggaatgcatttgacatcccttatatagattaatcacatctaagactcaaccagttataaacagttataaacaatcttacctaggtttatataattatgcgtactcattcaataagcactaagtatattactgaataattactataaatttttattaaattttagattacaaaatatcagaggttcagaatataatataaaatagtacttgcatctgtataattttttactatttataaagcactttgacattgaaccattcagtgcctcagcaaccctatttagatgatgaaatctctttatagaaaaattgagatttacaaatgtctcatgagtgcctaagtttatgcagctaataggaagcagagttgattttctgatagatcttttgacactgagggcatttgacttcctaacacaccataccacttcccagtatgataaaatagacctatattgaagtaattactaaataattgtatctacctctatagattcactcagtacttcagaatcttaaagtgcttgaggacctctgttttgaactgtggttatcatataactacgttgtagatttagtgttacaaggctaaataatggggacttctatttagtaaaatagtttattacttgaaagccccgttccttccaaaatagttgtggagacaccaacattagtttaacagtatgcttttattaccatgaaatatctgcgtagccttagcaggctaagcttaaggacagaagtgtttttaccatcatgttttcatctgaaaaagaaaagtctggactgaatgagctttcctattctttgatcatgcagcagtgacgggcacctataaaatcatgaaaactcatgcttgaagccacacgctaatataattgggagcacatggcctagattaagaatcaaattagtggttgatgcagtatagcatgcgtagtggttaagagcgtgaactctggagctggactgggttaaaatcttggctgcttcatttactggctgttgtgaccctggacaaatcattctctgtgtctgtttgctcgtttgaaatataggactgaaaatgatggtactgtcctcatagggtcattgaaaggagcaaatgagttgacttttagagcctggcacatagaaagtgcttttattaagactgtgaagtctgacccctaaagtaagataatggaatattatataatactttatcttttttatatttttaggatgctaaagagcaggtaagccctttggaaacaacattggaaaagttccagcaagaaaaagaagaattaatcaacaaaaaaaatacaagcaacaaaatagcacaggataaagtaagatttcatttatatatttacttatcaaatatctgtattaaacttatgttcatagcaccacgtcggacacttatttcacatgaaattaaatagcataagataaatagtattttcagattcatggtataattttgacattagaaattcttgttagaacaaggatttgatgtaaattattttgctgcttgatctacaatagaagttaagaaatgagactaattaatcaattcctataggtgagaaagggacttgtctgcgatcataaaattcagtagtggtggaaactggaacccaatgttcataacttcccagccagtgttttactgtgctctcctgttatgtgcccttaagtacaaccagtgtaaatttaatgaatatttttctacagctgaatgatattaaagagaaggttaaaaatattcatggctatatgaaagacattgagaattatattcaagatgggaaagacgactataagaaggtaatttaaaacttaaaattatttatttgattgtatttttattcatgtgcttaaagaattttcttttttgtagcaaaaagaaactgaacttaataaagtaatagctcaactaagtgaatgcgagaaacacaaagaaaagataaatgaagatatgagactcatgagacaagatattgatacacagaaggtaggtctgttttgcttatgatatcacttacacctatgacattcttttctatagttttattttcaatagaagatccattgaatagaaatgcaaaaaggaaagaggccaagcgtggtggctcacacctgtaatccctgcactttggaaggccgaggcgggtggatcacttgaggccaggagatcaagaccagcctggccaacacagtgaaaccctgtctgtactgaaaatacaaaaattagctggccgtggcggcgcgcacctgtagtcccagctactcgggaagctgaggcatgagaatcacctgaacctgggaggcagaggttgcagtgagctgtgattgtaccactgcactctagcctgggcgacacagcgagactctgtctctaaaaagaaatgcaaaaagtaaagaaaaataattccaataacattcttacttcatttattttttatttttattttcagtaaaagactcatggtaaaagttcgaacataaaggcataaaagtgttcctccccttctcctaattctcaatcttacttctacatgtcattaactgttacacttatttgttcttaaagaagttttttattcatataccagcagataggtagataaatttaggtgtgtgtgtatatatatatatatatatttaaatttacttttatggatggggtcgtatcatgttattctgtaccttttttcacttaacataatttgattttacctatcaactcacagatgtatcacattctttttaatgattataaaatagtccattttgtgtatataccagcacttactcagattgatttcatttccttatcacaaactgtgtgacaatgaacatctttaacatgtatctgtatcttttcttattctaacatatctttatgtagcataaattcacaaaagacggattaaggtttaataatcttgaaagtaatctgtaaggaaaatatttatatattaagtcattttccagttgattcctatatcatttattttctctattaaagaaattaatttctatagtataatcaaaatcatattaagaagccatcatcacatgctttatgcaagcatggtagttaatgcctttaaaaactataccatttctctgttcttactgttttaaacaaaatttactatttgaatgccttaaccacttggttataagtggttgcttaaaatcatttggaagattagttacattagttttctgctgggtctctttctgtaccaccaagaatttcaaatatatgaaatatcagtcaaagggagatcaaatctctgcctggcctaatacatattgaataactgtataaatttatgatgcatatataacaaaataattatcactagcttttatgtagttgcctatataaaaatcacaatctgtaaattcgcagcagctctctgtatatatatacgaaattgttaagattaatgatctatgaccccttttaaagtgatggtctaaacttagtggatctgatggtattagtttactttgtaaccttccttgttccagaaattatttacttagttatatacaatagagcaaagataaatgtatttcaaattaatgggaaaacaaggcagtgtagaaataagggcaagaaagtaatgaaaccaggagagaagtgtataaaaagtatgcatgaagtctgatatgcttgctgaagattctagtagtcaaataaagagaggaggccaggcgcagtgactcatgcctgtaatcccagcactttgggaggccaaggcagacggatcacctgaggtcaggagttcaagactagcctggccaatatggtaaaaccccatctctactgaaaatagaaaaattagccaggtgtggtgacacgcgcctgtaatcccaggtactcaggaggctgaggcaggagaatcgcttgaacctgggaggcagagattgcagtgagccgagatcacaccattgcacttcagcctgggtgacaagagtgaaactccgtctcaaacaaacaaacaaacaaacagaaacaaaaacagccaggcgtggtggctcacgcctgtaatcccagcactttgggaggccaaggcgggcagatcacgaggtcaggagatcgagaccatcctggctaacacgccgaaaccccgtctctactaaaaaatacaaaaaattagccaggcctggtggtgggcgcctgtagtcccagctactcaggaagctgaggcaggagaatggcgtgaacctgggaggcagagcttgcagtgagccgagatcgcaccactgcactccagcctgggtgacagagccagactccgtcttaaaaaaaaaaaaaaaaaaaaaaaagtcacaattagtcaagattcacattgtgtcaatgctaaaagaaaaccagtttcctatactgactacaggataatgtctctattcatagaaaggaagacatgtatagtcttcaacagacttcgcagggctttaaaaaaaatacagtgtatctcagcatcattattccttgatacgaggttctgtagagggtggtatgattgaagcctgaagtaaatgttaatgtttagaaagcaaaggttcttagctaggggcacctgtaaatcgtctgagtttttccacttctaggtatagaactaagaaaattgaaaacatatgttcccacaacaacttgtacaagaatgctcatagcagcattatttgtaatagtcaaaatatggacacacccaaatggccatcaactgatgatcagataaacaaaatgtggtatacccatacaatggaatattattcagccataaaaaggatacatgctaccacatgaatgaacccttaaaacatgctaagcaaaagaagccagtcacaaaaggtcacataatgtacgattccacttataataaatgtacagattaggtaaatccagtgacagcagattaatgtttccagggggctagaggtgaggaaggaatagagtgactgctattgaatatgagatttccttttgggatgatcaaatgctctggaattggatagtggtgatggttgtataaccttgtaaataaagtaaaactgctaaattgtacacgtttaaacagtgaattttgtggaatattaattacatctcagtttttaaaaaatgacttaggttattaaaaatacatgtgttggccgggcacagtggctcatgcctgtaatcctagcactttgggaggccgaggcgggcagattgcttgagcctgggagttccagactatcctgggcaatatggcgaaaccccatctctacaaaaaaattagccaggtgtgatggtgcatacctgtagtcccagctactcaggaggctgaggtgggaggattgcttgagctggggagttcaaggctgcagtgagcccttactacgccactgcactccagcctgggcaacagagcaagaccctgtctcaaaaaatatatatatatatatgtctatgtctccaatccacaccagtaaatcagaatcttgggggtttgggcagagatatgtgtgttttgttgaaattccttagaggttctaatatatccctttagctgtcaataactgagccagcactggatggactgcatagctttcaggcagtcttgtagaagtggtgttattcccagctagacttttggtggacattggactgtaatctgttcagcatgccactctctcacaggtatctagaatgcagctaatttttatgtttccataggtgaccagctgcatgcattaactgtcatctgagttggatgattggggttaatatttaagagctgaggagcctaacagtcacttatttacgtactgatttaagccctgctaaatttagtccacagaataaaataatttggaaacttaactgcctttctcagttttcagctgaaggaatatatgaagagaactgtaggtgacctgacttgtccaaggtcacaaaaagtagtaacaggtagaactggaccctacactatcaaatttctagtagaatggaaaaacatttgtggtatactataactgcatctgattttttttcccttcctttctctgatacattttgtagactataattggaattctcactgcttacagtacaaaggacaaatttgacccaaaaggcattttattagcaattattgagtcaggcactatactgattacatacactcattcctttaatcttcacaatagtctttttttttttttttttttttttaaattagatggagtcttgctctctcacccaggctggagtgcagtggcacaatctcggctcactgcaacattcgcctcccgggttcaagtgattctcctgcctcaacctgcctggggctacaggcgagtgccaccaggcctggctaatttttgtatttttagtagaggtggggtttcactatgttggccaggatgatctcgaactcctgacctcaagtaatccatctgccttggcctcccaaagtgctgggattacaggtatgagccaccacgcccggccacacaatagttctttatgatagatagtatcattattgaccatgttataagcaaactgaggttcagagaatttaaactaatttgcccaaagttatccagtttaaaagtaataacactgtgatttgagcctagatgtatctgacttcaaagcattacactcttgatgtggtatatactgtctttcaaaactagaagaataatggaagctgacctaaaacaaagaaatgcctagctgtctggtaacaatgcaggtagacagaccagcaacaatattttgtgccaaaaatcagtctcatctaaaaatgtgatagcactttaaagagtcctttcatgcaattgtgaaaacaaattcaaatgttctggggtattagatgaaagtaagcagtagcacattcccttgttcctaataaggaacaacaagcatagtaccccatagtagaaccttggtaagtcacaccagctacagtggtacattagattgctttagcaacaaaggacatttataaccatgtcattttagtcacctttaactgcctataataatgcctttagtagatacatattcagttgtctcggtatctctgggagggattggttccaggatcccccgataaaacagataccgaaatctaggatgctcaagtcccttatataaaatggcatatctagtgtttacatatagcctatccatatcctctgatatactttaatctctagattgcttttgatattaatatgtaaatgatacgtagtttttatattgtattattttaaatttgtatttttttattgtactattactttttattttttttccccaatatttttgatccatggttagttgaatccgtagatgtggaccctgtggataaattgtatgtttatattatttccaggaaaaatgaaagtagccttactttgtgactgttaaaaaagaaaaaaaaaactctaaaaatagtcacgcatagaggggcaggattggatatgaacattaagcatgtgagagaaatccttgatttccctctctcatctaccagtccctggcctttactgttggtgcaagatattgccacaggtctgtccatctctctcacttcccatgtcactgagtttagcttagctgcaagggctattgcaggagggtcccagctccctctttgagaaatccttactccaaattcagaataagttttctatacacatgatttgtgggccaaatcacccttctttctgcaggaaattttttttcctctaaattccaaagaatcaacttaaaaactgttttctaatgattgtctcttgacaacatagttcattttaatcaccaggaaaaccactgaaataattttgttgttgttgctgctgctgctaagtgttattgagtctcttttgaaggacaaaactactcaacaagaacagccaattttttgaaatttcatttcggtggctaaggaggtaccaagttcatagatatatgctactattgtggcacttcttactgccttgagtgattacaatttgtcaacctaaaggtagaagttgcaggtaacatatacctaacaggttctaatggtcttggtacatgttgggagacagaactaggacgaaaaagttggggaagacttcagtagtagtattgatctcttataatctttcaggtcagtaggctttatcatggggttcctatgcaaaatgatccactggggatgtaggtattaaaatatctagttatatttttaatttcaccatttaaaatgtctgttttgtatgtttttaatactttataagtaaataagtacacagatatatgctcaaatctttatgagactccccatcaaacagtagacctggtttttagattatggttgtgaaagagcagtaaaagctgcgctacaggaggtattacacttgtcactgtggatggggatgggccatccagattgccccagacctgtagattccttcacactggcttattctccctctgttgaatttcacatgattctaagtaagacagaaatggcacttgctgtcaccagttgcctgttacagatttcatgttagtaacttggttatttttgttaactaatttaatgtttacctttagatacaagaaaggtggctacaagataaccttactttaagaaaaagaaatgaggaactaaaagaagttgaagaagaaagaaaacaacatttgaaggaaatgggtcaaatgcaggttttgcaaatgaaaaggtatgcttttaaaataatcttcagtttaaataaacgtctttattactggaatgtgaagaatattaaatacctgttttaaaagaattttagcctcagcctggtatcctttgagagttactagaaggtgaacagtgttttgatacaattatatttcatggccttaagaactttattactgaagaagtgatatagaattggtaatcacactgtagtgatgggccttagttattcagtattgaacatgcttagtccccatacatctgctagcctgctgcacagaatagtggtactaagcataaagaatatggagctgtggaccttgtctgggtcagagcttgtacagtctataatattgtcaatggagttgttgccagagtgatttatccacagagattcattttagattttctcatttgtaattatgtgtccaccagagcatttcttttgaaagatgagcctcattcttcctttatctggtcttattgttacttattgtagttgctaccttcctggtacagcagaaaagattttattcctgccttgactgccttagagttagttgccttaggaattctgtaagaaccttgttgatgctaaggcactagactggtataaaaggttgtactaggcaaatacttagattgtcaaccacctcagctggttaaatccaggcctctcatttattaaacccttccttgtagagttttcatgtcttcttgaatttatacagaaatctgaatgaaaaaatgcccaggcttttctaaaggatatagtaaagtgaattttaatttataaagcctaacaaatggttaatcctgtgttttggttaagtactcttagctatttaaaatctctttcctatatcagggaaatcagatttttaactagaagagctcatcatcttcagagtcttcatttttgtatgcattatgcacacttagacccagaaaaatcacagaggaaattatgatgaaagccaagaatgtgaccctaatatcctagttcccaagcctcagttcttttacacgatactctccatggcaagttggaaaagtaatgcttctagaagaaattttgatataaaataatatattcgtggctactaaagaccaaaaccagatatttaaaaaatttcttctgtaattggtacataacagtactttttacattcattcacattactaagtacaactatttttcaaacgtttcttcaaccaggacataacagaaatgccaacaagacttgtaatccagtcgactctgtaaggatgcccataagcttgagagtagtgcctgacacataagaggatgcttaataagtgataataaataaatgaagatttttaaagcatacattgaaatttgtataatctgccaaaatatcagaaaagtttgaatattttacttttttggtcattattatggtttttacacttgtgcaagagaaattttgttttcatggaggaatctaaatttttaataagtattactgcagaaaattaatatatgatttaattcgtattgtgcctttgacatgagcaaaatgatgatgaagcctgttatccataacttcttagtgttgataattgtgcattctcagttcacaatcagaagattgtgaatttgtaatattaatcaccagagtgctttacttagcgtctaaaggccaggaactttatcagtgatcacatgctatgagggttctgtaatacacaaaattagctatttagcaacctatgtgcggcagagatatggaaggaagagaggggttttctttagtaccaaagccctaaataataagcaaggagagactctgttataatatactgattgctaaggagaatgatacttaacctatctaaagaaatctatgacttttccacttcaggttgttaaaagctaaaaaatggtcctcatttgtcatttttcttttttacagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccagtaagtattagactggggattttcttattgcagttaatattaactaacatactttagtcatcttttctctcatttttttctttttttcttttttattttttgagacagagtttcactcttgtttcccaggctggagtgcaatggcacgatctcagctcactgcaacctctgcctcccgggttcaaatgattctcctgcctcatcctcccaagtagctggtattacaggtgcatgccaccacgctgggctaatcttgtatttttagtagagacggggtttctccatgtaggtcaggctggtctcgaactcctgacctgaggtgatccacccgcctcggcctcccaaagtgctgggattacaggcatgagccactgcgcccagcccctcattttttctctttaaatatggtattttatgtataccatggattggaaaatatatgtatgtatgtatgtaaacacacactagcttaagttatgaagttaagatataaagcatattaatatctacgagtattcatgatactacctccctctaaccaatctaccattatcactgattggcatccacttagatgctcccttcttatctcaaccttctgtcatccccattccctataaccagtgacaaagatttttactttctctgcttttttaaaaaacagttttatcatatatatgtcatattttgagctttttaaaaatgatatgatattctaggacttgcttttttatttggatttgcttttgtttatccatgttgtttatggccgtagttgattcattttcactgatgtacataatctactatgggaatagaccacaatgcattcattctcctacagatggacatttggggtttttttccaggtcttgtcatgtcttctggaggaaaggtataaggttatatttgtgggagtgcattgtggagtatgctcaattttacaaaataatattgttttccagaaatgactactgatttataccactagcagtatataagggtttatttgatggatcctctgacattggttttataaatttcttaatgtttgccaacctcataggtttaaaatgatgaatcgttgtttatacattattagtcttgtctttttgtgtgttttgggacagagtctctctttgtcacctaggctagagtgcaatggtgcaatcatagttcagtgtaacctcaaactcctgggctcaggcattcctcccacttcggcctcccaaagtgctggggtcacaggtgtgaggcattgttcctggccctattggtcttttcttattgatttaaatgtgttctttatctcttctgcatttcaattccttttcagttatatgtattacaaatgtcttttcaaacattatgcttatcttttttacttagcatcttttgatgacactggatttgattttgagttagttgaatttagcagccttttctggttagctctttgtgtgtcttgttaagaaatccttccctactcctctctctctctctctctctctctctctactcctctctctctctctctctctctatatatatatatataaagatatatatatataaagatatatatatatatagagagagagagagagagatatatcttttttttttttgagacggagtctcactcagtcgcccaggctggagtgcagtggcgccatctcggctcactgcaagctctgcctcccaggttcacgccattctcctgcctcagcctcctgagtagctgggactacaggcgcccgccactacgcccggctaattttattgcatttttagtagagatggggtttcaccgtgttagccaggatggtctcgatttcctgacctcgtgatccacctgtattggcctcccaaagtgctgggattacaggcgtgagctgccacgccctacttctatatttttgtctaaaagttttaaattttgcctttcacatgtaagtacatttaagtatttaattctaagttgaattttttccgttatgaataactggttgtcttggctctatttattgtagactatccttctctcagtgacctacagtgtcatttctgtcatatatcagaattccctatgtgcctgggttggcctgggttctctgttctacttaattcatcactttgtctatctctgtgccatttctctcaccatcttaattacatatagcagaattttctttatccagtgtatgtctgtcttttaaccagtgaatttaggcctttcatattcattctgattactcaattgagttggatttatttctgccatctttttttcctttcctgcctttttgagatggatttatttttcttgactcctcctttttcccttctttgggttatccagttgaccatataacatggggattagggacactaagccccccacgcagtcagaaatccacatataacttttgattccctcagaacttaactactaatagcctactgttgactggaagccttactgataacagaaacagttgattaacatatattttgtatgttatgtgtattatatgcagtattctttcacaataaagtaaactggagacaagaaaaaattataagggaaaatatattttctgttaagtggaaatgaatcatcataaaggtcttcatccttgtcctcttcacattgaagaggaggaggaagaagaggaggggtcagtcttgctgtctcggatggcagaggtggaagaaaatctacataaacatagacccacatggttcaaacctgtgttcaaggatcggttgtattctactttagttatttgagtgtttactttttaatttttaaatacttatttgacttaaaatcatatgcattagttctcaaagtggtcgtggagcaccattatcagtatcaccttggaacatgttagaaatgcctctcagcttctaccccagacctcgatcaaaaatttgagaggtagggcccagcagtctatttttgacagacattttgggtgattctgatgcacatcaaagtttaaaaaccatagctttaatgtgaattgttttatctttttcctgaatactaattatcttctctcatctgcattatttcttttgtctaatattttagttttaccttgtttttaaatcatcacaaatgagtaataattattgtggtggtttcataagcccgcatgtttcccaatttctttgttcattcttgctttttaaatcccactcctcccttctttaggttcagttttctttttttggagtatattcttcaatagttttttcagtgaatgactgttagtggtaaacaatcagtctttgagaagtttttccccttaatttgatagtttagctgagcatagagttctagattgacagttttgttctcttggcactttgaaaatatttcattttttgttggcctctatggttacagttgagaaatcattttaattattcctttaaaagtaatctgcctttttcccctggttctcttaggatttttccctttgtcttcagtgttctgtatttttataatagtgtgtctagactcagctttagttcttctgctcataaattatgctttttgatctgaggattgatatcttccatcaattttggggatttttcatacattatctcttcaaatattattctttctccatttctcactattttccccttcttcactttttattagacataacctcctctttcctctacattgcttaacccctcttgcatatactgggctctgggtaaatatcttgttaaataaattatttagctgctacttatactgcctattgagttgtcattttttcctccatttttttctataagttctattttgttctttttcagaaactcacatggtttttttataattttttttttttaaaacagagtctggctctgtcgcccaggctagagtgcagtggcatgatctcggctcactgcagcctccacctcctgagttcaagcagttctcattcctcagcctcccagatagctggaattacagatgcatgccaccactcggctaatttttgtatttttattacagatggggttttgtcatgttgccccggctggtcttgaactcctggcctcaagcgatcctcctgcctaggtctcccaaaatgctaggattacagatgcgagccactgcgccaggcctatgatgtattttcttcctttgtattttgattccttcttgaatgtgtctttactcattttatacacattttatacctaggcctcccaaagtgctaggattacagatgtgagccactgtgccaggcttatgatgtattttcttccttagtattttgattccttcttgaatgtgtctttactcattttaactatacacattttatattctctttcagattgttattttttaatttcacattttgaggagtctgcttctgctgttttgtatgttgattctatcccctagtgaagtttctgtgttttattaacatttaattgtgtgcttatctttagtagtgttgttttttctatgagactcccttgtgacctttccttgtagaggtccatctacacagaaattttggttttatattaactaagagctccagagaaaacattggcctgcatgtagggtttttgttaatttcttagttggtaggttcctagactatactcactggtagcataactttgaaccccaaaactatataaagcatttgcccaagactttgaattttcaactcattaattttccactctttcattgaggattgatgttatagctcttgaagagtcccattttttgtgtgttgggagtcacttctaatcttcttccttacttgggtcctatccttcatcttctgtcctggatgataagaaccaatccctaggttataaaaacaataacgccaagttcatggctgggcacggtggctcatgcctgtaagcccagcactttgggagaccgaggtgggcggatcacttgaggtgaggagttcaagaccagcctggccaacatggtgaaaccccgtctgtactaaaaaaaatacaaaaattagctggctgtagtggtgcacacctgtaatgccagctactcaggaggctgaggcaggagaatcgcttgaactgggaagtagaggttgcagtgagccaagattgcaccactgcactccagcctgggcaacagaacgagactctgtctcaaaactaacaataacagtaataataataaccccaagtttagtttgtctgtcaggttacatactgactggtctggttttcacttctatcttcgtttctattatgtagggatttccctttctttcttgtgagctcaactatgaatttaaaataagttttgttataagtctatctagtagttctgttcatttgtggcaggagaattattacttaccttagattttggtggtggttgttttttccagaatggcaaatatcttccttagcactaagagagttacacagagagcttctcttctaagacttctggtcagatacagcatagtcaacagaccaacctgagcagtggcattcagaccacagggctcaggaagacaggagaactctggtttcagtatgaggacttttttagttagtgatgataacaaaggtggtcccagaattgcctaggcatatttttggcatatacaagttttaggaagtacgtaatcatgtaagacaaattagatccatttactgtgaaatattgggagtgagccaattaacatgttattttttaaaaataaattatactaagatttttgttagattaagtttaacttttaaaacaattttttgagagtattccatggatatatcttttgtcccatttcattgtgagtgggtacgttaacattacaatgttccctgggtccaaaatggctcatagaattatatgcctgcaccaaatgagaacttttgttttttaacttctttgaatattgccatctctcctagatattagatccagcagtttaaagtggttagtcttggaatttaaggtgctgaaacaagaacataagcaaaacttaaggaattcttgcccagtagactacacatacatatatttgttttttgttttttggttttttttgcctttaataattctttttagtcttctcagctacctcatttatgcctttaggggactttttagtttttcttagttctttaacaacagatgctgtgtatctaatagacttatcaaacattcattgagcattaaggaataggagatccagtaacttctagcaaggatattatagtttatttgaagagacacaaatcaaaacagatttttgttggtaaaaacctattttgccaggcttagtggcttacgcctgtaatcctagcactttgggagtccaaagtgggtggattgcttaagtccaggagtttgagaccaacctgggcaacatggcgaaaccccatcactacaaaaaaatacaaaaattatctgggcgtggtagcacacacctgtaatcccagctactcagaagcccgtggcgggttgcaatgagccaagattgtgccagtgcactccagcgtgggtgacagaaagagaccctgtctcaaaaaaaaaaaaaaaaaaaaaatcaccaaaacttctatttggaataagataagttggttgtgatggaaaaataaaaatggatattaaaagcaagacattggactttgtataaaagtccaacatgataagttttaccttttttaaaaagcctcagaagtccataatacatggttaaaagtgctgtctctgaacactacagatgtccagattttgaattctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaattcttttttttaaaaaaagttttattcttattttttatggctatatagccggtatatttatgtggtacgtgagatattttgatgcaggcatacaatgcataataatcacatcagggtaaatgaggtttccatcacctcaagcatttatccttccttttgttacagacattccaattatactatttagttatttttaaatgtacaatacattgttgactgtagtcactctgttgtgctataatatactagatcttattcttactatatttttgtacttgttaaccatctccactgcccttcctagtctctggtaactatcatctccactatctccatgagttcaattgttttaatttttcactcccacaaatgaatgagaacatgcaaagtttgtctttctgtgcctggcttatttcacctaacataatgtccttcagttccatccatgttattccagatgacaggatctcattttattttatggctgaatagcactccattgtatatatgaacaacttttttttttttttgagacggagtctctgtctcccaggctgaagtgcagtggtgtgatttcagctcactgcaacctccacctcagcctccgagtagctggaattacaggttcctgccaccacacctggctaatttttgtatttttagtagaaacagggttttgccatgtaggccatattgatctcgaactcctgacctcaaatgatccacccgcctcagcctcccacagtgctggaattagacgtgagccaccgcgcccgagaggaaccacattttctttatccatttatctgttgatggacacttaggttgcttccaaatcttaggtattatgaacagtgctgcaataaatatgggagtgcagatatctcctcaacctaatgatttcatttcctttgcgtaaatatccagtaagtgggattgcagaatcatatggtagttctgtctttagtttttttaggaacctccatactattctccatagtggtgattttgagtcctgactgaagatatttagcaaattatttagacactctgagtttccgtttcctcatctataaaatagaatttttaaaaatctatactattattcagtatagagtcagaaaagctcagaggcgatttagtccagcttcctttgtcatgttccattctttaatgtaagttaagttcttaaattctctattctttaatagcactaaagaactaaattcattaagaaaacgtaggtttctgttcccatttaaacattctttgaggttgagggctgtgcatagaagacaataatagcaattgaatactacatgatagcataatcgatttaattattgtatctaactctgttttaaagggcaagtatttatcagacagattaagcaggctacccaagattacccaggtaaatggtagagataaaattagatatcagaaccactgtgacatgctgctaccatagtggccccctgcttttttttttatttttctggagacggagtctcactggttctctcagctctctcaggctggagtgcagtggcgtgatctctgctcactgtaacctctgcctcttgggttcaagcgattctcatgcctcagccttctaagtagctgggattacaggcatgtgctaccacactgggctaatttttgtatttttagtagaaacgaggtttcgccatgatgaccaggctagttttgaactcctggcctcaagtgatccaccctcctcagcctcccaaagtgctgggattacgggcatgacctttttttataaccgttaaaaaactagtatttatataaaagcattttaactgttacttatacttcctggtttagaaccataacttatttctatatattttgtaactcttcagtgaggtgcttgtgtacataatacatagttgtatattaggattttgttcaataaaaatttgagtacataaatgcttgatactgttctagatactaagtatataaggatgaagaaacaaaattaagaaataaattaataacaaaatgggtagtagtggtaggtattacagtgaaaatgaacaatgtgagcataacagatgggcctttaagctgggacctgattgatgagaagggagcaagatatgcaaaaaatggggtgcaggcgttccaggtagagagaatagttactgcagcagccaagaccagtacgaacagaaagtgttcaaggaccaggaagaaggcaagcatgggtggaatatagtcagggatagaccattcccagagtatgtcatgccttgtagccttggtaaacaaacagttttatttcattctaactgcattgggcagtcactggagggtttgaagcagggaagtaatataatctgatttctagttggaagaaattgcactggctgctgggtgtggagaatggattgtaaagggcaagagtaaaagcagagactgatgaggagacttgtagtaaccaagagatggtggtgggctagatcaggtggtagcagtgaaaatggagagaagtgatagacttgggatttgttctggagagagagttgacaggccttgcttctgaattgagtgtaagggagggaaagtaaaataaccaaaggttgctcctacatatttttgcttgaacaacaggatattgggagaacaggttgccattccctaaaatgggtgggactggggagagaaaatcagtagttccgttttgtacactttaagtttgaagtgcctgtagatatctaagcagagctgtcaagcaggcagttggatatataacctcgagcctagagttcaagtgaaaggtgtacactggggagtcatcagcatatccacggcatttaacccatgagatgagatcacatgtggaatgagcatagagagagaagggaaaggtcccaccactagttatgtttgcaaatccagtaaataagcagctggtgatgtgggaaaagattttaaaagatgtggtatcttgaaaaccaagtgaagcaaatatatcaagaatctaatgctatttggagtcaaataagataaggactaagaagtggcccttaaatttgacaaaatggaagttgttaatgactgaggagcagtcagtggcacagttggaactgaagcccggtcaagttgggtggggagagaatgggtagtaagaaatggagacagcagccgggcacggtggctcacacctgtaatcccagcactttgggaggccagggcgggtggatcacctgaagtcaggagttcgagaccagcctgaccaacatggggaaaccacgtctctactaaaaatgcaaaaattagctgggcctggtggtgcctagcctgtaatcccagctactcaggaggctgaggcaggagaatcgcctgaacccgggaggcggaggttgcagtgagccaagatcgtgccattgtactccagcctgggcaacaagagaaaaaaactgtctcagaaaaaaaaaagaaaaagaaatggagacagagaatatagataattcttataacaacttctcctgtgacggggagcaagaaaaatggggcaatggttagagtggaccagggaccaagttaaataggcaggttggttttgttttcaattttacttgtaagtattttgctgcaaggtcagctcttctcttacagcccattgacctgcagacctggggtttcatatgtattcactgaatagaaaaacatacgtaggagctctccagctatccctgcataccctgagaaccagtggcagcaggaataagaattcccttcacttccaagattaggctataagagaaaaaataaaaaagaattcaacaacccttgctctgccactttcttgtcaggctctgggaaaacaggaatatctttccctgtccctcctccaaactgctgacagtctgtctgatggagaccttggtaggtgctccatagtctgtttttgacctgggcctgggataagaaggaagggcttttcagcagagaaaagtgcctcagtcacagaggcatgctgagcagaatgaggacctatgagggagcttggtggagcctggcggggtggagaggtacaggagtgctttctagcaatttaggcttgttaaggaacaaagccaggctgtttactgagttctcttacctggtactcagatggattcttctaaatgaaaagaggtgatacaaatttccccaaaattgagtctttgtggcttatgctcgcaaacagtggccttctcaagatttatacggtgagccctaaatttgccttctcacccagaagaaagtaaggtacaaaatttccctcattctttcacgtcttagaataaagcatgcagtcagtgtaattgttgcgttcagctgtctatttaaggtaacacaggaagtcagcagtgcattttcaagaaaagctgattaccatctgttattagtaatcatctaaaaacatcactaagtataagcattggcagtggtcagagacacatagatgaaaagggggaaattatccatcatttggaatgtattaccccatactaatacaatataccaatttaaatgatgttagaatatatcactcaagatatggtgttctaccccatgcccaaaatgttctactctcatttttccccagatgtggaaggttgcatattaggtaatacttttttttttttttttgagacagagtttcgctctttttgcccaggctggactccaatggtgcgatctcagctcactgccatctccacctcccgggttcaagcaattcttctgcctcggcctcccaagtagctgggattacaggcgcctgccaccacacccggctaattttttgtatttttagtagagacggggtttcaccatgttggccaggatggtcttgatctcttgaccttgtgatccacctgccttggcctcccaaagtgctgggattacaagcatgagccacgcacctggccaggtcatgcttcttttaagactcattgtaaacacgtaacctttacagttttgcatccaaggtagccagctttctgtgaggctcttcagagcctgggtccctgcattcgaggggagcttcagatgagggctttattcagggctcaccttagagtcaccatctctatcatgaccatggatgcagtaaggtttcacagtagctcctgcaacctcaagagggtagattacaaaacccaaagatagccagtggtgtttcacacctaaacaaatgtttatcttgccatagtgattgaaccataggctgaattgtaaaagctgatgtttgggagtctagctaaagaaaactaagttaataggtttaaagaagcaagagctggaagggtcttctcctggaaggtgagatattggtctgtggggtgtccaagggagagaatccagtcatgggttcttagcttctctttctggttggaccagtaaagcctcttcctcatccctcttttctgctcatcactagagacaaaactaaaaaccatggcttcagtctgctaaaagcctagaacaaaacagaacaacaaaataaggcaggctggacaagcttgttaagactttcatggattaccagaaatataaatgccattaaagccatcatttttcctcataaaatgcaatcgattgttactgaaatttttaatgaaatctttcagactcttaatgagtatttaaatatcagactaaagtaatttataaatcattattttctgagctccgagagagtctcacttttttttttttttttttttaagacagagtctggctctgtcacccaggctggagttcattcttgcaaactcggctcactgtaacctccacctcccaggttcaagcgatcctcctgcctcagcctcccaaatagctgggattacaggtgcccaccaccacaccggctaatttttgtatttttagtagagatagagttttaccatgttggccagggtggtctctaacatctgacctcaagtgatttacccaccttggcctcccaaagtgctgggattacaggcgtgagccacctcacctggcctctcactttaagagccagttttcacaaagaaatcatactacttcgcatgagttagtatatgcatttaactgagagatgtgcatactccaggcaggtggtggagctgatacactagccagatggctacttgaccataacagtttgcagcccatgaaattcaaatctttgcctcaccagacagtcatggactttcaaggtcattctgtaagttatttgatgttaaatgcctgtaaagtccaagtgataaaagcgtgttaagttaattgggccactatatgtcactcaatagctcctatagggttcttgtacaggatctcactctgtcacccaggctggagtgcagtgctatgatcacagctcactgcagccttgacttcctgggatcaagctatcctcccaccttagcttcccaaagtgctgggattgcaggtgtgagccaccgcacccagcccagagctgccttctttccatggcttcagcctaagtaactctcacctattaccgtggcacctttcccacctcttatctcttaccgtccttcctacccccacctccacccattatacttctgccagcttcattttcctaaagctggtggtccctattcccttctaattttaggaatgacttccatacctgggctttcccatttcaattcctactaccaagtgtgttctaaccaaacaattttgtcccatattttcctgtgctatctctcccatccttggaatgttatgttgattaagcccttcccaaacatatgtgatttttttcctacctttgtacttaataatattttgtaccacttatacaactaaagccattcagccttgtattacagatatttgggcttccccacgctccataactgcaaaccacagaacacacttcaaggtagacttaggctcatttccatgacagtgtctaactttgattcagcccttaagaattattaagttggtgacatattttcatttccctcacaatggctttgcacatagtacacccaaatacatcttttttgttctttgtaagcattatcacaaggtagatatttttctgagtttttttttccatttaacgtggtgataatcttttacgttcatatattcaagtaccttgtatttttaatggctgcatattctgtaaaatgcatgatatctactttatttaaccactattgaacatattagaaagcttttaaatatgtgctactacagataatgctgcagagtgtgtctttgcacactaaagcagatatgtcaaaaagacagcttcctagaaatggagttactggctcagatgttatgtatattttttagttaatgccaaattgccttctaaaaacacttagaaaatttccaccaatagtatatgaaagtgcccattccatgtctggattttgttactgacattttattggctgcacaaaaaaagcttgcactttaatttacatttccctctttactagtgaagttaaatgtctttttgtatgttgtctatttgtatttcttctccaagaattacctattcatatctctttgccagtttttctactaggttgtctgtttcttgatttgtcacattttaatagattctagatgttaattattttcacatacattgcaagtacctattcccagtttatcgtttgtccatcaattttctttcgttttttcttttttttttttttttttttgagacagagtctagctctgtcgtccaggctggagtgcagtggcacaatctcagcttacttccttccgcctccatctcccgggttgaagcgattctcctgcctcagcctcccgagtagctgggactacaggcatgtaccaccacgcctggctaattcttgtatctttagtagagacagggttacaccatgttggtcaggctggtctcaaactcctgacctcaagtgatctgcctgccttggcctcctaaagtgttgggattacaggtgtgagccaccgcacccagctgcctcagctttctttatggtatcttttgtaacttttaatttttaggtagtcaaatctttagtcttttgatttatggcttctcaattttgttccttatttagaaaggcttcccaatcctaaaattatcaaaatgttttcatctgattgttttattttaccttagcttttgttttttgttttttgttttttcagacagggtcttactctgtcaccgaggctggagtgcagtggcatgatcacagcttactgtagcttcaacttcccgggctcagttgatcctctcacctcagcctcccaagtagctgggactacaggcactcaccaccacacccagctaatttttaaatttttttgtagagatgggatctcactatgttgcccaggctggtctcaaactccaggctcaagcaatcctcccacctcagctgcccaaatactttagcttttaatcctttcattcatttggattttattttgaggttggataacgggtaataattttttttttatcttttgtaacactgttgaaaactttccagttgatttgaactgttgcagttataaactaacgttctatatgcatttgggtttgtttctggattttcctttgtataccaacttttaaaatttattttttttcttttgtattatctcttctatatgaactttagagtcagcttatggattctgttaagcattttttaattttattggggtttctgtttggattgcatttaatttatggattatttgaggagaacggacatctttgtaatatcacatctaccattctggactccttagtatgcatctcctgctcaatcatttccttttatcctattgtaaagttttacagctttttcctctagctcctatacccttttgttagacttattcctaggcattttagggtttttatcgccactgtgaataggatcctttttttttctattgcctttcctattggtgtttgcctctagataataaaacttcatttttatatatttatctctggctatctcattagtctgaataatttttcagttgattttcttggattttctaagcatacaattctgtcacctgcaaaaataatgacaggcttttctctctttttttcatttctcatttctttttaggtagggatttgaatcgtgaaatccctgaatcgttagggatttccaggaccttattttagagcagccataataggaggcatctttctcttcttagttttaggaggaacacttctatagattttaaattaaatttgatgcttgctgtggatatctgagggagtcattttgtccagttaagaaaacattctttgatttttcacttaagatattttatcaaaattcagtgttatagtgtatcaaatgtttttatgacatctattgaaaaattatttttttctttttaatctgctactatattagttgaattattttccccagttttactgtttctttcttgttgtaaacactacttggtcatgatatattctttttactacccttactactaaatttcgttttatttagaatgtttatattcataagaaaaatagccttgtacttttttccccttatgtttctccttgctgtgtcataccttatatacttgggagctaggtgtgtcttgaagatttgataacattccctcataaaactgagtctggtggctttaaaagatggaattttgactgccttttcaattttaactgtcatattcaagggctgttaatatcctagccacttttctctgatcttgaacaagtcactgatttcattgaatcttagttttgttaatggtaaatagagataacagtatctaattcccagtattgtcgtaaggattaaatgaaattgattatttagcatagttttgtctcgcatatggtaaatggtcatcaataataatcattattatcattgttattcccttatgtagattactgtagcgaccttagtcatccccatctcttacacagtacagctgtaaattccatagtagacagagaggatacgaagatgagttaatggtccgtcccacagtggtagtcatcaactccatccgacacactctttggtgggttgagacctctccctgaactagatctttttcccgcagtgctgtgtctcagcagacctggccatgggacaggatgcaccacctgtgttgtataagggagccaaggcagactgcacgtgtgcgccttggccacccctgccttgtctggagcttgttctccacattagaatgcttatgttagtttttgaagatttttaacttgaatggaaagataacttttttttaatgtcatttgaaaaatcaggatcatgatatataagctatggaaaggcagtctttacatgattggtctaacattccatcagttttgttttgtttttaggaaatacttagatgttttgtctccttttgaaaggagcataaaatgttaggctgagataaatgtataaggtagaaaatggagacttgttgcattctcatcaacaagcagaatatggttttttccagtcttctactacttcacagtccttcatctgatatttaaaatgtatttatgttgagtcatttctttctctcttgctggtgaaccagaagatcacgaaatgattctacagaggcagtagcattatattcagtttctttttttgtatgcatcagataagaggcctgcaaatggaagtaagtcgcctcacatcctcacatcctttgtatgatgatcgcagtaatgtttgcctttttaccactggtgcaacatttattagttcataaacccgcttccaaagaacctaagggctttttgatgaaaggtgactgtggtgggaacaatgttaggttttgacaggctacttttgcttttacaaacatttctcctctttgtttttagtgtttagaaactactaccttaaaagagagttgaggacagggacatgtctggactaagtggaatttagtgcttagagttaggatttggaatataaatatggaagttaatatttagaattaggatttctgaatctgtgaaggaaaggtaaaataaaattttgatgtcagttcagcttaagcttctaaatcattctcgctgaaccaaagcttccagttggtaaaaatctaagatctgaggaataaaaccaacataagaagctgacttttggtaagccttaacagtgatagaagagggacaaggtggcagttcgattctcctattttccccatagactgcaggccccttggctaaccgtaaaccttctaccctttaactccctgtcgtccattcagcaggccttcctgtgacccgtgagtatcagtggaagcattccctccaataagttaccacggcctaagaaaaaagtctaaaaaattatgtttcctgaagttttcacagtatttaagtatttacgtaaaggagtatttgttgtatcctagagagtgaatatggagaagggtacccctggagcactagaaataagcctgccaattttcagtattagccaagcagcaaagttttgctgctgtttatttttgtagctcttactatattctacttttaccattgaaaatattgaggaagttatttatatttctattttttatatattatatattttatgtattttaatattactattacacataattattttttatatatatgaagtaccaatgacttccttttccagagcaataatgaaatttcacagtatgaaaatggaagaaatcaataaaattatacgtgacctgtggcgaagtacctatcgtggacaaggtgagtaccatggtgtatcacaaatgctctttccaaagccctctccgcagctcttccccttatgacctctcatcatgccagcattacctccctggacccctttctaagcatgtctttgagattttctaagaattcttatcttggcaacatcttgtagcaagaaaatgtaaagttttctgttccagagcctaacaggacttacatatttgactgcagtaggcattatatttagctgatgacataataggttctgtcatagtgtagatagggataagccaaaatgcaataagaaaaaccatccagaggaaactcttttttttttctttttcttttttttttttccagatggagtctcgcacttctctgtcacccgggctggagcgcagtggtgcaatcttggctcactgcaacctccacctcctgggttcaggtgattctcccacctcagcctcccgagtagtagctggaattacaggtgcgcgctcccacacctggctaattttttgtattcttagtagagatggggtttcaccatgttggccaggctggtctcaaactcctgccctcaggtgatctgcccaccttggcctcccagtgttgggtttacaggcgtgagccaccgcgcctggcctggaggaaactcttaacagggaaactaagaaagagttgaggctgaggaactggggcatctgggttgcttctggccagaccaccaggctcttgaatcctcccagccagagaaagagtttccacaccagccattgttttcctctggtaatgtcagcctcatctgttgttcctaggcttacttgatatgtttgtaaatgacaaaaggctacagagcataggttcctctaaaatattcttcttcctgtgtcagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggcaggtatctcaaaagcctggggagccaactcacccaagtaactgaaagagagaaacaaacatcagtgcagtggaagcacccaaggctacacctgaatggtgggaagctctttgctgctatataaaatgaatcaggctcagctactattattacactctcctgaagctaaccaacatttcctgcaacattatgtagacttttaaaagaagggcctgaagcattctcacaggataggctaaatgtagaacaagaagctgaagacccgttagagttttcatggcactccttatcagaataaggtcactgtctcatcagttataagacataccactattttatgtgccagcaggaatgaaaaaatgcaattataaccataagatgtttcagaatcaatgacataatagtattgcaaaccagattctagcttaagctagaatgaatattccagtatagtaaggagtctcattaagaaagtagcccctcatagaactaagtccctaccacagcatacacaaagacttagctgctgggtcaggccatctggcttcaggtaaggctctgtgaggacagcctacattggaaatcaggaagaggaatgaagttttaaagaatcaggaatatggcatccttggggaacaaggctggatccttcactgtgcacaggtttgtaacaaagatgtcacagatacttgagctttctgctttcagatcaaggcagaagattacacttgataacacctctaggcccttgactttttttaaataaaattctaaaatcatagaaatagatgcttacattatctaactcattttcatagtttgcagtttttgcttaaagaacatgccatgcagctgggcatggtgtctcacacctgtaatcgcagcactttggaaggccgaggcgggcagatcacctgaggtcaggagttcgagaccagcctaacatggtgaaactccgtctctattaaaaatacaaaaattagctgggcatggtagcatgtgcctgtaatcccagctactcgggaggctgaggcaggagaattgcttgaacctgggaggcggaggttgcagtgagccgagatcgtgccattgcactccagcccaggcaacaagagcgaaactccgtctcaaaaaaaaaaaaaaaaaagaacatgccatgcatatatgtattatgttgtcagcctagacagctgatcccaatttaaagcatctgcagattactgtctaaatcatagtctacaaaaatgacaaacttgtgatctgtaatcagtatccctacgtgctttgatgatttttagtggtaattataaatgagaaaatacagagtttgaaacatggtctctttgaattaaaaatactttcaaaaatatcttgaggaaaaagattttttgtagctattctgagttatgaaaattaattagcaataattgtctccttggtgtgaggggagagaacaaataatggaggtgggcctccagcctacctaacactggcttttgctgaggctctagcagccagccaggggctctgcatgtgagtgggtggtggtagagttgacagcagtttggattcaaagacaggaaggaaatgcctgtccctcacagggccaagctgtggccctgtcttctggcttgcctaggcattaaagaaaagacataaactattctaaaattaccaactcactgatgtgtgcgcacccacccacaaactgagggggaaaggggacttacagctcacaccagagtagtttatacttcctagaatagccctactctctcaattctgtgtgtcttgtatcctcagatggtttcagtgggtctgagggttttagtattaggtttctagtaaccacgaaaatgcctaacagttccagttacttggattttctacaggtaagcttaactgaaaccacatttctatactcctgatactttgacctaggattttcttttttattctctcagtctcaggattatacacaagaatatggaaatttaaaggtagcagagaaaaagtgagaggctctagaaaacgtgtcgaagttttctaacagatcccattatcaggcaaatagccaggtcaagaatttttaaggttgctcatcttacaggattattaaaattacagataaatggcattgtctctgtttctagcctttggtctcaagttggttgtagctgatgtaattttttatgtgagagcatcagcgttgttctgagcattttgttttgtggtgaatgataggctgagatcatgcaggttctccttctggaggacataagaatctggtcccagtgctgggctctcccagagggcagtgctttacctaacagtgaacctgtgacgtttcccacttttccctgctgaaaagatcatgtcaggactgcttgcctgccatgagatgagaaggtctgtgctgggcttctcacataggggcttttttccaggtattagcctcactcatcattcgcctggccctggctgaaacgttctgcctcaactgtggcatcattgccttggatgagccaacaacaaatcttgaccgagaaaacattgaatctcttgcacatgctctggttgagtaagtatctcttgcacatgctctggttgagtaagtatctcacatttggggacaggttgtgatagttcttcaaaaccaagagagttctgtgatgaaaacgttctctagctgtgttccccacttcttggggaagccagttggtgccaggccctgggctttaccttttgatagtaattcttcagatccctcctaaaggaactagatggtgaacagcagccccagacacatcctgcagctccccaagtgtgttcacagggagagagtcactgtgaggggttcctggcctggttttcctgtaaacctaccagaggaacccacatgtcatgcacagcaattagcatgccctgctaagacatctgcaggtagtggtagtgggtttaggactgtctccccagctttccacatgtgtcagagaactgtgaggaatgacagagctcttactcaaaaagcttatttgagattaggtaaagtccagtgagggtaaaattgcacaccttttaccacattcacctggggtcagtgtagacgccaaggttgtcaagcagctcttgcataaggactatgctggcagagaaaaaggcagtttccctgaggtcaaaggaggtgtttcaggcactcctggctccagacagtccctttctggcagagagggccagaaggagagctcagcagcgcagggccacctttctgcagccatcatcacaagtaagggcgagtgcttttgaaacctcaaatgcatccagctccaggaaggggataagtggctagctaaaagaaaaagtctttcaggtttcagtcacattgctggttacctcagcaaaatgttcccagaacacccactcaggtccctgtgtgtcatagtaatgatgcatctagtgactggtggtggcagaattctaagtagacccagctcttaagaaagcagtgttattccccttacctgtagtttgtctttattacttttaaatttttcttccagagaaaagtagtaacaggtcaggaaaatcccaggcgaaggagtaagccttctatagttgaacagtttggatattaaggaaaactcaataaaatatttatacctgctttagtgagaacttctgatctggaagaaactagttcttgtattcctgtgagtccctaagccagacctaagtgaggagtcaggccatgtgtccctactgtctggagaggagaagagactcctgcctggctggcctgaaggcctggggccacccctccacttcctgcagggtagctggggccctgacacacagcacaagttcatgtgtctgacaaggtttgcggtgacttttcaaatcaaagaaggggttatgctctttactaataatatgttctgaatatattgttgcaggataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttca

SEQ ID NO: 105 - DNA, 97132 bp, Homo Sapiens
ttttaatgtcaaggcaccacagattaaatatccttttatttgactcaaactgaacaataacatttaaaacacacaacgggaagcagcgcagttatctctcaaaatagacaatgatggtttaattaagaggttgataaagcatatgtagaaaagtcagaatgtcaaaataagtaccaaggagaacatatactttgaaaagggggctaaaacatgtagctatacaatctggggttcttatcgattgatggatagattgattgagacagagtcttgctctgttgcccaggctggagtgcaatggcgtgatatcagctcaccgtgacctccaactcccaggttcaagcaattctcctgcctcagcctcctgagtagttgggattacaggcgcccaccaccatgcctggctaatttttgtatttttagtagagtcggggtttcgccatgttggccctgctggtctcgaactcctgacctcaggtgatccgcctgctttggcctcccaaagtgctaggatcacaggcgtgagccaccgtgcccggtgctgggattctaattcaacaatttttcttggtagtcttgccaacagtaattggagaaacgtgttcctaattgtcggtggggagaggattaaaggtaagcacacacattttaatacacattcaatgtctgaatttgaagaataaaaatgcattgctttcaccacttaaaaagagctaaaatcagatccagttatttgacacagcaaagacatacaaatgtacatggcaacagcaagttatataagctggttctttagatcaaactaaaattctagtattttctgaccaaactaagttcaaaagtactaaaagaaaatgaaacaggcaaatgatgaaatgtggatctttttcattcaagaatatggaaactcattggactgaaaaacccaaatcttcattataccaaacttctataatgatcttaatggtagttagctttaaaaaaacacaaaataggctgggcgtggtggctcaggcctgtaatcccagcactttgggaggctgaggtgggtggatcacaaggtcaggagatcgagaccatcctggctaacacagaaaaaccctgtctctactaaaaatacaaaaaaaaaaaaaaaaaaattagccaggcgtggtggtgggcgcctgtagtcccagctacttgggaggctgaggcaggagaatggcgtggagcttgcagtgagccgaaatggtgcccctgccctccagcctgggcaagagtgcgagactccgtctcaaaaaaaaaaaacaaaaaaaacccaaaatactatgaattaaatttatgacagatacaaaaaggacatcagatttctttgggggaaagtcgcttttaaattctatatttccaaaaaagatattttacatttagatactttttttttttttgagattgagtttcactcttgttgcccaggctgcagtgcaatggcacaatctcggctcactgcaacctctgcctcctgggttcaagcgattctcctgcctcagcctcctgagtagctaagattacaggcacacaccaccatgcccagctaatcttttgtatttttagtagagacgaggtttcaccatgttggccaggctggtctcaaactcctgacctcaggtgaaccccctcctcggcctcccaaagtgctgggattaaaggcatgagccactgcacccagcccattgagatacttttttactcagtttttttctaagaatggattttcctctttatgaaaacaaaatattccttttctttataaaactttataggcaaatttatcaagctggtaaattccataacaggctgaaccaaatgaaatacctaagtaaagcaaattacatgattagaaggctaattatggtattactgcataggtttagtattaatgcatatgttctaagtttattgcaactacactaacttcgtaattttagatttgcagttgcatcctcctaactgcgtctaatggcagaagcaccaccttgtggcaaaagtaggagcttttaaattacagaagttagggcttgttacccagaaaggagaaaacaatataatgggcatccaggacactgcgctatttcttgacctgtagagggattccatcagtgctcaatttataattatttattcaaccatatgacttttctgtatttattgtatttcctacttttaaaagtttgggaaaaaagtcttttacatacctgaattaaaggtcacattcctaaatgcttgaattttctaagcaccacttatattttcaagaatttcctagaacttcgaggaatctttaaccttgtaaatgcactgttgtatttttatgataggaaataaaacaccagaaagacacttattctttggtaagtaacagaagaattccctacagatgtcttcctctgaatgttttcattcctgctctcccaaagcctccaagagcaaatgcagctgctttcaaatcatctgaaagacttctacattcctataccaacaggtctgaaaattgttagaaacaaaaaacaaaactcccctaaaaccaacagattttgcaggatcaatataaaatattaaggatatatagcacatttaactatgtaacaatattcaatcaaaaaaaggtttccctgtcacgttttatttaccatattttcagggcttgatacatagtattcacaaaatgacctgaattagctggagagatttatcaccctctgtaactgctatgtcatcactttccttagcggtgaactgaatcgcatttagtacctcttttcacagccaagagcaatttttttttttttaaggaaaaaaactttattccttttttcctaggaacttgtcaggatactttagtgaccattccctcactataactctcacccagacccacctaactgatgcatgagaagagccactagctgatgtggcccacagctcagactgagccagcatggcttgtgcaggggtaggtagcacagcatcatccagacactgcctcccctggtagcttccattacatcatggacagcactgctcttccctgacttaaccttctgctttgttcaaatactagaaatattagatttcaagttcaataaagatgtgggcagatctgcctaagaatatttcacaggacaatgccttccactgagttaatgttacttgctcaaataacccttatgctcaagttaggtacagaaaaaatatttttaagaaagtcaatagaatgttatattgcaagttttgacttaggcctcttcaaaagtgctatatgaggcagccactaaccaagtgtctgtctcttataatttgacacattccaggtatgactattctaatggtcatgagtatcactgagtcaagtatttgtttctacctatgaagaaatgtcgggccattgtactcccaagatgtataacttgaattttaaagtaaagctgtcgcataaaactagaagaaggaataatctcagggatctttttacagaggattataaagaatgggattatttaacttaaatctgaagatgtctaattcttatttctccccgaaaacaagtaaaaaatagaagcttaacatgggctactaagatttctggaattgcccattcagaaatgtatcacaggaaccaaagttgagataaaatattgttaatgagaaatcctggcattgacattccacattaaatatatttctatactttactgtaaggttcaactgaccactctacctaaaacaaattcttcaatattttcaagatgtagtttaaaacaatttttaacccgtttcctcctagaactaggcacgcatatatgtatgaaagagaagaaaaagcaaaggagaaaggaagagtggggaacgggggggagagggagagagagagagagagagagagagagagaacaccattaaggatacagaataataaaggaaattactaccacttaatgggaacacaatcttttgaaatctttgctacaactggaataaaaaactcagtaattctgaaaggttattctactcttttaaataaaaacatatctgttcaaactattaggtacttctaatcatttagtcttataagaagcattggaaaaaaacatacatagtaacaaacagtgaatttagacataggttcgcataaattgttttactttcagaaaacccagaacctctaggaaattactaaaattatgaagaagttaaattttataagctctttccctcaactttggctaaatgtaaccatattaaaatactgacatagtttttcattatgaaatagaaatgtaaaatggtagctttattttaatctttactcaagagtgatattgaaacaaagctcttactacaacaaccaggttaaaaaaacaaggtgaatcaatgctattgtatgtctgtgaactagaaatttcttacttatggagttatgctcaggaaacaatacttaaaatcttaaactgtaaactcttagcttgtaacattttcatttttcctgtatcttgcatgtttctcagtgccattaaatatattatcttctatttcttcttaaagaactagtgttcataaaaggatcatcatcatcatcctgaaatgagatacaaatgttgtattagtgattgttccctgcttcactgaaacaagacagaagttcttatgggcaaaacaataccagtgagagtcatttcacatgggatagactttatttttctatttcctttataactgcaaaatatattaagtacaattaaattcttaatgagcattaaaatgaaaatttatcctgctgtgtgtgcatgtatctacaatataaaccacacacatttcccttactaaccttaataaagataaatgaagtataggtaagccagaaaaataattcaagtcattttatatttggtttttgaatatattttctcatttacattttattacagttgtatctactcttctggaaattcacagcgaaaaaataatgaagccacatggagatccaactcagaaacagctgtaattttatttcccattaccatttaatactagaaatagctagctactctcacacttatgcaaaaaacaacctagcaaagcaagctttcaaatagttttttggataaaaaaagaaatacatgcagttatttcaagagttcccatgctggccgggcgcggtggctcacgcctgtaatcccagcactttggaaggccgaggcgggtggatcacgaggtcaggagatcgagaccatcctggctagcacggtgaaaccccgtctctactagaaatacaaaaaattggccgggtgtggtggcgggcgcctgtagtcccagctactcgggaggctgaggcaggagaatggcgtgaaactgggaggcagagcttacagtgagctgagatcgtgccactgcactccagcctcggcgacagagcgagagactccatctcaaaaaaaaaaaagagttcccatgctattgggctatagattgtatgcatggtaagaataaataggaatatcagatattaactaataatttaattaaagagaatgaaaacaaacctcagataagcccaattatataattttatgaagataaaaccaattcttacgtattctataaatattcagaaaataaagcaaatttgtttataagttttttatttgtgtttaagacattaaaagaaattaaaagaaattatttgatgctaggctttgttggtggtatcagcacttccaaatgttagctaaattaactatctctgatgagtaatggatgccttaagaaatataaattcattttcatttattgattcattttctgctgctatcaaagacaaaacttaaataaaccagagacaaatccaaatgaagtctaatagataatttgctaatagtttgtctttgcagttaacatgaactagtatacaaatttttaactgtaacatataaccgcatatatatccagatgttttggaataaacaataattgctcacttccctcctggaagcaacatgttagtatttaataggtagaatgagctcttgctgccatttttcttggcagcctgagttgagtcctctcaagctgttttaaaccacagcttaaatacagggaacatggcagcagcagccaaagctaaaaatgaaaggtgtaagtcacaggctacaacgtagataaaccttcaggtacttacgctatgtgaaataagccagtcacaaaaaggcaaatactatatgattctacttctatgaagtacctagagtagttgaattcatagaaagagaaagtggaatggtagttaccaggggatgaagaaggggaaacagagacttgttatttcagggatatagattttcagttttgcaaaatgaaaaagtgctgaagatctgtttaatatggatctatttaacactactgaactgtacacttaataatggttagttttatgttatgcttttgctacaattaacaattttttaaataaaaaaataaatgaaaggggtcatgggcctaagagaaacactttcaagcaaatcaacaaaaactagcaaaggcccttcaaatggcagccttgaaggaaaggggaagggcagtatccttcagtcatgtagttttatttaaacttaattgaaacagcaaattaataaaggcaagaggtaagtcctgacttataactcttcctcttcctcctcctcctcattcatggtggggagatttcatggttgcagacgcgatctggaactggagttttttccagacatcctcccagagaacatttcggacaatgcctgaatacctgtatgtcatgaaatcaccaccatgcgccaccctctacatgacacatgtagagcatatagtgagtacttaataaatattcattaaagtaatattaaaagctcttgggatatcatcatcatcatcatcatttctccaaatataagtaaatggtagaagctaaaaaaaattccgatcccactgttaactgggcaaataagaactgagtgaatatcatattttaaaaatctacaggacttttatatctgaggtattacactgatgggcactcaacatatgttacttgttaactcttaacattaactatagttcaaaggaaggttatcaatgaaactattttttttttttgagatggagtttcgctcgtgttgcccaggctggagtgcaatggtgcaatcttggctcactgcaacctccacttcccaggttcaagcgattctcctgcctcagcctcctgagtaggtgggattacaggcatgtgccaccatgtccggctaattttgtattttcagtagagacggggtttctccatgttggtcaggctggtcatgaactcccgacctcaggtgatccgcctgcctcagccttccaaagtgctgggattacaggcatgagctaccgcgcccagcctgaaactatttttaaaaataatttttagtggaagaaggacaagatggccaactagacagggccaagaagcaccactgccactaataaagaccaaaatatcgagtaagccaacatattttgagcagatctttggagaaaaagcaccaagagctgatagagaggtgatacaaactggaagctgaagagggaggaagctggtaaccttgtgggggttgcccaatgccagggctggttcttggccttgaaaggctcctagaaaggggtgagtgaatggatgatggggcagcacactctcactatggacctcagagatcctagctacaagattccatgccccctggagacgtttcaactggcagggggattggcccaaacagtaggcagagacagagctccagaatacatggagcccaggggttttcatatctaaggcagctgcagcagaaggtggccataggcgcccatcccctaagacttcttatttcccctggagtaggactagccccacctgaatgctggggcaggccagcctggggccagcttccctgtgggacagaggaacatctgttctgcaggccctcctcccctacagccccttccagggcccctgccaagctgccctgcaggaatgtgtgcacagggcagcctctgctgcctagccttgttttttgctggtggttccacctgagtaccttcctggcagcctgggagcatttcagattccccagcacagctggtgcctgaccctgagggtccagacgatggagccacaggctggtcccagtgctacagggctacagcacacagctggggctgtcgagctaagagctggggctggcactcaagtaggggagaaatcccactttcagaacactgaaaggagtgagacacgtgggttcgtgggccagtgcaggaatgggacatgccttcctccacagtgctggtctgggaagggtgtggcctgtctggcagccatggcctctgtctaagggagccctgcaacccaagacaccaaacaacagtaatgcaggtacagtgccagtgataggagggacctcacccatggtccaggagtggcccttatgagtggtcatctctctccccaaccccaccacagagcacggctgtgaacacacagaaatacaaaagaactatgcagctgagtaagagcctatccactggacactaatgttaaatgccagctactggatcacagccaaaattacaacaccaaaataattctgccaatatacatctctgtgacacccagggcaagaatctaggcacagtaaagatctatatagagctgtggccctctgaaagcacccagaaacaaggccagttgactatactcgacttacactgcagttaaaggaacaatagccctctaacatgagaaagaatcagtgcaagaattctggcaattcaaaaagccagaatgtccccttacctccaaatgagcctgctagctcaccaacaatagttcttaaccagattgaagttactgaaagacagacatacaatttagaatctggatggcagggaagctcatcaagattcaggagaaagttaaaacccaatccaatgaatccagtaaaacaattttacaaaggtaaaatagccattttaagaaagaaccatactgaacttctggaattgaaaatttcactacaaggatttcataatacaactgaaagtattaacaacataacagaccaaactgaggaaagaatctcagagcttcaaaaccagttcttcaaatctacttggtcagagaaaaataaaggaaaaagaatgaagaagaatggaaaaaaaaaacctctgagaaatatgagattatgtaaagaggcaaaacctatgactcattggcattcctgagagagaagagagaataagcaatatggaaaacatattcgaggatacagtccagaaaaatttctccaatcgtgctagaaaggttgacatgcaaattaagaaatacagagaattcctatcagacattatataagatgaccatccccaaggcacagtcatgagattcaccaaggtcaacatgaaagaaaagatcttaaaggcagctagacagaagggtcaggtcacttacaaagggaaccccatcaggctaccagcggacatctcggcagaaaccttacaagccagaagagactggggacctattttctgcatccttaaagaaaaaagaaattctaaccaagaatttcatatcccaccaaactaagcttcataagcaaaggagaaataaaatccttctcaggcaagcaaatgctgaggaattcattacaactagatcagccttacaagaggtccttaatagagtgctaaacatggaaacaaaaaaccaccacctactaccacaaaaacacacttaaggacatagcttagagacactataaagcaactacataatcaagtctacaaaacaaccagctaacaatacgatggcaggatcgaaatctcatatatcaatactaactctgaatataaattgtctaaatgtcactacttaaaaggaatacagtggcaagttggataaaaggacaagacctgactgctgtcatcaagagacccatttcacatgtaatgacacacacaggctcaaagtaaagggatggagaaagatctaacatgcaaatgaaaaacaaaaaagggcaggagtcacaattcttttatcagatatagccgattttaaaccaaccaacagtaaaaagggacaaagaaaggtattatataatgataaacggtttgattcaacaggaagacctaactatgccaaatatatacatgcccagattcataaatcaagttctgcttaacctaaaaaaagactcagacagcaacagagtaatagtgggaggcttcaacaccccactgacagtgttagaaagaacatccaggcagaaaactaacaaattcaggacttaaacttgacacttgaccaatcagacctaattgaaagctacaaaatacttcatccagtaactgcaggatacaaattcttcccatctacacacagaacatattctaagatagatcacgtgttcagtcaaagtaagtctaaataaattcaaaaaaatcaaaatcataccaagtatactcttggactacagtgcaataaaaagagatatcaatattaagaagatctctcaaaactacacaaatacatggaacttaaacaatttattcctggataactcctgggtcaataatgaaattaaggcagaaataaaaaaattctttgaaattaataaaaattcattcattaattaatgaaattaatttcattaatgaaaataaaaatagaatcacaacttacaaaatcttagggatgcagctaaaactgttaaaaggaaagcttacagaactaaatgtcttcattaagagaatcaaattaacaatttgttaatttaaatcaaattaacaatttgttaatttaaatcaaattaacaatttaacattgtacctggaggaactagaaataaaagaacaaaccagcccccaaattagcagaagaaaagaaataaattagagaagaactgaacaaaactgagatgcaaaaatccataccaaagatcaatgaaatcaagaattggttctttaaaataataaacaaaattgataggctgctagctagattaacaaaggaaaaagagaagatccaactaagtacaatcagaaatgacaaagatgacattacaattgaccccacagaaatacaaaagatctttagagactactatgaataactattcacacacattagaaaatctagaggaaatggataaatccctctaaacacacaacctcccaagattgaaccaggaagaaagtgaaaacctgaacagaccaataataaattctgaaattaatcagtaataaaaaactgaccaaccaaaaaagccctagactacatggattcacagccatattctatcagacatacaaagaactggtaccaatcctacagaaattattccaaaaaaatcaagggaggctcctccctaactcattctacgaagccagcatcagcctgataccaaaatctggcagagacacaacaaaacaaagaaaacttcagtccaatatccctgatgaacacagatgtaaaaatcctcaagaaactagcaaaccaaatctagcagcacatcaaaaagttaatataccatgatcaagtatgctttattcttgggatacaaggttgattcaacatatgcaaatccataaatgtgactcaccacaaaagcagaattaaaaacaaaaacgatatgatcacttcaacagacacagagaaagcttttgataaaatccaacatcccttcatgataaaaaccctcaacagactaggcactgaaggaatatacctcaaaataataagagccagctatgaaaatccacaaccaacatcatgctgaacaagcaaaagctagaaccattctccctgagaactggaaaaagataagaatgcccactctcaccactcctattcaacatagtactggaagtcctagccagagcaatcaggcaagagaaagaaagaaaagacatccaaacaggaaaagaagtcaaactctctctttgctgacgatatgattctgtacctggaaaaccctaaagaccctgccaaaaggctcctagaactgataaacgacttcagcaaagtttcagaataaaaaaaaaaagtgtacaaaagtcagtagcatttctatacaccaataacgttcaagctgagagtcaaatcaagaacaacacaatcccatttacaatagctacaaagaaaattaaatacatagctatatagctaaccaaggaggtgaaagatctctacaaggagaactatgaaacactgctgaaagaaatcacagataacacaaacgcaaaaacattccatgcttaggaactggaagaatcagtatcattaaaatgaccatactgcccagtgctacctacagattcaacgctatccctatcaaactaccaacgtcatttttcacagaaattagaagaaaactattctaaaattcacatggaaccaaagaagaacccaaatagacaaagcaaccctaagcaaaaagaacaaagccagaagtataacactacccaactttgaactatattataaggctacagtaaccaaaacaatatggtactggtacaaggacagacacacagaccaatggaacagaacagagaactcagaaataaagctgcacatctacagccatctgatctttgacaatgctgacaaaaacaagcaatggagaaaggactccctattcaataaatggtgctaggataaccggctagcaatgtgcagaagaaaatggatccctacctttcaccatatacaaaaattaactcaagatgaattaaagatttaatagtaagacctcatactataataatcctagaagaaaaccaagaaaatacccttctcaacactggccttggcaaataatttttggctaagtccccaaaagcaactgcaagaaaaatacaaatggacaagtaggacctcattaaactaaagagcttctgcacagtaaaactatcaggctgggcacagtggctcacacctgtaatcccagcactttgggaggccgaggcaggtggatcataaggtcaggagtttgagaccagcctggccaacatggtgaaaccctgtctgtactaaagattcaaaaaattagctaggcgtggtgatgcgcacctgtaatcccagctactcgggaggctgaggcaggagaatcgcttgaacccgggaggcggagattgcagtgagctgaggtcacaccattgcactccagcccaggcaacaagagcgaaactccatgtcaaaaaaaaaagagaaaagaaactatcaacagagtaaacaaaaagcctacagaatgggagaaaatattcacaaaatacgtatccaacaaaggtctaatatcaagactctaaaaggaatgtaaataaatcagtaaggaaaaatcaaataactgcatcagaaaatgggcaaaggacatgaacaggcacattacaaagaagaagacacacaaagcagccaacaaacaaaaagtgcttatcatcactaatcatcggagaaatgtaaatcaaaaccacaatgataccatttcataccagtcagaatggctattactaaaaagtcaaaagacaacagatgctagtgaggttgtcagaaaagggaatgcttatacattgttggaatgtaaattcattcagccattataagccatttggaaatttctcaaagaacttaaaacagagctacgatttgacccagcaatcccattactggctatataaccaaaggaaaagaaatcattctaccaaaaagacacatacactcatgtttactgcagcacttactcacagtagcaaagacatggaatcaacttaagtgcccatcaatacggattggataaagaaaatggtggtacatatgtaacatggaacactatgcagccataaaaagaacaaaattatgtcctttgcagctggaggccactatcctaagcaaattaacaggaacagaaaaccaaataccacatgtcctcacttacaagtgggagctaaacactgagttcacatggacatgaagatgggaacaacagacactgtggactactagagagtggaggctgagagtaggatgtgtgttggaaaactgcctactgctcactacctgggtgatgggatctgtaccaaacctcagcatcacgcaattcccatgtaacaaacctgcacatgtactccctgaacataaaagatgaagttatttatcaaagaaaaaaaagttcagcaactagctggcagtctctatttaaattttataaagttaaaaattaattaaaatttaacaatattacttatttacctcacttgattcaaaatcaacccctttcgatacttgactctgggacatgattttgctggatgatgtgctggaccacctgaggcaaaacaaaaacaaaaacaaacacaatgaactacataattcatcaagtgtgcctttctggctaagtttttcaatccagcagctgccacgaatataaataacacacaattcccttaaaatctacattagcggcaataaaacttaactgtaaggaaaaggactctggggccgaggtttgaactctggttttgccctttactacctatgtggctttgagcaagttacttaacctctctgtgcttcaatttcctcatctgtaaaacggggataatggttttataaagactaaatgtgttaatatgcttaaacacttagaacagtgcctgacacatattaagtactacaacaatacttacttatattattatagtacttatcatgtaccaaaatgtatacattaccatcttccacttctgaaaaccatgggaacattgaaatattttctattcaaatctcagttaataagaaaatcataattcctactctttttactcttttttttttttttgagatggagtctcgctctgtcaccaggctggaatgcagtagcaccatctcggctcactgcaacctccacctcccagttcaagcgattctcctgcatcagccccctcagcatgccaccatgcccagctaatttttgtatttttagtagagacggggtttcaccaggttggccaggatggtctctatctcctctatctcttgacctcgtgatccgcccacctcggcctcccaaatgctaggattacaggcgtgagccaccacgcccagccgattcctactcttacaaagcttaacttgcagtaaattcctatgtcttttaattaataagaaatttaagtcactttagatcggggccagtaagcaaatctagcccaccaccaggttttgttttttttatggcctataagctaagaatggttttcacattttgaaatggttacattttaaatggttatacaagtgtctacctacataatatccccggttttgcctcttgacctgccgagcctaaaatactccttatctggcctgttaagaaaaagtctgctgattcccgtcttcaataaaagtagtgtttataaattcttagtctacaattttattaacatgctttgggatgtcattatagcaaaagaaatatgtccaaaggttttatctggaaaaaagaatgagaatcacgagatcttatgtcagaagtaaatagaaaaattcacaggtcctttgcactaaaggaaaggacagaaggatttatcaggcaaacttgaagagcaactaaggttcagaggtagcagattagcacaattatcaaggtccactctggtaagtggcagagcttaaatagtttaaattataaataaaacaccatgcataacctgcaattactaaaacattctgcaaaaacagtctaaattatcatttagatgctgtaattagaaacaccaatctgccaaagctgatttctgatgtgtttccaaaatgtcaattttggaaattgcctctaaaatgttaaacagcctctcaaaacttaaatgattcttattgcttgcacaatggtcagagaagttagttaccataccaagaagcaacaacagagatgagtttggggtcagaatgcctggactgtatgactagttgggtgaccttaggtaagttacttagccactgtgcttcacacttcatctgtaaaatggggatgataaagttataactataatctatctcctggggaagttgtgagcaccacgcaagctaattcacatgtaaaatgctcagagaagtgcctggcacataggaagtaccaaacaactgtgagttatattactatttcatgtctaaagaaatcggcagacatttatacagctgaaaagtaaacaatctactgtgatatcaaaagcaaactattttttctttaatatccttaagcatatatcaaaaatatcagaatagcattttgatccatttctggaaaaaaaaaaacttagaaagctagatctgatttgtgtgtgcttcaatttacaaagacaagaacaaccaaacaaggactcagaaaggggcccttacttccttccaaaacctgaggtatcccgataatcttccaataaatctccttttctgtaagagaatctgagttaggtttctatcagctggaaccaaaggagtcctgttaaatacacataaatgagcctgagaaattcaagtaaaccttcgtgagctaaaataagtccctccactacttaccatagacatataaactgatttgcatctgcgcccatcttggtattttttactcctataaaggccagtacggccttctgcaactctatactctcccggatttttctcatgtctttattgtttttttctactctacccaaaggctgagtaaggttaaaactgcaggctaggaaaacaaacactcttctgctctgccttcttttttgaggtgatcctatccatcccaatggttttaagtaccatctgcacgctgtccagaggtaaatgtaagtaccatttcaaaccccttatctgggacgagcacggtggctcatgcctgtaatcccagcacttgggaggccgaggcgggcggatcacgaggtcaggagatccagaccatcctggctaacacggtgaaaccccatctctactaaaaatacaaaaaattagccgggcatggtggcagggcctgtagtcccagctattcgggaggctgaggcaggagaatggcgtgaacccaggaggcggagcttgcagtgagccgagatcgcgccactgcactccagcctgggagacagagcgagactccgtctcaaaaaacaaaacaaaacaaaacgaaacaaaacaaaacaaaaacccttatctgagttctgaattcacacattcaattgcctataacttcccttcatgtaagtttctaggcatctcaaacttttcacatctaaagtggaacttttaattatatgcctatcattccctacaacacatctgtcctttcttttgtccccttctcaatatatggcacaatgtaaatgctccagcaagaaaccagaaaatcagtcttgattccttattctcccttactccaaatgtttaatccatcttcaagttttgtcatgtctatcttcaaaatatatcctgaaaccatctgtttcctccatttcacctaccaccagcctgtgcaagcctccatcgtctctcttagctcagactacctgcagcaccctcctttcagataagcttgtttacacttgttctgcaaccacagtgatcctttgtaaatgtaaatcacaaggtgccactcctctcttaaaatctttctgtggattcccactgcatttataacaacatccaatacctttgtagtgctcacctgttcctgcagcatgatttaccctgtgtctcttttctattctcatctcaaacaacctccttttccaccacacattagtcattggctcctaaataacattattaaacttgcttcttcaatagactgtgatatggtttggctgtgtccctaccaaatctcatcttgaattgtagctctcgtaactcctaagtattctgggagggacctggtgggagataattgaatcacgggggcagttcccccatactaatctcgtggtagtgaataggtctcacaagatctttcacttggctctttttctcttcttttgtctgctgccatgtgagacatgcctttcaccttctgccatgattatgaggcctccccagctatgtagaaatttgagtccattaaacctctttgttttgtaattgcccagtctcgggtatgtgtttatcagcagtgagaaaatggactaatacaggctgcatgcacttgtccctctgctttttgcaaggccacatttcccttattaaaatttccgcttaaatgtagcttcctcagaggctttccatgaccatccttcaaagtagatgcccgtcctgtgccactgtttcttctctctacaccagatcatttcctttaatgcatgctaactgatcggctgatcaccagctcaaatgtcacctatcttctttgtaaaaccttcaatgacctttcccaggaagatactggcacgtcccttaggtttcattacacctgaagaaaacatttatcttggtggattagcagtgccctgtaattagcataccactaaagtgtaaattccttgaaggaagaaacatttatctttctatccccagaacctagcatgatgtttgaaggatctaataagtgaacgtggaactatacttacacttgctctaacattaacctttaagtcacatacagcttatattctcagtggggtcagtatcataaagaacaaaaattggctccaggggatagagtgggatgaaaaagctacggtttttggccctctcagactcaaccatacccaaaaaaatttcattctttaagtatttaatttctaacgttagggagaaattgacttacatctaagttacttaattcttctccttggataatcaagaaatggctgagataatggaaaaaaagcttgagaaacactgatataaggctttttcctcaatcacccttctttctggagttcctgctcatgcccttattctcagctgggaccaccgttttccaccctactaagccaaatcttatctttgaaacctcaggtcaattttattccctccatgaagctgcttcttctagcccacattccttgttccttttttcaccagcccataagcactcacacttatgggtctgtaatataaaattctacacctaattatgtactaattcattctttgatgaattcaaatatgttcatttctcttttccactataattgaagttacctgaaggcagaggccatattaaaacattcgttatgcccctccctcatcagacctaatataatgctcaaacagaaaataagtacaaaataaggcagttgattactttattaagtagaaattctcattattcgagctttagttaagcagtattcaaccaaaatgttaacgtataaaagcaaatggtaatagtgaatcaagtcaagcttaacagcaataggcaaaaaatcccaaaacacacaggaagagcatgcaagtcctctgaaggcagactgagtctacgtgatccccttttaagtgtttagtacagtaccatgtgtagttaagaatataaaaataagacaatgacaaaaagctgaaatcaaatgatagcaaaatacaaaattattttctgttatttggagagaacacagtcttccattaagaaaagcactgaggccaagcgcactggctcacatctgtaatccaggcactttgggaggtcgaggtgggtggatcgcctgagctcaggagttcaagaccagcttgggcaacatggcaaaaccctgtgtctaccaaaaatacaaaaaattagccacgtgtggtggtgcacgtctgtaatcccaactattcaggaggctgaggtgggagaattgcttgagcccagaaagtggaggttgcagtgagccaagatcgcactactgcactccagtctaggcgacagaatgaggcactgtctcaaaaaataaataaataaataaaaagaaagaaaagcactaataaagtcaaaaggaaaaaaattacaggctatttcaattttcactgaaaatccttgtactaatgctgcatcaactctataaactagcccttggtctgttttcattcctctacatactttactagttgaaaataagtctgttaaacttacatggcatagaaaaatgtgtaactttggaattctggataatttttaatttttttcagatgtttcttttgcagaaaatcactgcacctacctttgatctgtctttgaagtggtaggaaaaatgtcttcttccacatctgattcatctacctcaatcacctggcaaggaaacaaagcaacaaacagtttttgtgagaatagactctgaataaaaatgaaaatgaagaaatgaattacacgattaaatcttaagttatatatgagccacaaaaaaggagacagaaagccataaccattaaaactaacactcagtctgacctccctccaatgtccctcttcattcacaaatgttactttttgctcacctctctcctggccatcccaggagcctgagcacctaagggaacacagttacactggtgaatgacttgcataggctcatatgcagaccttatgactttcctcttagtttcttatgagaggtgagaccatcagtgttccatctccaactttaaatgaggtatcagaccatgtgggaaatactagatatctttctgttaaatctgtccctcttaaataccatttgttagtgttaagacccaataaagatatttctgactgttgattctaccacccaaaatactatttctctacattttgttatcttgacatttgatacatacatttgccatatcttcatctaacttaagtacagatgaggatgaagccaaagaccaaatactgaacgaacagcccctgaggctaaggatgctgttaaatatcctacaatgcataggacaacccttcacaacaaagaattatctagtccaaaatgtcaacagtgctactatggagaaaccctgatgtaaagggaagagtattggctcgggagttaagacacacagttttgaaagtgaagtaataagagaatcaagcccatattggactcttcttggaatcgaaaggaagagcagaaggcccaggctaaacctagggcaaaccacatggatcgctggactccagccttttcattcatcttaagtctagcaacagctgttaaggcacagctagtattttgggaagataagtaacaaaaggaaatccagcatagaaaaaacctctataaccattgaactcaccttcaatattagtattccatgtatgagctcttttggttcaacactgttatccttgaaaacattactgtatacataacatttatggatttctataataaccattatttaaaaaaagagagcaaccaagaaaaaaaaaatcaaatcctagaagccctagagataattggtaaagctccttccagctttaatgttccataatttttcttcttttatttactttgtaaatcagagagttgacaattcataatgcagaaaacataaattattaatacacaaccataaaactttttttcttacctctgaataattcttagtagtgacatttcgggaaggctgctgtcttgtagatttaaaggctagaatgaaaaagatgaaatgtgcattatgttattcttaaaataacttagaaaaacttgcatacttctttagctaaagattttctgagtcctatctgcaaaactgaatgatgcctaattataaaactatttgatatttttaaaaatctaaagggagatagaattataggtacgcataactcaatgcccaactgtcagtctcattatttcccagcttattgagatactgtagtgtttataaatacacacactaaaaatatttcatagaaaaacacctgaaggataaaatctaatcacctaaccaaatgaactacaaatgtattgaaggaaagcctcctaatcccttctttgttgttgacgatacctttatccctgttgctacattaggagccatggggttccagtagtttctcattttcctctaccttagtagccatattcaatatctaagaaatattccagaggagaattctagaaaacagcattctatgataaaaattcctttgtatccataccttttttccttttaaacttggttagatacttgaagtttagctagctctttatctttccctttctttttccttgacatcgaaacctacaataaggccaggcgcagtggctcacgcctgtaatcccagtgctttgggaggctgaggcgggcggatcacttaaggtccagagttcaagacaagcctggccaacatggtgaaaccccaactctactaaaaaatatataaaaattagccaggcatggtggcaggtgcctgtaatcccagctacttgggaggctgaggcaggagaatcgcttgaacccaggaggcagaggttgcagtgagccgagatcgtgccactgtgctccagcctgggcaacagagcgaaactccgtctcaaaaaacaaaacaaaacaaaacaaaacaaaacctacaataaatttcaaacgtctaatttaggtttattttctcctatgccttaccagtttgctaatatcaaaaatatcttccccaagataactcacaaactaaatagggcacagaaaaacaaacaaatactcaaaaaatcctgcaaagtccaaaattctcctagtcagaaaactaacgaatctttctatctaacctaaatttattgtgtttgcacatgtttcctattctaggttctgtccccaaacttgtaatatctaagaggagaaacgagaggcagaaacagtgttcttatctgctttactcagttacttttttcacatcctactctactcaaaaggctagacagagcaactgaataaaaaatccagtgatcatgatgatttcaaagaatatttctgttcagtatttattcactgactcctttaactctgagatcctagaaaacaagatacctttctttttatcccactggaaggcaaaagatgagtgatgttgtgaaataattttatcagaaaactaagcaatatgttctgttaggaagacaataaagtgtggtggttaaaagctctggttttggagttagactcattttgacttactagcttgactatggccaagctccttggcttctttaaaactcaatttcctcgcctgtaaaacagtgttaatacttcatgcagaaaactgctgagagggtaagaggaagtgtctagcagatagaaagcattcaaatacatgtagctgtttgggtagcaaacatagtagcagcagtggtacccatagtggtataaatgaaatgtaaaggccgtgacttcagaggtacttttattcacctagccactatcctctgctgactaacttcaatggaaaaatctgggctgtcaactcctatttacaactcccgtggctacaagtgtaatttttatcttttccaataaaattgcagcacaataataaatttccatactccatggaccttgttataagagaatttgacctttatttatctcttcactcctccatttaaaacagagatctagaagttacagtcttaatttgttgcttctgtcccaaagtgatgacaagtatagttactacttcacaggtattctgtcagagacttaaaaaaaaacccaccaaatccaacctgataaaaatgtttcacaaatttatacttaaaaaatcagttcatttttcaaaaaaaggcctagtactggaggtaatcagttaagttagcgaaaccattatatcaaatcaattagataaaagacaaatttagaccaatgattcacataatattcatcttcataatcttattgcaaaacactaccactaatattaataacagctatcatctgtcgcatttttaccaggtgctgtgatcagtactgtaaatacttaagctcatttaataaaattactctgaagtcagtacaacattgtcaaattttatagctaagggatctgatgcttgtagaataacaccagtttgcacttactgagggcttaatatgcatagacactgcctgatacttcacatgcattttctcattaatcctcaaaataacgcaatgaggtggacgcaatcattgtcccatcctacagatgagaacactcattcctaaagatgaaaaacttaacatatttgctggaggacacacaactagtaaaattgagaagtcaggatccaaaccaagatcttcctcactttagaaccatggtcttcacccttacgctacacaatctccaagtaatttttactcagtcattgtcaagtatttaacaagcatctactatgttatgtgccaaatatagtggatacagtgatgaggaggaatgatgcagacccctttctcacagcacttacagtgcaagggtgctaagccagcagtaaagagctggctgtgactgacccaatggacctgactccagagcctgcattcttaaccatcatgctctgctgcaaaaggtaccataataagatttttgcttacaacataattcaggaaatctgacgtttcgtatttagtttatttacatagcctcttttcatagatgaatactgtttccttaaaaaaattagtcaagccattctgtaaaacttttaaggcatcataactggtctccagtctttctacacaaatagaagctttattctatgttgtcaatgggtaacagtcattgcaggctaggttattcagacaaaatgacctctcattgtcttcaaactcacttctgctgacaacaatccaaattagtacctcaaacatttaaaaaaaaaaaaaaattctcaatggcattgaagagctgatcacataccaaggaattaccaggccaaaactgaagaaaagctagaactcagagaggtaagcagagtcctttccctgagttcacttttcaattgggaaaatgttaacattggttttgagaatcctgaagaaaaatagagagggctaccacagcccacggctgcccaaagtgaaaaccccgatgcatttcccttcctaaggtggagccccagtggttgaagagagaagcagaggtaaacaggatttcataagcatgtaactgagtaccctcatttttctaagaggtagttcattactttttctctctcttcttttctcctttcccccactttctacttagttctttagaaatgcaactatagtcttttacttcctcttcatcagagactccctaaaaggggagttcatctaactatgtgcttggaagctccagagttgaactatcacccaccagggggttgcctctagagataacagtcaattcacaatccaaagtcctgctatgaaactctcgccaacctagagagtattcggccacctttatagcctatttctacccatgaagatgccaattcaactgcctggtagataagacaccaaactagaatgcaaaccccccacttgctcgcttcctcccctgcatgccactcctgataggtcccctttaaaagagtccactttctgctgcaaagggggaagcagtacccttaaggtaggaagcctgtatttcttcccctaagttcgctttggaataaaaagtcactttctttataccacaccttgctcttgttaattggactttgcaagcagcaagtgactgaacctgcattttagttacaagtacgtatcaaatgactggtccaagaaaccctcaaatttagcttaaagtggtctatgacttgtggtgccctacaaacctagagaaacaaacgtgaatcttctctgaaggaagatggcttcatccaaggtctcaaattattcctgttgataattttctagggacagtaagtaacaaagcatggaaggaaataagtcaccataaataagaacccacagaaacagacaacagaaagaggccaaagacattcagacactaggttattagatacaaaataaaagaagtccttactgtgtacacacgaaaaattaaaacaggcctaaaaatatcttcagaaaacttctaaaaactattaaaagtgacagagcatattttaaaggaagcaaataggctgggcaaggtggctcatgcctgtaatcccagcactttgggaggccgaggcaggaggatcacatgaagccaggagtttaagaccagactagccaacacagtaaaaccgtgtctctactaaaaatacaaaaattagccaggtgtggtagtgcacatctgtaatcccagcgactcgggaggctaagacaggaaaattgtttgaaccccgggaggcagaggttgcagtgagccaagatgatgccactgcattccagcctaggcgacagagagagactctgtctcaaaaaaaaaaaaaaaaaaaaaaagtgatcagaaataattattcagaatgtagcacagaaagagaaaacagaaaatacaagagtcatgtgaggagagagtaaagaggtcttatcattatttaactgaagactcagaaggagaataagaatagcatagaggtaacatctgaagggataatagctaaggattttctagaagtgacggaagatagcagttcagagattcatgaagcccaataattgctaagcaggctaaacaagagtaccatctttagattcatcacagtgaaactgcagaacaccaaaaacagcaagctgagagaaaaacaggttattttttaaaaaacaaaaaccaacaagcttaactgatatctgatttcttaattacagtggaaactcaaagacgactcattttaagtgatgaattctacccactggagtcaaggaaagcttaacataaaacaagccaggacactggattccacaggacacaaaaacacaaaaacaaaaaagaaaaataaaacaagacaggacaaaaaaagacgatttgggctaaggtaaaggtgggtaatctacatctatgactctgtcgattgcatgctaaccaattttggtggtttaacatggaagtgttcattattttattcactctttttctatgttcctgttttctcatttttaaaagaacacttgataaatgcctactgtgccaggctttttgatcatttaatcttcagaataacccaatacaatagagattattatttccaatcatatctaaacaaactaggagagtgactgatttgtctcaagtcacaaagctgtcatttgttgaatgcaaggttgaactcagcatgaatcctttacaattttccaggctgccttttctctctttcttcctctctgcttttatattaaacctaccaagaatggaacagcatctttccagataccactccctaaatggcaataaagacaacatgtttgtgaagcaaaaagctaaggatcttagctagctcttctgaagtactaaataatacttgagtaaaaatatagcaatggaattttttgtaaggtttaagagtcatttaatcaacctgattttgtatcttttcttcaatgtcagctgtcatttgataaatgttgaaaattcctttaatggagtgatacttacttccaaggcaaattagtccatctttatattaattacataggttattctgcataatgcaaaaattattctatggagaactagtagctaggtctctaatcttaccttgctctggaaactagtacagtggtcaactactggttgtagagtgcagagaatgtgagatcattcccagatctggtactgacaagttatgagatctaggataagctacctatctttttaaagcctgtttccttttctgtaaaacagaaataatatagtaagtacctaccccacagacctgttaagaggcatgcagtttcataaatattagctattattgctactattagtggttttatcaactcagggcaaaactgcttggcttagttccctcacatataaaacaggggaacaaagttgttcttaaatcttccaggtccattctatcagatgagaaacttaaatcagtatgtttctagctattcccatccatccccattgggccaggagttcttaagctggaaaacacgaatgcgcctcatgggagtggctgaaccctttgaaattgggtgcaattgcatgtgagtacttatttaaggagagaagacatagctttcatcagatttttagagaatccataagccaaaatagattaaaaagcattgcctttgggactaaacagatcaaatctattcattccacattttacacgatagaacataatctacataaagatctgaatgtttcccaggttagatatcctaaatcctaagttccttcaaccaatttttttttttttttttttttggagacgctccgtcacccagttcagtggcatgatctcggctcactgcaacctccaccttctcggttcaagtattctcctgcctcagcctcccaagtagctgggactacaggtgcacgccgccctgcctggataattttttgtattttcagtaggggacagggtttcaccttgttgcccagactggtttcgatctcctgagctcaggcaatccgcccgcctcagcctcccaaagtggtaggattataggcatgagccactgcgcctggccaaccattttttatattatttggtatctcttctgaatgatcatatatagttgacagtctccttgaaatataattccaaagaggagtacagtatccttggcatgttatggccaatttagtacacagagagaacttccttgctgtgcaagcttgtccaacccacctcattttgttattgtttttgttctgttttcgttctgttttcttttgttttaggcttttagcagctgaagccatggtttttagtttctgtcgctagtgatatgaggaaaagaaggatgagaaaagggctttactggcccaaccagaaacagaaactaagaatccatgactgtattctctcccttggacacctctgcaagactcattaaatgctgtttaaaatatcaatagatttggacagttgggtatgcctgcataactcttactgacctaagtctttttcacctgggttgctgttaaactcacatacctctcacaactctacttgtgcagctgtccttttggacataaatgtggtttatattacccttgataaacttcatcttctgagaattagttcagctccccagtgtgtcaacaattaatcctagctataagattataaatattacaattataatatttaaaaaatatttataattataaaagtgaaacaataacctcaaataactgataatataaataatatacatatgaatatattctaaatgctaggtagaaaaaagtatcaccacctatcttaatgcatactttttgtaaatatgactaacattttaggctgatctcatcatctataatattaaaaatagttaaacagatccccttgaggccaatttttagaccataggatatacacaaattaattccaagggcctagccataatttctcttaaatataggtcacatgacttctctatatggaaagcagagactgacagggcagtatgggggaagcaaggaaacagtagagacagttcctctctctttcgaccactgtccatatagtgaccaactacttcactttcctgtttccagggtctctctgccaaacagaaacagcatttgtctgaaagtaagaaattataaaacataatttttgttttgttttgttttgtttttgagacggagtctctctctgttgctagggtagagtccaatggcatgatcttggctcactgcaacctccagttcctgggttcaagtgattctcctgcctcagcctcccaagtagctgggactacaggcatgtgccaccacgcctggctgatttttgtatttttagtagagaccgggtttcaccatgttggccaggctggtctcgatctcctgacctcgtgatctgcctgtctcggcctcccaaagtgctgggattacaggtgtgatccactgtgcctggcctataaaacatgattttaaaagcttaccctcttcagtaactctaatgcatagcaaagatcttttaaaaaataatttatcctgtgatcctaattgcccttataacttcccaatgattgcaacacaaataagggctaccaatggtgattaccttggtctttctaatgttggaatttataaataatcacttgcagtctatactcaccatctataatagacatatttctagatgctgacacagcagtctttgagttcctgctacgggtagaagtctccagaccagtgtctgctgttagaaaaatgaacagtcaatgtacaagcctatcagcagctaaggtttatttcatacaacactaaaaaatgaaagctaaataaacttatgtcaaatagtttgtctgtaaaaagccagacatatatataagaacaaacatctagagtctgaccaattttcagagactattcttttaggccacacttcagtttatccaatttaatttatccaattaaaatgtaaggaaataggctggacgtggtagctcacgcctgtaatcccagcactttgggagacagaggcgggaggatcacttgaggtcaagagttcaagactagcctggccaacatggtgaaaccccacctctactaaaaatacaaaaattaactggcatgatgatgggcccctgtaatcccagctacctgggaggctgaggcaggagaattgcttgaacctgggaggcggaagttgcagtgagctgaaatcgcaccattgcactccagcctgggcaacagagcaaagacaagactccatctcaagaaaaattaaaaaacaaaaataaaaatttttaaggaaaaattttgtaaatgtaagaatagtgaaaataatcatcattaaaagatgaggatttctctccctggagattttaaaccaaattaatattcatttcaccagcttaaaattcctatggatgcatatttaataaaaacaattttaaaaaatctttagagatgaactgacataatgtgtgagaaagtcactgagtgaccaatttctattggcgtgaactattcaatgacaatagtctcacagtaaatacaatgttgactatgttaatgactagttttaggaatcaaattggggggcagttttctttcttaaactgactttataaagactacttgataagcatatgtgtatttgtatcttatgacagtaacaaaaataataattgtatgatctggagttttcctcctgttgccaaaggcttttagctattttctttaacaactcatatttgcctattactttgcacatgtgaaaatacatatgacattaaatgtatccaaaaggtactacgtgacaaacacagtgaagcttttataaggtatgtgctaagaacaattaaaaccctaagtgcatgtggccattcaaaatttatttaagtaaaaggcacatgtcagaactgccttaaagactgtctttatatattataaaaatagatttttaaagaaccgtgttttagaaataaaacttataattcaactctgacaagatctaattctgtattttccactcaactgccaagtgtgaatgtgcacaggactgaactcagtgctcacctcttcctctttgagaccctcctctcgatgctgaattctgccctcttccacctcttcgacctcttcctcggcctcttcctttgttggttgctgctgagatgctatcatcagagtcattagccatctgttctgctaaatctatactcataaggtcatcagcactaaaggcagaagcagactcctctgactgagatctgagtgctctggccctggtcatagcctaagagggagaagaaggagaaagtacacacaatgagataacgtaccatcctaaaaatcattaatttaggcattgacatgaactaatcatactataaaaacataaaggaggctgacacagtggctcacgcctgtaatctcagcactttgggaggccgaggcgggaggatcacttgcacccaagagtttgagacaagcctgggcaacacagcgaaaccccgtctctacaaaaaaaaaaaaaaaaaaaaaaaattaggcatggtggcatgcacctgtagtcccgagctacacaggaggctgaggcaggaggatcacttgagcctaggagatacaggctgcagtgagctatgatcacaccactgcactccagcctgggtgacaaagagagaccctgtctcaaaaataaaaataaaaacaaaaaatatttatatatgtgtaaaggagaacctccccaccaatcaaatttaatacttattatctgtcagaccaatctaccatactacctataaaatgagaccctttgaaaaggtttaccaagaaaaataaaattttacagaatcaaaattttcagaactagaaggaatactggcaatcatccctaattcaatgccacatttgacagtaacagactgtcatcatttgagctactttttagaatcggctcctaggaaataataagaaaaaaacttacaaaaaatagccgttatctctgggcactaatattttagggtgcttttgttttttgttcttgaatattacatattttctatattacactttttctaaaaaattagttttataatcagaaaaaaacatgagtaacaatctctcacaaatatatggtaaagagaattaagggctgggcgcagtggctcacacctgtaatcccagcactttgggaggcctaggtggatggactgcttgagatcaggagttagggaccagcctgggcaacatggcgagaccctgcctccaccaaaaatacaaaaaaaaaacacaaaagaacaaaattagccaggtgtgatggcatgcacctgtagtcccagctacttgagaggctgaggtaggaggatcgctcaagcctgggggaagcagtggggaggggagttgttgcagtgagctgagattgcaccactgcacttcagcctaggtgacacagtgagaccttgcctaaaaaaaaaatgaaaagaaacggaagaattaaggagaatatatcaactgaaagcctaagcctaagaaggaataaacaccttaggaccaagaacatgccacgcatttttaatttggtaagaatccatttagaaaagacatcgtgccactgcactccagcctggcaacagagcgagaccctgtcaccaaaaaataaaataaaatataaataaaagcaattttgccttgatcttcccttaaaccaatcaaaaggtagtaagagaacaaaaacaaaatacattttccataaaattaaaaaatagttccaaacccccaaacacacaaactataaagaagagttaatgaatatgataaatatttgacctagctaagggagaaaggtgagaagagtttcaggtattatacagctctccaaaactgatgtataaatcccaagaagacatgataacagtctctcttgcttggaatggcagttctgggtctaagaatagctgaccagaacatttctaagctctgtgataccataaagtaaggagacccagggctaaatgaggagatgtgaacaaggcaggcagcataaagtgggactgaagtggcaacttcatgatgagatgatctcagctgaggtgaaatcacagctaactcactgcatgcagggttcaatacagcattacaatgcaaaaagaaaacacttcaggaaatacaacaaaaaatataagaaacaacagtgatttcaattcatctttcctgtcccacatgaaatacagttaatcctcattattcattaatcctatatttgcaaattcaccgacttgccaaaatttctctgtaaccctaaaaatcaacactcacgatacttttggcatcatttatggagacgcagagtggtaaatattttgaattgcctgacacacatattcccagctgaggctgaacaatgagccactctgccttcttgtttccacttgtgtactttaaagtgtcctttctgtgatagtcatgcattgcttaatgatggatgcctcatgagaaatgtgtcatcaggtgatttcattattgtgcaaacatcatagtgtgtacttacacaaagctaaatggtacagtctactacaaacccagactataggagatagcctattgctccttggctacaaacctgtacaacatgttactgtactgaatactgcaggcaattataacaccatagctatgtatttgggtatctaagcatatcttaatagaaaagatatagtaaaaatatggtattataatctcatgggaccaccactggatatgcagtctgacatcgatcaaaatgttgtatgtggcacatgactacatatttattgcattttctgcatttttgtacttttgctttggtaatgtggtgttttcaaatgaccccctcaacatgtttagtgttcattcctacatgcaaaaaggctgcaatatgacttttggagaaaaaatgtatattagataaacttaattcaagtataagttaaagtgctactggctatgagttcaatgctaatgaatcaaatgttaaatacagtatctttaaacagaaacacattaaaaagattacgtattgatcagctgacaaaaacgttatcagtggctcatagaaagctaattttgtatttcccctaggagcaatgattcaccatttgctaattctgtgctggaagtgattttatacgacataactaccacaaataaaaggaaccagctgtatgcttttagaaagcagacttaagagaaaaaagatgatctaaatcacataattaataagatagatctaattgataaatgttgaattctatacactgaaaattaataatatacttcaagaccccatgaaactttttagctgatacataacagggtgcaaacaaaaatctcaatacatttttgataggagaaataaatttatcacactgtctaatcatcatgcaataaaataaaaaattaataataaagcaaaaacctgcctcctgaaaacaaaccagagtcaaaactataaaacaaaacgaaagttgcagaacatctagaaaatcataacaagaatactgaacatcacaacatatgagagagctaaagcaatgcttataagaaagcctatagcctgctaagaataaatgtaaataagttaattctgtatccaaaaagctaggagaaacaaaataaagcctatccaagtattagaatgaagatgaaaccatatattaatagattttaaacaaaaacacattagaatgaataaatataagcactggtcctttgggacaaaacaataacattaataaaaatcacaaagctttaaagaaaggaagaaaacacaaatatacatcattagaaataagagggacgggcgtagaggctcacatctctaatactagcactacaggtgtagaagctcacatctatactttgggaggccaagtcaggaagatcacttgagccctggagttagagaccagcctgggcaacataacgagactccgtctatataaaaaaaaaaattaaaaattagctgggagtggtagcacactacagagcaagaccctgtctcgaaaaaaagaaagaaggaagaatgggagggaagacccaagacttatgagagaatgctcaattctaaataatctggaaaatgaataacttaatctgatccaaggtgggaaaaaaacaggttcaacaaaccaattatcaaagaaaattttgagaaaattattaaaagaaaaatactcccaaaaaaggaccacaatcagaaagtttcgtaggtaaattctaccaaactttcaaaaaacagataagcccactgctatttcaatagtgccagagcatacagaaagacagcttccaaactgttttcacaatgccagtatgacacagtactgacaaagaactgcgtgcacaaaaagaaaattacagaatcttatttataattatgaaagcaaatagagactccagaagcttatggaaagaccaatatatccattaccagggggtaatggatatattaccaggatgggtcaataagctatgtacataataatataactcactatattaatggaacaaagaaagaaaaaacccaaatgtatatcttcataaaatcagaaccatgtaatcaccaatcattcctgatttaaacaaataagctgatgaataagtggatactttatgtgtcaaaaaaccctaaatatgctatattactatgtgtatatatccagagagagaaagagagggcacacacacacaaatgtgttcaagtgagtgctcttacaaatcaattagagaaagaccaatacccggccaggcgcggttgctcatgcctgtcatcccagcactttgggaggccgaggcgggtggatcacctaaggtaaggagtttgagaccagcctgaccaccatggtgaaaccctgtctctactaaaaatacaaaaattagctgggcatggtagcgcgcgctagctactcgggaggctgaagcacgagaatcacctgaacccaggaggcagaggttgcagtgagctgagatcacaccactgcactccagcctgggtgacagagtgagactttgcctcaaaaaaaaaaaaaaaaaagagaaagaccaataccctactcgaaagagaaaatgtggccaaacaaaatgaccatgtgtttcatataaatacaaatgatttataaacataaaaattaggcagactcattagtaaaaaaaagtagtatgaactgaaaacaacagtaggaaataatttcttaccccttagacttgtaaagatcaaaagatacagtaatacatcacgatggtaaagatgtgaggaaacaagcactcccaaatactaatggtgagaatataaactagttaagacatctttggactaatgtggcagtatgtagcaaaatttaaaataaatatgccctattatgattacttcttggaatcaattactaaccatcatttctaaactttgtattttccctttgtctaaatactgtatcttcatttttatcatctcaaattgtatattcaaattgtattttaactctacctttcctatgaaaaacagagtttactgttatctttggaatgtattacttctaagagcttaactcatgagtgcaggtctagagccaatggcaaaaatgtttccatatacattttgtgagatttgaaaacatactatcctactgttaaacactttttttttgtggtgaaatatacataacataaacttactctttttaccacttttaggtatagtagagtgacattatgtacattcacatggttatgcaatcatccccccatccatctatagaactttctcatcatcccaaactgaaactccatacctattcaacagtaacttcacattcctccctctccccagtaaccactattctaccttctgtttctatgaatctgattactctaggtacctcatataagtagagtcatataatatttgtccttttgcaactgtttttttttcactcataatgttttcagagtttcatccatattgtagcatgtatcagaatgtcattccttttcaagactgaataatattccattacatgcacataccacattttgtttatccatctatctgttgatgaccaactgggttgtttccacttttcggctattgtgaatcatgctgctacgaacactgatgtacaaataagttcctgctttcaattcttttggttatgtacctagaagtgaaattgctatattacatgataattctatgtttaactactttaggaactgctatcgttttcctcagtagctgacccatttttcatccccaccaccaatgtatatggttctaatttctccacattcttgccgaaacttgttattttatggtgttttaataacagccatcctaatgggtgtgaagtggtatctcactgtggttttgatttgcatttctctaatgtctggtgatcttgagtgtcttttcatgtgctataatttgtaaagcttctttggagaaatgtctattcaagtcctttgcccattgtaaaaattgggtttttttgttattgttactgttgagctttagaagttttaaaaatatattctgcttattaatcccttatcagatgtatgatttgcaaatattttctctcattctgtgggtcacttcttcactattgatagtgcctggtattatattttgaaagagggtatcaacccacctcaaattgaggtagaacataagaaatcagaggccaggtaaactaacgactgtgggtaagactaagaatagtttttatatttttaaagggccattaataaaaaaacaaacaaacaaaaaaacacaagaatatgtgatagagaccacacatgtcccgcaaagcctaatggttactgtttgctcttttattcaaatatgaatttatcattaaagaaaagatttgagagtttttctatgtgaacaaaagattttttttttttttttttgagacagggtcttgctctgtcatccaggttggagtgcagtggcgtcatctcggctcattgcaacctctgcctcctgggctcaagcgatcctcccagttaagtctcctgagtagctgggactacaggtgggagctaccatgcctggctaatttttgtattttttgtagagatggggttttgccatgttgcccaggctggtctcaaactcctgagctcaagagatccacctgcctcggcctcccaaagtgctgaaattacaggtaagtcacaatgcccagcctgaaagactttaaagcatactgttttttctccaaatagaagagctaatagtcttgtttgtcagtataagtaatttaagcatggcgctgggattcatattctaagccaaatgattctgcaaagctgtgaattacagcttggcagagtttcagactccattacctaagttctaaatagtatgctgaaaatgaaaaaatatataatatcttatgatatgctgaaaaattacctaggaagccccaattacattttagtcttaaaatatagctgaatatctgaacttgtaagttatttcttctgtaaaactcccatatgaaatttgtcacagcctctcccaccttccttgtataagacgttcactcttaactcttttaaaagcttaatgaaaaattgaggtttgtcgcttcaaacatgaagaactcactcaaacgtaaagaaatatttctgtaccctgttaaattgaaagggttaatcaattttaagctagatatttaagaatcaggaatcatttcttcctagcattattcttgcaatttggcaaactatttctattttaaatgcaccttataagataaatagaaatataataaacgtgttaagccatttctaatctatagcttcttttccttagcttccaaaaaacaacctgtaaaagatacagtggttgcaactatgtgtatttcaacagtgattctgatgtgttgcatgacacttttagaagtttttcatttttagaaaaccatccatttgcaatgcaccgaattaatattataataatctaaaattttgataggacacaggatgatagaaaagtctacacttggagtcagaaatatgttcaaattctagcgccactccatgaccttgagtctggtctgtctcctcatttataaaatgggcacctaggaaaaataattcaataaatatcttccttacacaaatgtctcttatctactaaattgagaaaatcttgtggctacagacctcagcttttttatatgtacagtcctaatataaagcagaatatctaacccataacagggacaatataaaatgtttgctgaatgaaagcaatcaagacaaaactaacagtacatagtttataacttttaaatactagatagcaatcataaaacactaagggcaatcagaaaataagaaaatacatttcaatcataaattcaacaagtaccaggtagaggccccaaatttaagtaaatggttgctaacttgtagattcaaacctgcaatgagactgagaagacagtgatgatggtgcttaagctaattttaatattttagaatagataatagaaattgtctatttgcccatgcttgcttacttatggttaacattgctaaccaaaacactttaagtttcttttttgcccaaaataatatcagctcagtaagataagattttatctataagatgctctgctaacaaagagatattattttgagtaataggggcttttgttgtatatatccccacacacatacaattaaatgggttttatttatttttatttatttattttagagacagggtctcactctgttgcccaggctagagtgtggtggtgcagccatagttcactgcagccttgaactcctgggctcacgcaatcccctccaaccttagcctctcaagtagccaagactacaggtgtgagtcactgcacttgctaaacaggttttagacaagaacaaaatggaaaaaaagagcaatgagcagaatatttgtaggctgaactgaaatcaaccaaaagcagccatcctaagccaaccccagctcactcctatcccctagacctatggactgactattctaactaaacctactggttattctagtttaagaaagtgatatataaacacaagaatttgcagcagaataattacctcacggacttcatcatcttcttcattagtatttttttgtctggtttctctgaaacgacgtacctagatcataacagagtaaatcacaaacatgttgcctattccagttatgtaaatataaaacaaggggctacaattaagaaatgctttatgttataaaacttgcaaatttaacaatgtctcacaaaagtaaatcatatttttccaattattaacgttaaaattgcacaatgtactcttaaaaaaaaaaactcatattgacccgaagcaaaattatattacctgctgccaaaatgtttcacatcactgaaaaagtctttcagactgtacaggaaaaattctaataccctatgggtattacacttcagtaaactagttaaaaacaaaaatatctccttgacaaggcttgaaatatttattacattgcaaatcactcttgtgcaccttgctgcaagacatccaggaggctctgtgaaatgggatctgaagtgggtggcccctgaagatccatttttattaagagtcaactcatgaaggtttgctgagcatggtcctggtatcaagaaggagactacaggtttcttttttaatggttcctgctcacaaggctcttattatacagctatgtatatgttctttaagcccatttatttaataatctactcagcacatatttactgagcaccttcaatgtgccatatattatcgtagaaactgagaatacagttattaacaaaacagacaaaaagctgctctcatggaatctataatcaattgatgatatgggagagggaacagcaaataagactccaatgtaagaggctggagcaattagaggaatcaacaaaagacactgaaaatatgcagccagtgaggcaggaagataacaagagtctggtatcctgaaatccaataaaaaacatgtttcaaagaaggtcaagtgagatgtaagatagaaaactgacagtggatttagcaatggcagtcactggtgatcttgacaagtgcagcttcactagaatgatgggatcaggagcctgagtggatagatttaatagaaaatggagagagaagaatgagtcagcaaatacagaaaactctttgaagcgattctgctctagaagaggaacagagagcagtagctaaaggaaaatgggatcgagagttttgtttgtttcttaagctgaaagaaataacagcatgtttgttatgattcagtagaggaaaaatacaagaataacaatattttaaaagatgagacagtatgtaatcgtgccctaggtgataagtagcataccaaaggtgctaagccattcacagaagagaaatgagagtcagagtgggaacactgaacaggcactatgtgtcagacagtattctaaggattttacatggattaattcttctaatccttacaacaaccttgaaggagggcctattatcatcaccattttatcctcagatgaggatactgagggataggtgggtttagataactcaatgatgggtacacagctaataagggttttgattttgaacacgggtgtctggtcagagccaccatgactcacacacactctttctctttctctctctccctctctctctctctcacacacacacacacacacacacacaccccacacagactttgctgctcaggagtcatgatgtcactccaggtggggatggttatgttttatttctggtatgtacctgagaaatctatttatgctataaattagcaaacccaacacatccagagtcatagagtgaatggttttagagggtgaactgcctgtcctacctctggaagtacttggtattaaataatattagttacacattgacaccataaggctttaagagaaccatgttaaccaaaagcactaaaataagggaatgagttttttttttttttttaaataacattgttttgttcttctgcttagggagaatctgggaaatagagaaagtgatcccctgtaatataactaccttgacataactgttgataatatatctgggatattttctttatttacataaacatacacaattacatataaaataaaaataattgagattatactacgcagttttttatctttgaaatctttcccaattaacattagattagaaatatcttctcatgttcttcttccaaaatgtcatttttaagctgtgtaaaattttatatggtatatgtaccaacatttattgtatcaaaacatttccaattattccccactatgaacaacactaagatgaatcactccatacacaaatctctacctcactattttcatagggaaatttcccaggctgagttaaagggtaaatcttaagcctcttaatatactctgccaaactgcttttcagtaaagctattcaaacgtaatactactaccagcagtgtgctagatactatttttctcaaattgctgccaatttgacaaacaaaagatgtatttgagtttctttgattatcctaggctaaacaccattttcatatgcttattagctatttatatttcttttatgaaccacctattcatgtcctttgttcattattctatcaaatgtttaattatttttaagatttctaagagctcattaatattaagaatattaaacttttttctgcccacatacaaatattttcatgtcaatatcttttaattttgttttttgacaatgtgatatgcaaacatttataatttctatgtagtcaagtctagacagcttttcctgtaatttttccactgcttcttgcttagcagaaattttctaaatgaaattcaagatctcaatcaaaacttactaaaaaaattaaaatgaacaaaaattaccatcctacaaggttcactttaaagccctttcaaaggatctttaagagaagatactatccatggggaacaaaacactttagtaccaaccatatgcaagactctgttctaggcattttctacattttctaatttaaccttcattttatcatttcaattttatagatgagaaaaactaaacaaatcagagaggttaaatagtgatttaccagaaaaaaatctcagagctactcttaaagacagactatttaaatagacctagacactcaaattagttacttacctcctcatcgattttgtcttcgagggcatcaatatgacgttctttaagaaatcgctgtgttttttccaactggtatttcactaattcctcaatggcatctttctcctccttgtccacaaattcttgtactgcttcacccatccctctttctgttagcagtgagagctgcacattctgtaagatacaaatcactggatgcagaaatagtttttattccttacaaaataattatagatgagcaaggaaaattaccaaatatgttaccagagaaaaaatatagtgaacagctgtagttaagcctactaatatcaggaaccagaaaaagcaaagtcaaaaccagaaatgggggaggagtacaggacacgtgaaatgtagaggcctgatggctaggatatggagtccaaaaatggcagctatgattaatagagatgaaattaaccagtgtcataggcaaaataagagccccctaaagatgtccacgtcttaaactctgggacctgtgaatacatggcaaagaggaacaaaggttgctaatcagctgtctgtaaaatagggagagtatcagagactatccaggtgggcccagtgtaatcataagggtcctgaaaagcacaagagggaggcagatgggagctggaaggaaaaataactctggggaaatggttagagagatacaacattgcaggatttgaagataaaaggagagcaagagccaaggaacatagtaggcacctctagaagctggaaaaggtaagaaaatggattctcccttagagcctccaaaaaggaagacagccatgccaaaaccttgattccagtcctgtgtacgatttctgacctacacgactgtaagataataaatttgtgttgttttaaaccactaagtttgtggaaatttgtttcagcacccataggaaactaatacaaccggaggatcttagagtggcatatacttatgacgtaagtttcagtggcttcaccatcatttggctgtctttgtttgtagaataattctgaaattacatccaaatgtgagaaaactaaatctggattgagatctttgtaacagagatacaaataaagtaagaaaataacaacaacaataacagttatgttaataatggtattcacaattaacattaattaaacactaattttctttgatgtgcagcaactacaaatgaatgtaaatgtcaccctagttacttctaagtttcacttaagaatgtccctgatttaagttaaaattattcagtttaataattgcaacagagatacaaagaaagagaataacaacatcaacaataacagctatattaataacagtactaataactaacattaattaaacactaattttccctgctgtgcagcaactgcaaatgaatgtaattaattgtcaccctacttacttcatagaaacattttgaggattcattttgtttaaactatcaactaaacatatcctaaattaaaatctgttactataaggtagccattattcaaaatgtgaactgtaagaaattaccttctctgcggtttgaaagtactgttttacaagatcttctacccttaaagttgttccttctgaaggctttgtgataagtttcccaaagttgatctcttctcctagaaaaaaagaagtatatcaaaaaatagcttctatcataatgttaaaatgtgcatactcattgcaagttgtcagtggagaaggtaaggccaaactttagcaactgccagcttgctcaacatggtaaattttgaggcaaaacaagccatttttgttaatagccacggtcttttccccacagtcagtatttctcgttcatacctccaggataggtgtcttgtagctgttctcactgggtgaagcacagacttctggaggtcctcaagacccattcagggagtaataacgtcaaaaatactttcataataatcctaagatgttatttgccattttgccatctgccatcattgctacactgacgatgcaaaagcaatcatgggtactgctggtgccttgtgacgtcaaggtagttcggtattgatggaacatatctcaaaataataagagctatttatgacaaacccacaaccaatatcatactgaatggacaaaaactggaagcattccctttgaaaactggcacaagacagggatgccctctctcatcactcctattcaacacagtgttggaagttccggccagggcaatcaggcaggagaaataaagggtattcaattaggaaaagaggaagtcaaattgtccctgtttgcagatgacatgattgtatatttagaaaaccccatcgtctcagcccaaaatctccttaagctgataagcaacttcagcaaagtctcaggatacaaaatcaatgtgcagaccaggcgcggtggctcacgcctgtaatcccagcactttgagaggccgaggtgggcggatcacaaggtcaggagatcgagaccaacctggataatacggtgaaaccccgtctctactaaaaatacaaaaattagcaggggcgtggtgacaggtgcctgtagtcccagcgactcgggaggctgaggcaggagaatggcgtgaacctgggaggcggagcttacagtgagctgagatcacgccactgcactccagcctgggtaacagatcatgactctgtctcaaaaaaatgaaaataaaaacaaaatcaatgtgcaaaaatcacagcattcctacaccaataacagacaaacagagagccaaatcatgagtgaactcccattcacaattgcttcaaagagaataaaatacctaggaatccaatttacaaggatatgaaggtcctcttcaaggagaactacaaaccactgctcaacgaaataaaagaggacacaaacaaatggcagaacgttccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaacagagcccacattgccaagacaatcctaagcaaaaagatcaaagctcgaggcatcaccctacctgacttcaaactgcacaacaaggctacagtaaccaaaacagcatggtgctggttccaaaataagagatatagaccaacggaacagaacagaggcctcagaaataacaatgcacatctacaaccatctgatctttgacaaacctgacaaaaacaagcaatggggaaaggattccctatttagtaaatggtgctgggaaaactggctagccatatgtagaaagctgaaactggatcccttccttacacctcacacaaaaattaattcaagatggattaaagacttaaatgttacacctaaaaccacaaaaaccctagaagaaaacctaggcaataccattcaggacagaggcatgagcaaggacttcatgactaaaacaccaaaagcaatgacaacaaaagccaaaattgacaaatgggatctaagtaaactaaagagcttctgcaaagcaaaagaaactaccatcagagtggacaggcaacctacagaatgggagaacatttttgcaatctacccttctgacaaagggctaatatccagaatctataaagaacttaaacaaatttataagaaaaaatcaaacaaccccttcaaaaagtgggtgaaggatatgaacagacacttctcaaaagaagacatttatgcagccaacagacacatgaaaaaatgctcatcatcactgcccgtcagagaaatacaattcaaaaccacaatgaaataccatctcataccagttagaatggcgatcattaaaaagtcaggaaacaacaggtgctggagaggatgtggagaaataggagcacttttacactgttggtgggactgtacactagttcaaccattgtggaagacagtgtggtgattcctcaaggacctagaactagaaataccatttgacccagccatcccattactgggtatatacccaaaggattataaatcatgctgctataaagacacatgcacacatgtgtttattgtggcactattcacaatagcaaagacttggaaccaacccaaatttccatcaatgatagactggattaagaaaatgtggcacatatacactatggaatactatgcagccataaaaaatgatgagttcatgtcctttgtagggacatggatgaaggtggaaaccatcattctgagcaaactaccgcaaggacagaaaaccgaaccccgcatattctcactcataggtgggaattgaacaatgagaacacttggacacagggcagggaacatcacacaccggggcctgtcatggggttgggggaggggggagggatagcattaagagcaatacctaatgtaaatgacgagttaatgggtgcagcacaccaacatggcacatgtatacatatgcaacaaacctgcacgttgtgcacatgtaccctagaacttaaggtataataataataaaaaagattgctatctaatttttagaagacaagagaattattcccactgtcaatttgtttaagacattacaatcatattaaaacatcttccattattatgttacagtttttaataaagattccttcacaaatcctataagaacatttttttacctcataaaaataactagcttacctgttttttccttttgttctctatgcctgaaaaaatggataatgtcttttggattagctacccgatccacaaatttctggctaaagcgaagaacactgaaaggttcaaaacctccactatagtccacctgaaaacacagaataatctatgaacgctaggaaacaacaatttgccaatttttaaaacacacactaatccttcagtattcacagtgtttatgcttgatactttgaaatttatgaattaattttctacagtagatcatgatggagctatatcatttatcctactgagaaactaatgtttgaaaagtttataagcataagcaaaatactttgttcgatggaatcaaggtattgcaataatttccacaatgcagaatgattacatctccccctgataacactaatagtctaggtacctaccaagcaaaccatctgaaaacaattttctgaactttcaaaacaaacaaacaaacaaacacacaccaaaataaaatactagccttaaatgcattagtaaattggtctatcatcttagagatgtgcctcaagagaaagatgaatgctaggaacatccaggtaataaagaatcaaatctgtgagccttgagaaatgattacctccaaaacatggtatctcactgaaactgagaacttctctcaaggtagactctttctacagaagtctgtagtggtaaacagacctttacaaagacaaataccacctttctttctcagagatatgttcttctcaactagctgttcccaaagtacgctatggggaccagcactgcaccacctcacagcttatccagaatgctccctaactaaagtgctcccactttcactcatcatcactatctgctaaggttttttgttcatttatttgatatttgtgtatcatgtctctctttgcacctccacctcctgtaagctcgacgaattcaaaacctcatctgttttatcatccctatatcctgcagcatccataatagcaggtactcagtaagatttagtcaatgaattaatgaatgtcttttagtcagtacaatgtagttttgtaatattacttatatgacaatatgtgctgttttatgaatgaattcgtaatttactgtgcttaggaaaagaaatgccaattttctattaaagtctggttagttttaatgctgtgaggcagacacagatgagaaaattgggatcttttgccataatgaagagaactatgtgattcccttaaagtaattatttttgtattacccagaccatctctctctctctcttttttttttttttttttttgagatggcgtctcactgtcacccaggctggaatgcagaggcacaatctcagctcactgcaacctctgcctcccgggttcaagcgattctcacgcttcagcctcccaagtagttgggattacaggcatgcaccaccatacctggctaatttttttatttttagtagagacagggttttgccatgttgcccaggctggtctcgaactcctgacgtcagatgattcagccacttcggcctcccaaagtgctgggattacaggcgtgagccaccatgcccagccttacccagatcatctctacagctaccatgttataaaagacaaaatactaaatgctaaagctattaggtctctccttcaaacttctcatttataaatgtttggtcataacaaattttattggatgtcctcaatgttctaagtatgctgttcagggccagggatacaaccataaataaatacaatcttggctgtcaagaaattcacaaactgactgggaagaaaaacatgtaaacagatcactggaagcagactgtgagtggtgctataagaggtatgtacaaagttggatgaggacacaaaggaagaagcatgttctctgtgggcaggtcaagaaaggcttctttgaagacagaggctttaggtgggtgctgaagaaggtatagagaaaggaggagagaagtatgtcccacgcaacaggatcaacatggacaaaggttccagtgaaataaactccactgcacccaggggacggcagcttttttggtttagaccacatcatgtagacccctgaatgctaacctaaaaaagtttagactttttcctgttagtgctggggaataattaagttatttttagcagaaaagacatgcaaaactgtgttttacaaagatcattttggcattagtgtggagagagaaggaaactggaggcagagtcctggtaggaggctgcagcaataggccaggaagtattaataagggcttcactatgccagcgacagtgggataaagaaacgggaacagattacctactgtgcaacagacactatttaatccatttagatctcataaatctacgaagcatttggttggtgcacaagtaactgcagtttttgccattactttctacgacaaaacccgcaaatacttttgcaccaacctaatacaaaccaagggataagggatgcggttgctcaaggtcatacaactagtggttgggccagaatgaagctcaggaagtctggctctacactgtactctttacctccacagtctacatcccagtacttctcaaattttcatgaacatatacatttcttggagatttttgttaaaatacagtgggttctgatgcagggtctgaggctctgcatttttaacaatttcccaggcaacaacaacactgctggtttaaagactacactcctcagtaccaggcctcaggggactcctggagatacagaacaagaaggaggtctacgtaaagattttgaagtcatcactctattggtggtcattaaagctgtatgcctacactgaaaagagggctaactatgagacgggacggatacaaataactcagagaatgcccaagagtaattcagcaagatgagacacgatctattggattgaacaattaaaggtcatcttttccactggttatggtgaagtcagagccttggttatagtgaactgaagaagagaaagttaagagagatataggttatatacttttaggggcttttaaagagagtaagcaacatggggtaggagtttggaaaagggaaaagcatagtggtaaagaagaagtctgttgttgtttctttgtttataacacgatagaaaggataagcagatttataggcacaggaaacaatcctaataataaccaaaacaaataaaccgtacatagattagaaggatgtgttacggggaaaaaaataagaagaaaagaggaagcagaagaaggtaagtgaaatcagggcactggagagaaggtaggggctgcaatcttgatgatagggctgcagtgaggtgacacgggagcagactaaagggagataagagcacatcccacatgcccaagaaactgcgagaaggccaagatgcctggaatgaagtgagtagaggaggtagttaaagatgaagccagagagctcagccaatctattaaatataacaacaaattatttagaaaatgagaaaaataagttaccaaacctatcacttaaactgtgattaactcaaatccttatatctttgtttttgcctccgatggtgattgctcttcttattactatgagcactctcctcactacttttcaaagaaaccatgtaaactgtacattactatgctttgaaaattaataatattcaatctatataaataggacttactcgcagtcgtacaagaggcttctctggctggtgagaattacccagacgttcccgttcagcattttcaagcatttcttcaatctcaaaatttttaaaaagattaaaaaacaacgtagtaaactgagtttaacttggctgaatagcagcttattaccacaggaattttcctgaactacataatcatctttatttcctaggtcatttatgacaccttttcaaatataccttcttgtaatgctcctttaatactattccttaatgttttcctttcatgaaagttcttcataatttttcaatctctaaaataattcttttagaataaaacttaaaatattactactcatgtttcaataaggctttcctcagcttaccaacttaaaaccaagtaagtctagtttttgcagtcatatgatccatgggagactcaccagaagatttagggatcaataagcaaggactttagattatttatcttggaagagttcaaggtaaaagaaaataagactgatgttttcaaatatgtggagttgtctcatactctgagaggataagattataacatcttagacttgaaagagttctgaagacaaaagcacttgttctatattgttcttaagggtaaaaccaagttacaaggagacagcactagattattttcataaatggctgtgtgcacagtgattagatatctccagatggccaacttcatagctgaacaattctagttcttagaaagttcttgtattggaacaaaaactgccttcctataacttggtcctgatctcaagaacaatacagaacaagtgtttttgtcctcagatttctttcacatctaagactttataatcttgtcctttaaactgtctgtaacaatgaagtccaaaagagttttctgcaataattttttctatgtgcatattcaatatggttgccaaaaccatatgtggatatagagtacttgaaatgtggctagtacaagtgagaaactgaattttaaatttaaatgtaaataattaaatgtaaacgccacatgtgctagtgaatacatatcagacagcacagagaaaatctataagaatatgatctcctaggtcaattatttcaatccaacaagcatttatagagcatcattttgccaggtactaggtcaagtgctgagacagaaaagtaagatatgggtcctgtcctcaaagagttcagaagacactcacatgcttataaaaaataatataacttaactaagtacaataacagaaatgtacataaaatacagagataacagaaagttatgtgcacacctggtgtttaaaatgaacctctattactttgtgtcaccagcgtctactttcctctctggattcatgtcaccaaagcccacaggatttaggtgaagttcatacagtagacctcaaccagaggtgactttgcttctctaaggacatttggcaaggtctgtaaacatttttgatcatcacgaccagttagaaggggtactactggcatctagtgggtacaaaccagggagaatactgctaaacatcccagagtgcacagaactgcctcccacaacaaagaattattagtacaaaatgtcaactaagccaaagttgaaaaacccaggtctgactccagggaagggcacatgactcaggcctggatcaatcaatgcaaaagcaattaatgcattttctatctctttggcttgagagattggatttagggatgccagaatcttaatctatgtttgagtttctagagtcaatcatcttgaaacaagcgtacacttttggttacgtgagctacacactgctcaaaaagctgtgacactgaatgagtcaccttatctaaggttcagttcctctaaactatagatggtagaaactactcacatatagtattgttggctagattaaatgctgtcaacagtgcacatcacatacagtaaatcagtaagtatcactggtcataattattatcattgttactatgttacctgatttttcatgaaaagaaaacatagtaggacagctgacacagagttaagaactgagcgtcagcaagtgatgctaattaagctgtcaaaccacatattattaaatgcattaatccacccaaccttagtagtggctgaaattttctagagatttaggggtggcaatgtgcatagagagggaggtttgggacttacattgcagcaatagggtggatagcaaacacatttttcacatttcatttggggtagctttcagggtgaaagggacgcctaatacagattattagaagctaaggcttttctcacacacgatagtctcccattcctcaatcaaagttactgcctgctttcataaataaaatgaacaaatcatcaaatcaggattaaaaaggagaaaagattatgtattatgtttttgaaaaggaagaaagaaactaggagagagatttaattttttttaacatccagtattcctctctctcaatgacttaaaaaaaaaaatcttggacacaattaaacacattcactgaagaacagtgtccttacaggcttcatgagaatgtaatcaacataaaggcttccctctactctattaaattacttaattgaaggtgaataattcttcaactaaagtagatctcattgactttatcaaaaagaattaccttctccaaacagaagctttgtatggcttgggttactttaggattatctgggttaaaaatgtctggatgattagctagaacaatatcctccatgaaaaactgccgcactgtgtgaagaggaattttatgcatattcatcttcctccctttaatacgcagcaaaccaacatgtctgaagtggagagaaatgaacaccgagtcacagtgtaaatttcctcagggtgatgtgcaaacgaaagctttcatatttcttagtttctaaaaatgcttctttataaaatcatactcttaaaaataaatgtttctgctaatttaaccttaatgttatcatcacaggaaaagatggtagacattttccttccccagagtaaaatcaactcatccattattatccctgtctgatcagtcttgtaagatagacataataagcataaaaaaatgttaacaggactatgatggtagcatatgtagactatagtattacatctatatacctatgtatatgtacatacatgtacacatatagacaaaatgattttgcagtggactcatgaagaaaaaaaaccaaccaacatagattctactaccatattctttaaccctattatcattgtaacaatcagaactcaagtgattcaaaagataaaacccataataaaaattgagtttaatcactgttaactacttcttacaatcatatcattcccccaaaaatgttttaaaaatgagatctattatactgcacttataatcagaaaattttcaattaaatggttttaggataattttttataatgaactttgtgaaattagtaatcatcaacctaaaacatctaccttgaaatataataaaaatgtgcatcttgaatttgcctaatgagcagcaaaataacaccaattggatgctctctttttgaaaatggcttaaaatctggaaaaacaataagactacacagaatgatcaattttcaaaaataaagctatcatataaatgacaatactgccagttagcggtaaccttaacataggccttaaacctatgagatgattagttattatagcaaagatttcttaaaaattggctcaaaatatataacactcacttctttacagcttctcctggggaaagagaagtaaccactgagcttccaggttgtgagatataaaacagctgttgttcatttttggttggagctattttacactcatgttcatggccccagataacaagatcaatgaagtcatccaaaaattgttctggaatgaagttagtacttccatgtttactcctgtatcaagattttgaaaaatataaattcggtgattagaaaaatttcatattattgaagtctatacagatctttctttctccattcactaaagattttattgcatccttctatgtaccagaaagtgtgcacaggattgggaatgtaaagatcatcaatgctaactcctgaccttgagagctttacaaacttattggacacagacaagtggaaacccgaaaagagaaagcagtcaattctatatttggaggaagatcatgaaaggttttacataggaaggatttcccctttggtcaatcagaaaagcatgaattctatcaatagtagaaatctataaatcagtctaactatatactagagaaaacacacagaaaatgcaagtaagtataaatatgtccagtaatttcttaacattatctttttactaataaatataatgggagtaaaaacatcaatctcacataagtgctaagagttttcaatatcaaatattaaataaacaagtgatatgcaaactatggtattatacctatatcagttattatttaaagatacatgaaatgcaaggtgatagaagacaagaaggaatagttttccctaatattaacttacatcattggagattcaagtaaaagtgttcacatagtttaaccaagcattcatttaatccaaaccaatattcttccattcacccaacaaatactgttacccaaacactgtctactttatgtcagatgtcccaggcttcttctagatatggaagacacagcagtgaacaaagtccttgttctagtgtgggaaacaagcaatgcaggttgagtccctaatctgaaaatccaaaatccaaaatattttaagtgccaacatggcaccacaagtggtaaattccacacataaatacttaacacaaactttgtttcatgcacaaaattattttaaaacatgtataaaattaacttaaggccatgtgtataaggtatatataaaatgtaaacaaatttcatgtttagacttgggttccatccccaacatatgtgcaaatattccaaaatccaaaaaatccaaaatcttaaacacttctggtcccaagcatttcagataagggatactcaatctctaatacaagatgtatatgcatgtgtgtaagtatgcacatgtataacttgtcagttagtgataggtgctgtaaagaaaaataaagggaaaagtgacatagaagtgccatactcctctctacatacacagggtagtcaggaagacctctctgactagcatcaaatgagcagagaactgagatgaagcatcagtacgcggagagagaaagtcctaagcagtagaagagcagatggtgctaaagtgggaatgtgttcagtgaattcaaggaacagcaaggagaacagaagggctaagcagaataaatgcagggaagacagaatatacaggcttgtgtatccaggaatgtttttatgtaaaaaacatacatctaaggtatgagattatcacaactactaaagaaaagcagaataattcccaaatacaacatgatgccattgtgccttcattgagtgctggttctttcccggaagaagaagggaggatgatgctggtaggctgactgtaatttgtgacctagaagtgatcacaatatccttgttgaaagattttgcatgaccaagtcatctccaaattcagattctttcttctttgaaacaagagaaaaaaacagttgatgtagagaaacaaatgggaaataaggcaaaatgcagaaggctcaagattctcacccaatctgtgaaaaccttctttgttttaaatatgaaagcagaagtatcttgagaatgcacagggtgacaaatgaatctaacagcattaccaaagaaccacataaccacagtgaagggggtggggagaaaatgagctaagtaagtttgaaaaattaggtttcaactagatacagaaaggctaaagactaaaataacttacacaaacattgtaacctagttgggaaagttgttttgcacaggggtatgagttagcaattttgaaattactttataatttcaaattataccaggattggaaatataattaaaccaagattgaaaaaataagtaaacatatatatttataatatgatccaggcttctgttagacaaagaagtcacaagtaaggaaagggagaagacaaaaatggaccttgtagggctggattagaatcagtctgaacttatcattggttttttaagcacatatatagacatgtatgtatgcatgggttactatatacacatatatctattcccataactctgttcattcagagtgctgagcaagccctggtagcagtaagcacacctagtacgcatttgtggatttctgaataccactctccaataaaaagaatcagagcaccttggagaaatggttgattccagggctaggtaggaaaatatcaggttggtgcaaaagtaattgtgatttttgccattacaagagccaagagcctagaccatcttgaggtgccaaaaagctaactaaggtcatgacctcaaaacagatgggaagacattgaaaggacacagaggccaacataaaagagaatgcaatggtcaaagctgcaacaatcagaggaacagtagcaaccaaaaaactgatagtactggatcttcaagtccataatgacataaataagtaagtaaatagagaagaagggacaaattttccttacagaagaattccattaataaatatagaaagaatgaaggaaatcaaaacttacaattaaaataccacagtattaattactggaaataagatcacccatggatgctaaaattagcgagtaaaagtttaaggtgaaacaggatatttgcatagtctcaaagtattttcccaaaaatatttattaattgaaaagtagaaaatgggaactttacagcagagaaagctgttacacattcccttaatcaaatgatgaggggggcaatgagaaaaatcaacatcatatggtgactacccattccccttaccaatgctgctattctacctttcatttggcttaaattcttagaattacttatgagttttcctttcaactcatcatccctactttggcatagtacaaaaaaatggtagacctgggaagctctatggaagagaaggaacaaatcccagtggtgcaaagttatatgaagaccacacacatatctaaactctggcctgcccctcctttgaaactcacagtttattcaagaactcacacataaggtaacacaagtcagcctcttaaaccctttcttttaccgagtatttaacctaagtctgcattcactgaatgcacagagtagtctgcattcaataaatgtgttcaataaatatagctggccctctgtattggcagattcgtggattcaaccaactaaagatcgaaatattcaggaaaaaaacaataaaaaataacaacgaaaaatataaatttttaaagcaatacagtataacaactatttaaacagtatttacattgtatcaggtattacaagtaatctagagatgatttaaagtacataggaggatatatgtaggttatatgcaaatgctataccattttattcaagggatttcagcatcccaggattttaggtcctggaccgaacaccccccgtggataccaagggacaactgtaataaattatataatcaggccccaaatcctttgagttcttccctgacaacttctccggtgtgtccctcccatttctgtttcattgccatcactgtcaccacctcacatttttactgcagtgatcagataataaatcttgcttcttcaagtctgtcttcttttcaatcaatcctataccctgccaacagattaaatttcttaaaactactaacaaaagaaaggtaatctagctatatttgtatatcctggaagaacacttgcatatatgtagcaggaaacatgtctaagaatgttcataacagcaaggtttataaaagcaaaaaactcctgttcactgacaggaggcaaagcataactgtacacatcagtaaaaataaattacacatccaagcatcaaaatggatctcagtaatgtaatgctgaacataagttggctgtaaatatagcataatatgagtatacatgtgattaaacagcaaagaaaagcaatgaaataattaattcaaaattaataatgcttccctttgggatagggggaagcaggtgggatcagggaaaaggaatgggataaaggaatggataatccaacaaaaagattctacctttttgttgaattgaggagtattcatgtgtatgccttatccttatgttacaaatattcttgtaggtattaatatatactaaaaacaatttcaaaatgaaatcacacaaagcaaatctatgttttgtctgatcttgcattgacaaccttgaaagattaagggcatttcactaaaataggtaagctcagaaacagatttgggaagcctcagcacttggctcaaactttttcagagaaaagttttacctgttctgatgaatcacaaataagttaaaccaagagttctcatcttcctttggtctcaacattgttacttttttattgacaaacattcgatagagcctttcatctggaatggatcctgaaatggacattacattatttttaaattgttttcttacttcggcttaaaaaatgaatctattttgcttctaaattatgtccttctcaaagtatttcactttactgttgggagatatatttgaattctggaataatttataagtgggtatgttgcaggttctttttttatcttttttttttaactgagacagggtcttgctatgttgtccaggctggtctcaaactcctgggctcaagcaatcctctcgcctcagcctcccaaagtgctgggattacaagcataagccaccatgcctagctgtttcagggttttttttcttttcttttcttttctaaacacagtcttgctccattgcccaggctggagtgcagtggtgtgatctcagctcactgcaaccttcacctcctgggttcaagggattcttgtgcctcagcctcctgagttgctgggattacagcatgcaccaccacgtctggctaatttttgcacttttagtagagatggggttttgccacgttggacaggctggtcttgaactccggacctcaagtgatctacctgccttggcctcccaaagtgctgaaattacaggcgtgtgccagcacgcctggcctgttccaggttcttgataacagtagttagttgcatttgaaaaacattttccatttcagacatatacatgttcaaaaccagcaaaatgtagaataaaaatgtgagttttctatggtaaaattcttattaaaacttctagtaatactatttttcaccatccctttgttataaattatatatacttttgatctaatatatacattataacatgtgcagaaataaatattaaaagggatgataaaagtgtatttaaaaacaatattcttacattgttttaatatattgtgctttttaaataactcaatgactttcaaacaattctcatactccacaggttcaccttgatctagtgaaagaaactaacaaaaacaagtcaacaaaatagttacaaatattaaatattataaaaggagaaaaagccaggatgctaagatggcgaattaacactatggaattaaaagggtggacaacactgctactttatatacggattagagagggtctcagaagaaaagccaacaatgtagaagtctagaagttagaagtggcctagctcccaaggagaatgctacaggagtggccaatggaatacatggctgaggtggaatgtagaacatgtaactggagacaaaaaagtcaaggcacacaaagcccaaggcattagaagattaatctacttgagtgttgaaacactaaaaacactggcaaaattgaaggtaggtaagtaggtaaaaagtctgagagaaaaagcaatgcggtttagccagatggcagaagcttaaagggaacagtgtgtttgcaggcagaaaaggaagcagtgggtggagcaaggagaacagtgatccccgcttctttccaaaagcccaggggtaagagaactgcatgggacacaggaacctcaggggacagctgggcttcactgaaggttagaaagtggaggtaacattcagagaagagactgataataatgaggaatctgataattataaaaagagttctagagtttataatgaagagctgggggacagggaggggtgcagggtggagacagagtccagttaaggaaggtataatagaacaggataagataagagtttgggagaaaatggatgactggagagatgtgcttctggtggtgactgaggcataatggaatctgtccttagtctgaatggaggaggaaaggcaattttctggagatatgatccctaataacactgcagtgattaaaacaactgttaatagcttttttaagaaaagtatatttcacttcctgctctttcacttgcagaatcagatataacatccagatttcattttccttatctctaaaatataaataaccatgatgcttttctacttgccagaggtattatgaaagctgcacaaaattataagctagcggtattgtacagtgaagcattagacctttcaaagacttccaagatatcaaagtgcagttttgctaattattctataattctaacattcaggattctacacctgagtctaaaaaaaacccaaaataataaatagtaacgaaaagacattttttcaccaaaaatttttaccaaaaccatccatcattttttatagtcaccaataaagaataaggtttgccccattttttccaaacagatacaaacttatctccaaatttctcaattgtttaaagaatcacacatggacataaacagtaaaataaaactgtcttacctaaaccatatagcgcaatctttgtgcttcctttttgaagcaaaaccggactaatgtctatcttctccacagacattgaacgtccaaagtgatttacaaatccagcacaacttaaaatgtccaaggcacaaagtgcatctgcctatgcaaaataatttcaaagaatgttagtgtgtatgtaaaagtaggtatctgcatgaatatcgtatcacctgttaaaagcatactccatattctacttacaaaaacatagatgaggatagtgtcttctcaaaacaaaattacaatagtaaaagtatttgctacatttttgtactacaaatcacctacagcaactggaatcacatgccaaaggcaaggttaatatctcatcaaaacttatgatgtcttggccacaaaaaaataaaaattagccatgagataaatgctttgtaatattaagcaaccgtcttaaagcctggggaaaaaagaccatagataatcagtgattcataatattaatgaccagataaaatgaaaaaatacttgtaggatctctagtcttacttccatatcaaacaggtaataagataatctaatttagatttaaagatggtcttgaacaatcatttcctaaaagtgagattttataagatagttataaaaacactgacaaactgtaaaccactatacagatgttaggtgttcactcctactcctggcttcttattgttaacatcagtattaatgaaataaaagcatagctcatacaccaattcttatttcagatttttaaaaaatctaaaaagcagtataaaagcttgtatgaatgtgaaaagtcaacttgacttttgactcaatttgactacacaatgagaaaaagggaaggcatgctttccacagacaaactaaactgatcatttccaaaattccaacaaactctaagaaaacaataattacccctgtgggatcgtcatgattgccatgaatactaaacactggaattgaaatgttgaggttgccatcttgatagttcacccatggaaaccttaaaaaaaaaaagttacttaaaatttccatacgggacaaaagctgttttccctaagattctcctccaaaatattaatgcaatcataggcaaactgcataatctacattggcatatgaccactagtttagagctttaaaaaataaaatcataggcgacaattcatttcaattagtttgaaaatatctcaaagcactacattttaaagaaaccccaactataataaacagtgcttgtggtatgtatgagtagtatatctaattaatgaaaagttaataagccttcaaaattttaaaaacttagcatatggtttttattcgtagtggggggagggaagaaaatccatatactttagaatcccaaagaggtagattaaaactcccagctctatcacttattgcctgttcaaattaaagtctcctgtcagcccctgcccccagccatccagctcctcttctcagaggcaaataatgttagcaatttctagtgcatctttcaaaaggatcctatacctatccacacaaataaacagatttttctttctccttacataaatgatagaaaaatatacatttctgcatcctgcttttatcactcaacatattttagaaatcattccacatcagtacatgaagacctttcttctgctctgtcagccacacagtactccattgcatggatcaccacaatgtgtttgagcagttccctaccaatggacatttagattcttggcagtcttgttttacaaacaatgctacagtcagtaatcttgtacaaagtaatcttctacagcgagtaatcttgttgccctggtgagtcgacctgtaaaggaatacctggaagggaattgttaggtcaaagagtacatgtatttgtaattttgataggtgctgccaatttcccaccatagagatttacacataatgcaatggcagtgcacaagagggacagttttcccctacctcactaacacagtaggtcatccagctcttaaatctatgctagcagttcttaatgctagcagcatgttggaattatcttggggatctttcaagaaatgccaatgcccatgacatacttggagagactctaagttagttggcctggagagggggccatccatattttcaaaggttcttaggtaactgtactgtgcactcaggattgagagtcacagacctatgccaaccttataggagaaaaatatttcagtatagctctgtctttttcttatgagtgaaatcaaacttttaaaaataggtttaggccggatgcggtggctcacatctgtaatcccagcactttgggaggccgaggtgggcagatcacctgaggtcaggagttcgagatgagcctggccaacatggtgaaaccctgtctctactaaaaacacaaaaattagccgtgcatggtggcacatgcctgtagtcccagctacttgggagactgaggcaggacaagtgcttgaatctgggaggcagaggttgcagtaagccgagatcgcgccactgctctccaacctgggcgacaaagcaagactctgtctcgaaaaaaaaaaataaaagttaaatgtcatgttatttccttttctgtgaagtatgtccatattctttatttattactaactcatgaattttattgtcttgaaagaactgcttattggggaattcaaccttaatttgcaattggttgcaaatattcttcctgattgaactgtgacttctggctttgcttcaggcagtttttggcatgcagaaatttatttttgcaaagacaaatgtatgaatcttttatgacttctgggtcttgtgtcatacttagaagccttccccacacctagatttttaaaatatgtgtaacagtttctcctagcagttttactgaatccattatttcccctacattgtgagatggtgaccttcatcaaatactcaattcctacatgtatttgaggctatttctagagtttctattctctttcacttacctatctactaattcatgagccataccacattttcaattattgtagcattgttatacttcaaatctaattggctactaactccttagtagtcttcttttttgggatttccctatctttgcctattttctacatgaactgtgaactggaagattaaattatccaaaatgaaacacaaagaggtaaagttatgggcaatattttttttaatagtatgctatataaatgatattcagaaagagaaaggaaacaatatttgaaaacataatgaatagaatgggaatttccccaagttgctgaaaaacaatattacattagaatatatgataaagcccacgcggaacaaacagaattaaatccacagctaaataagactgcaacatgttaagaacaatgagaaaatcttaagttacccaagtattgtctttatgctggtcactactctagccatttttcttatcatctcaatcttctcaactctgtaagattggcacatttctttcccatgttatgaaggacagaactaaggtagagtagttaagtgactaacataattttacaactactaaatgacagaaccaggatttgaactccagctgttttataccggaacccatgctcttaatcactatgctaaactttctagcaactcacctaacagtagactcctcaacagcaacaaaaaataagagtttaccactcactgacactccatgaaaaaactactgaaaactgtgcttcagaaagaaggaaactgaatctacacaaaagaaatgaaatacaaggaacaacagtgagcaaagaaataggtaaacatgtatatagggtggggaaacagttttcaaaacagaatgcaatttaaaaataagatgaaagaaagaaaatactgaagttaaaaaatgtcccggctgggtgtggtggctcacgcctataatctcaacactttcggaggccaagtcgggaggatcacttgaggtcaggagttcaagaccagcctcaccaacctggtgaaaccccgtctctactaaaaacgcataaaaaaattagctgggcatggtggtgcacacttgtagtcccagctactcaggaggctgaggcagaagaactgcttgaacctgggaggtggaggttgcagtgagccaagatcgtgcctctgcactccagcttgggtgacagtaagactccttctcaaaaataaaaaataaaaaataaaaaatgtcccaagttttagatttgaatagaaggagggtaaagacattgatcacaattttgaaaaacaaggacaaagtattatacaaatcttttaaaactcaattatatatgcagccaaactatcaatcaaggggaaagtgaacataaacattttcatgtggacaaaatctcaaaaaaaaatttacctcccaatataaagtcacactttaaaaactaaataagaaataaatatgggctgggcatggtggctcacaagtgtaatcacagcactttgagaagctaaggcaggaggattgcttgggcccaggaccagctgggcaacacagtgagaccccatctctaccaaaaataatttcttaaaaattagctgggtgtggtggctgatatgctttgactctgtgtccccacccaaatttcatcttgtagctcccataattcccacgtgttatgggaggggcctcgtgggagataattgaatcatgggggcaggcctttcctgtgctgttctggtgatagtgaataagtctaaagagatctgatggttttaaaaatgggagtttcccagcacaacctctctctttgcctgccatcatccatgtaagacgtgacttgctcctcttgccttcagccacgattgtgaagccgccccagccaggtggaactgaaagtccattaaacctctttcttttgtgaactgcccagtcttggcgggtatgtctttatcagcagcatgaaaacggactaatacagtggcacatgcatatagtcccagctacttgggaggctgaggcaggaagatggcttgaacccaggaggttgaggctgcagtgagctatgatcatgccactgcactacagcataggaaagagagccagaccctgtctcaaaagcaaaaattaaataaataaataaataaataaataaacatgagtatgtctattctcatgggttagtatgtacacatatttttcttagctctgtccagtgagagcctagaagcaacaatacaatagtaatgtgcacatgtaacatccagatcttggtttccaaataccattctccaaaaggaaccagggttccttgaagaaatggctgagtctgaagacaagaaagacaaagtaaaaaatcagaagaaaaggtgggatatatcaaaaggatacaggagccaatctcaaaaggagcccaatggctaaagctggaacaatttaagccacaagtaaattatgatagtaataaattataacccaaaggaaaaaaaaatgggtttctactgatatagacaattgaataaacaaatgtgggacaagggacaaatcttccttacaaaagaatcccaattaatacatgtagaaagaatataggaaatggaaaatcacaattagaatatcacagttataactgttgtaggtaagatccactgatgaatctaaaattaatgaacaaatttaaggaggaacagaaaagtcgcacagcctcaaaatatctaccctaaaatatttattaattactttggtggttttaacttatgtccatcagaagtggaaacttaactccctgccctttgagagtaagctggactcagagactcaattctaaccaacagcatatggaaaggaaaaaataatgactttacactggagaaacctggcagagaccagcttaaccaagtgatcaaggttaaaatcaccagtgataaatcaggttgatgtcacgcacctcctgatatgatgcgactgaaagggtacttcacttcttgaatattctcccccaaaacctgtaatcccaatctaatcatagaaagcaggagaaaataccaaattgagggacgttctacaaaatacctgacctctttataagtatcagggtcatgaaagacaaggaaagacagaaaacctgacatgggctgaagaaattaaggaaacgtttctactaaatgcaatgtgagatcctgtacaatgtttaagacatgatgggccagaagcggtagcttgcgtctataatcccagcactttgggaggccaaggcaggtggattacctgaggtctggagttcaagaccagcctggccaacatggcaaaaccctgtctctactaaaaatacaaaaaatttgccgggcgtggtgatgggcgcctgtaatcccagctactcacctgtaatcccaactactcgcctgtaatcccagctactcaggaggctaaggcagggagaattgcttgaacccaggaggcagaggttgcagtgagccaagctcatgccactgtactccagcctgggcaacagagcaagactccatcaaaaaaaaaaagaaaaaacacatgatgatatttttataatatagggattgacaaatatcataaatagtcccaaaggcacaaatggaaaaaaagaaaaaccaatagatttaactacataaaaattaaatatttctgtcaacaagagtccataaacaaagtcaaaagacaagccattgattgggaaaaaatatatgtatcacaaaggtttactaattagaatatataagtaacttctgcaattcaggtagaaaaacaaacaaaaaaatctcaatttttaaaataggcagaggatacgaacaggagaggataccaaaatgtacaatataaacctgagaagatattcagtcccaccatgtattttttttttttttttgagatggagtcttgctctatcacctaggctggagtgcaatggcacaattttggctcactgcaacctctgcttctggggctcaagtaatcctcccacctcagcttcccgagtagctgggtcagttccactattaattaggaaaatataaattaatacaatgatgtacaaaaaaattcaaagaatgatatttactaagaaaatagcttatatggaaggcaaaacagttgtgtgtttacgtgtcttatacagcaaataccatacacaagtaatcactcactcaagtaaataaatatacttacttactaaaaccaaagttgactgactgatcactgagaatttcaaactggacaggccgatcacccatacaatattttcttaataactcgaggcaggtatgtaatgttttccttgagggcttattttcatgaaaaagatcaccacctaacaaaataaaatccacctgatcaacagaaaaaggtgttaaaattagtatgttttacaggtaaaatttttgtaaactacagatgaaagagataaaaaaaaactcacaaaagacactattatatatggcaacttaaaaatttacattttatttattcaaagggactttcaatctggtaattaatctggttctaatttagctgactaagctatcttcaaaaaagccatcttccaattacaccaagtctctgattcaggccacacaaggtgatcatattttttctattatttgaatcaaacataaacttagcactttaacagaacgtatgggaagagataccaaattcaatccaaatcattcatttaattcattcagcatttatttacagaattcctacaggttctagaagctcaaaaaatagcaatctacaaaatagattatatccctgccctcattaaatactgactctatgcaagaccctctactgagtcctgaggatacaatgatgaataaaatatgatccctatcctaaatatgttcaaactctaatggaagaggcaaactgttatacatttaaacataagtcaaactctggggtgcactagaatggacacgtaagcaaccagcagcagagatgacactacgatgaatttgaactcaagggaggacaattcgcctgaggacagaaagtctagaaggaatgaactaacatggtggcatgttagttgcactaggaaagataaatgattgtgaggaagagaattctaggaataacttcagtgaaggagggaaatcatacagaaaaagtctaacacaggctttcaagacgtatacgatgcacctaaagaaacttaagttcttaatcacacaaaagaatacaaggtatagatcactgtgcgtatggtagttaggataactttaataaaaatgtgaggtttaagctaggccttccagaatgaacactatttgagtaaaaggaagaaaatgatctcaatcaaaggcatggaagaaacaaaacaaaaacaacaaaccaaatgaaaaacatactggggcgaaaagaagttgttgcttaatgggtgtcatttttgcaagatgagagtaattctggagattggttgcacagcaatatgaacatatttaacactactgtactatacacttaaaaatggttaacaagggaaattttatgttatgtatttaatatattttgccatcattcaaacatttaaaaaaattttttaaactggctggcagtgactccaggaaatattgaaaagaacacgactcacttctgtggtattcttgccgaaagtgcagaatctgaacctaatcatgaggaaataccacttatagccaatttgaggaagattctataaaataactggcctgtgtactcttcaaaatattagggtcatgaaaaacaaaggcaaggcagatgcaggaaaatgtaccagattaaaggagacaaagagacatggcaactaaatgcaatatgtaaacctggactggatcctggacaccaccaaccagcctccaaagtgctgtaacagacattacagggacaattggcaacatcttaacattatataatagcactgaatcaatactaattttctggttttctatgattatacatgcggtttactctcaaatggttcaggaaaaaaatcgtgtgtatttgtaaagagaagataaagcaaatgtgacaaaatgttagaaaacctgggtgacgggtaaggaattctatgcgctattcttgccaacttttctgtgagactgatgttgtttcaaaataaaaagtttttttaaaaaaagactccaagaaactagggaacagaactaagactggttagtgggcatgggcccacataataagggacttaaaagtcaggaagactttagattcaataataagaaatactaaatacaaatcaagagaatgagtaaatataatacacatctagaagtccctacctggggttatggggggtggaacagttacaattaagggacgcagggaagagaaacagtagaagcagaagtgaaggaaagggcaaagtagaattaagtagcttacactcaggagaagattctgttttagggctcaagagttaaaaaagaaagagcacatacaggattctctggcaggaaacagacctcctttggccacaagtttttttgccttcaaggaaggaaaaatgcaccttacattctattattgaaaagtcaaaaaagaacagatgctggtgaaattacggagaaaagggaacacttatacactgttgatgggggtgtaaactggttcaaccattgtggaaagcagtgtgacgattcttcaaagagctaaaaatggaactaccatttgacccagcaattccattacttggtatatacccaaaggaatataaatcattctaccacaaagacacagcacacatatgttcactgcagtactattcacaatagcaaagacatggaatcaacctaaatgcccatcaatggtagactggataaagaaaatgtggtacatataaaccatggaatactatgcagctattaaaaagaaccagataatgtcctttgcagggacacggatggagctggaggccatcatccttagcaaactaatggaggaacagaaaaatcaaatacttgtaagtgggagctaaatgatgagaagacatggacacaaagaggggaacaacagacactgggacctaccagagagcagatgataggaggagggagaggatcaggaaaaataatgaatgggtactaggattaatacctgggtgccaaaataatctgtacaacaatccctgtcatatgagtttacctatgtaacaaacctgcacatgtacccctgaacctaaaataaaagaaagaatccagccattgcctcacttaattaagaaatttaaaatatgtatacccactgctttctgattctttctaagcactaagatacagcatgaacaaacaaaagatttccactctcatggagttttccttctagtgaagacaacagacaataaacaagtaaataattcaataaattatttcagatagtgctattaaaaatatgctatgaaaaaaagcagagtaatgtgataaaacagtgcttggaagtatcagggaagacgtctccaaaaaggtaagacttgaactctcagaagtcggccccaccaagatcaatgtgctccaagcagaaagaactagatgtgcaagggcctcagagtagaacatgccggtgtggatgtagcactgtaaatcaggcagagagtagtaggagatgaagtttcatggcaggggtcaagatcaagtcgaaccttgtagtttgaattttatactagattcaatggaaggacacttggaaaattttaggcaacagagtgccatgatctgatttattattttaaaagttcactttggctgctatgctgagtagatgtagcagaaaagaatagaagcagaaagatggaaggggacctcctgcaggccatgtgaaatgtgatcgttttggactaagtttattagtgtgaaaagagtagtagagaggaaccatatatatttgggaggaagaactaaggacctagcagataaacttaagagaactctccagaaaagtcaaggctggcggtgttaatttgcaagtcaatttttacatttattctccaactctctcctgggctggcgtgttaactgcctgctgaaatttttccctgaatgtcccattgcagtctccaactctaagtttgtcgaaatcaaacaaagaatttgtcaccttcccacatgaagcagtacctcttccttatctacctatttctatttttggtacaactattcacccaaactccacacacttcagagtcactgtcatccctttgccctcatccccaccccgctacaactaaccaaagtacacaaatcctctttttgcagtatcccttgcattcatttcctcttttccatccctaaggtcaatacttcaaaaaaagcctctaactggtctccaattcatggtattatactccgctgccaaaagactttctcttgaactggatacaaatttctcaatctgatatttgaagtcctcattaatgcagctcaaatccttccttctagtctctcagcatgcttgctaactatgacctgctggtgagccaaattgactacagggcccctaacataccttatactgtctcacgggtttcctcactcctgcttcacatggatgtacattctctatgctccccactggccaaaagtctacccttcctccaaagcccaagttaaacacaaccttcttcattaaactcatcttgctataatctaaacgtgattttttctgcctctaaactcaaaggaaatgttatttagaattttcttagggctcctatcacatacaaccttgcatctgtggattgtggatatttgtctttcacaccagttttcttctacgttatctgaaagcagaagctttgacagtcaccttacatttcgaatagacactgccacaggatcctgcattcagtaaacaccccaaaaacatttgtaaattttaacagactatttacaaaagtagctcctacttgaatttaagacacaaagcatacaaaatcagctttgagctttcagtatattgatattcaagcaggcaaggtaagcacctgagcttataaaacaaatctctaactttagaaggaaaaataacttgttaaccaagggaatatggtagatagtgcacaaatacaaaccacactcacttcattttcctgggcaagtcttaaaatttcatcgagtgttacaaacgtatcatttcctctgactgcatctttctccataaatccaagatgaatatctgttgcaactaatattttaaatgtgttttcatcatcactatattaagaaagaagaaacatttcaatatattaataattcattaaaggatattcaaacaaattgagacaaacttataaaataaataataacagttatagagtaaaatcattttttttagccttagagttcatctgaaaatctgaagtattcaacgttatcattaacattacagttttcctaaccactagttcaatacagaacaaatgtacataaatctttacaaggttctataactgcttcaaaaatttataaccttgttataaccagttttacaaactcatgtaacccaggcccaaaagtttgcttgttttcctcagataaataaacttgttatttatctgacttcgtactcttccaggaaaatcgaagttaatttaaaaagccttcctctaagtttatgagtcaattttatactaatatgcaataatttacattcagggccttgaagacacttgcatgactctactctctacagagttagatttcattaataaagttggccaacacagaattgtttcaatttgaatttggtaatattcaaaggtactttaatgtgaagtagcaatgtaatagttattaatactcttacactaaatttaattgtatgaaatacttttatttttatgatctcatctcaaccctcacagataaagagtcaggcattattatctctgacaaatgagaaggctaaacccagagaaattaactgctttatcacataactagtgacagaaacaggactaaaacccatgatgaaaactcaggctattttcaataaaccacaatgaatttttaaaaaatctctgtatatatctccaaaattcaaatctttacaaacaaaagatatttccacaaacgatttctcttcaaaaacttcaaaaatgatatgcacacagttctcactgatatatccaagaaggtaggtcagatacttttcaaatcataatactacatgtttctgtagcaatttatgaagtattttctcatgaattctctcatttaagcctcaaaattaatctgaaaaaggtataattattccaattataccaatggcaaaattgaggcaaggctcagagaactgctgacttgcccaaggtcacacagctagtagggtccaaggacttgaaactagggtaaaagactccaagtctaaagtctttcccacataactttttttttttacgatctcggctcactgcaacctccgcctctcgggttcaaatgatactcctgcctcagcctcctgagtagctgggattacaggcatgcgccaccacgcctggctaattttgtatttttagtagagacggggtttcaccatgttggtcaggctggtctccaaatcctgacctcagatgatcccgctagcctcggcctcccaaagtgcacataacttttacagtccttttatttattcccattccattcaaattcatttccagcttatttaatactagaggaatttactctaaaaatcttaaacagaactgcattgactaataagaatttgtcaggaaaattcaagaatatttatcacttcaataatttaagatgaagcctaagaacataaacaatactatatcaatatatcaaattactgcaagactccaatctatagctgcatattagcttccagttaacaaacagataaatatttaaaacattccaaataccctttttgatgactaatatttctgttcataaacaggttccttatttactgcttattaaataagttttcttttactgtgatcacagttgacgagctttagaaaccccaaataacaagggattccagaagtcaggtgcttacagtgcatctgcagtactcatttttatggtcagtcaagctcctctgggaccaggttcttctccaagaacccctgggtactgtactcaaatgtcagaaaatgcactcgattccaaattctagaaattctaaaaacaaaattacatcataaaacacattttttaaaagcctgcacgtatttaaccaacatgatttacgctgcacaaggtacagacgtcttaattagactggcaaatttagaagtctcattttcatctaagcacccactatacttttttttaatgaactgagcatagaaaataatatatctccagtgtacatcctgtttcctagtttcaccaagatgattaaactcctattttcctttcccgtgctcttatgggaaattaatgtatgctaaataaatgggcagaaagggtcacatacggttctggttcaacacacaaacaactctagatgtgcagatatttttaagttgcacgcataggttactctggagaacagaggcaatcctgtatttcctattcaaaccccacgattttttttaaaggacctggctagtttggaaaagggaacgggcccgcgtttaaagcgagtgtaaataaacaaacacgtggtctgcggaggaacacctttaagcaccagcaggatgactgaaaatagccaggtttggggaagagtggctgccaccgcgagacaacccccaccacatctggagctccagattccgtcgggattccaagcctcaacacgccctcaccgcagggaacctcggaatcagaacgctgagcccgccaggacccctcccctgcccactcggcccgctcttcccgaggttccagttaactctgggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgtagatgcttcaagtccagttcggctctcattggctaccgcacgcagtgagggggcggggaaagtagcggcgaggccccgccctcacgcaggagccaatcctgagcaggctaggagacgaacccggaagtgagatgcaaggcggcgattttcccttctgtcaggtgggttgttattccctgtcccggacctcgctttttgatggaccggcgccatctaagaactcctgagcccgtgggggtgggtagcctgtggacacaggccgagccctgcaggtcaggccgcttcgtggtccccaggtaggaccgaagccgcttctccgctcttggctgtttggaaggccgcaggcggagctcacgggcctgtgagctcccggctggtggcagagtgccggagctggatcccctctccctccctcccagtcgccagaccctctacaggtgtcgcccctaggtccttgagttcagcacatctgcactgctttgtgctgagagcagtaagatgtatagtgcagcgaaaaataatgtagaacttttgaattagaacgtctgccctttcagttccattgaagggtccttgatctagggcaagttgttttaatctatctgaacctccttcaccagtaaggtttatagccccgcctatcactgagttgtttgtaaggagttgacatagttcggatctctctcaaaataggatatgccctttaagttaggaaacataccctgacattcctgatggaatatcaggaatatcatcatcaagtcatcagttttgtttcttaactgtaagtcgggtagatgcgcctaggcttggctttttaaactaaatataccagtaaaattttgtacataattttttgtatctggatctgtaaactcaaaatttatataaagggagtttttattgaaaggaaaagcatgttgggggagagggtaagatctgtggtataaggttactatatttgatataattacaagtgaacttttatttattagcatctgttaagtgtttaatgaattgatgtatggtcatttttgtgttgcaaggttcaggaattagtttgagaatcaaagaaaaagtggaagctccaggagaattaataaaacacagagcaattctgattggatatctctgattccaagggtgtctctgattgggtgactgaaaagccggattggccttaggaatactttagtaaaattcttacattttacaataaagtaacaggaccagaaaagttactggacatgagtaatacatttaaacttgagtttagtgctattgccactagtaataaagtttaataccacattaagattgtatactgttaaacttgtgagattaggtatcaagaaatcagtatcttggggttatgcctaactctggaacttctcagaatccattccaggcaaaatcaagtgacaagactttaattaaatgtaatgctacacatacttcttaatgccttctatagacaagtaggagataaatataagttaaatgtggtccttatctttcagcttataatcttttaaggggctaaaacaagaacaaagttagaggtgaaatgtagcaccaaaaaaagtagaaagcagaaagcgatctaaatgagaggatcaagaaagaatgaaagagataacatcagagaagagccttgaaagactgattatatttcaacaaatagagttgagaggctgggaattcgtatttgtaaattatctattggttattctccttttctttaattgattaaggtttatatgttgtgtaaccctttaagctgatattggtttaaaaattaatatggcagcttagcagaataaacatcagttccttcaggaagccttctttaatcccttaggactaggggaattatgaacctcctgtatactcatggtttctagacaaggtcttgtagtagtacttatcatgttgtctttgccagacacatgatgtctttgccagtcacctacactagagtaagcttcctgaggtgaagacatggatcttgctcattattgaatcccagtacccagaagttggcacataccagacattctattcatattagttgaatgaaggaatgaatgacagccaaaattcagttgaaaacaaggacccaactaagaactatagttgcctatcaataaacaggactactttttaaagcagtgaattttcctaggcctgaaattatcaaagtagaaataggataattagtgtagatgctgtgataaagatatatgtaccgatgacagattggaacagatgtccttttgggggctattccatcttcaagaatccctgattcttcgaaatagtatttttaggaattagaagtttttatttctgctctatattatctgtgtgtctagtttataaaaatcttgaatgcacctgtcttcattgtattagttatacttcaaaacctttaagcattcatcactgttagcataacaccatcatacctaaaccagtagattaaaaataatagttataataatataattgacttagaagaaaacaacaaaagtaagaagcattagaccactattagatcatagtttgttgttttctgtcagcatcagtatttagtgtatgtaagggatatcatgagaaaaacaagagtttagacagggtttaattgtatatgtttgcaagacttatctatgcagttgataaagcctgaattattgttttactaataacttttgtatttgtgttttcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactgttatggccatcatacctatctcttgattgtgaggaccaaatgagacaatgtacatgaaagcacatattaagctgcaaagtgtcatgctaggtattatttgggggtttaaggataattatctataaagatagcaagcaatcatctatattttaaaatcatttatataaagtcattaggatcatttaggaaagagaggatggaaactaacatttattaaaaactaactataccaggtaccttattacattattttatttaatcatcatgtatccctataagtaatattcttctcttttatagagtaagaaattgagattcaggaatattaatttgcccaggatcatcgaagtggaatgaacatcaaaagcctattccctctgcttggccacttccacctcattttactaagtttccccatgtctgtgttagtaaactaataactaaaagggtctcgcattttaaatagctttttaacccaagagcatgccacatttaaccagaggcccatagaacaaactgaaaattacaacctaaaaggttgtttctaaggttgtattgagaaggaattgagctcttgaatccctagaattccttattaatactttattcttctgttaaaagttttatttttaaaagtttcatacagtgtgtatattggtgtgataatcctacagaaaaatcaagcagttatgttttcttcacagataacacataaaatattaaacagaaagcctatgttattcattggactgaagcttttatgcaataaaccttagttggaccaggagtaaatgtatggtttgatattcagagaatctcattcttagaagcaacaaagtgtagttaacactaacttgttcattcttaaatcagtagtcctctcctccccaaaaagagatcttaaattattttcattttaaagtcatctactaacaagtaagtttttattcaacttaattaaatctaacaccacaagacaattttgttttagttattgttttggtttgagttgagttgaaagatttcttttttttcttctcagcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaacacaaaaggcatgaattcattttttacctgtgtatgtctttcttggatccagaacattattcatccagcacgcacttagttatttaacatctactcactcagtctctccagcagcaattttgcattgtctatctagcccccctgtgattgttcccaaagttttgtcttctcaacaccacaacactccaggggaagggaactaaaccagttgctctttacttcagttaaatttttaagatgtccaccaaggcttatctctttcaagccatcctacgtaacccagtcaccctagactaagtaataatgttatttaatcaaagattaaatatttatttttgcttagaacttattagatcatctcagaaaagtcagagataatatatgaactgaatcatcgtgacaacaggatcttgagagttagtgctttagtttatgttgtgatctcttcctagggagatgctttgtggcagaggttgctttctgtttaatctggcctaagttagtggcaccaaatgacagatacagctgacaggcagtgatgatagaataagaccttatttatccaagcagactgctgaatgaggttgcttagcctgaaagtcacagagctgatggctcctttctcacttgagaatggattgtacccatgattccatgtaaactttccattaaagtatggagccaaagaagtcttgtttccaataaggacctaagatgtgtctattcccttgttttcagacctcaacactcactcactgatgctagagagcaaactctacacataagacaaatcccacccctgagggcagaatttgtattgtctgcttcctttatactttccagagcattcactagactgctctgtgcacagaaggcagtcactaatcgtgctttgaaaggattacttctactttccagtttaggccggctaaatagctcagtttacaaacagaattttctctaatcttggaaagtctatacaaagacttattaaaaaataaaatctgagtttttcataactaagggtttaattttgattaacatatgcttgaggaagaggtaatttttgtgactgttcaagattcatagcgtcattcttaggcctaaagtggaactagttgcctttgcttttatgaatcttaaatatgcttttccagggagccttccaacccacagcctaccacagtggtgggatttagagtctttatactacaatctgaagacatttatttgtattatttgacatctattatgttatctaacactatgctggaaaatcatgatcagaagaagcccagagactatactgagatttatgtcccataccaaaatgaaatctctggatcaactcttgattcctgatcaacacatacaccatcttcaccctacctgcaatggctctaggaatttatgcaactgcctacaaaataatatcaccaaatcattatgtctttgctataattagtttatcataagatgctccagtccatctgtaggattactagatgaccactcaatttgttcaatatgaaatgctttctctaaaggatatttaaggtctatctttattaagttcagaagagagtaaaccaagaaggattaagtgtagctgattgatgttttaaattcctggaaatttcccttggaaactccaaaattttacttctcagaacctaagtggaaatgatctaaatcagtgccaacacatagaaacatgggcctcatgtaattttatgtttttagcatgactattttagatacctcatataagaggactcatgcaataaggacagaattgcattttatggcacacaaacatagataagcaaaaatcctagcagttgaaaatcgtaagagccatattaaaaacaggtgaaattaattttatatatatatgacaatacatccaaaatatgagatatatatttaaaattttttgagatgttttacttttttttgcagtaagtcttcaaaatacagggtgtattttacagcacatctggatttagtcacatttcaagttctcagctatgtttgtctaatggctactccattgaaagcacagatctacatgcctgaaatcattccctggaggcacagaaggatggttacacagagcattaaactctgagtgagacaaactgagttcaaatcctcagtgccacctgtgggtcactttgggcaaaaaaaaaaacccctcggttttctcataggtaaatcagggataatatctatcttgttgtaggctagtttgttatttaaatgtaaaaatcatatggtgttatttattttgtcaatttctttaatactttaaaaataaatatcaatatgaaatacatcgaaatcatattgtttttttaaaaagctatgtgtttatcaatgtcctccagtcatcttttatgaatgaaatagtctcatctgatcttcatgaaagttcttatatatatataagatgtggtacaccaaacctctgtgacaatattaatagctaacaactgagtgctcactgtgggccaactatgctgtatgtgcttcacgtgtgtgataccatgtgagcctcacaacaactctctgagataatcattgtataaaaggaaatcaggtttatagaacttacacggattgcccattgtcatgccatgtgcgcatgatggaggtttgtctatctgattctaccacctttcctcttcaccatacactagtatttgatatgtatttgtaaagttgattaaagaatgcatcatttggtgcatgtttagtgtatcttcttaagttcccagaaagctcatgttcaaatgtcacagctttttacctgtggtgtttttgaatattatctgtataccaccagtttgtctatcataataaccaaaattccattttctttaatattatttttatgtagtttatttatagtagggtttgaggacataacaattactatcaggagcacaagcaactgcatttgcttttaaagctgcagtttatattttttgaatttggttacttgtatctacttttaaatatgcttgccatttatccacatatgaagtatatgttgtacataggctataactaaatttatttatttatttttcaatttttgttttttttctttttgagacagactctcactgttgtccaggctagagtgcactggcatgatctcagctcactgcaacctctgcctcccaggttccagtgattctcatgcctcagcctcccaagtagttgggattacaggcgtgcgctaccatgcccagctaattttttatgtttttagtagagactgggtttcactatgttggccaggctggtctcaaactcctggcctcaagtaatctgctggtctcgacctcccaaagtgctgggattacagacttgagccaccatgcttggccactaaatctattaattatattccccttccatgtaagattccatacttatgtgcaaatttcttgttattgtgtgaagaacacttaacatgagatctgccctgttaaaactttagttcatagtattttttttatctataggcacaacgcttgtagatctctagaactgcagagattctagattgtacagcagatctctagaaattattcatctcgtataactaaaactttatactcattgaataactacttcccgtttacccttgccccagatcctggcagccaccattctactctctgtttctaggagcatgactattttagacacctcatgtaagagaactcatgcaataaggagagaattgcattttatggcacacgaacatagataagcaaaaatcctagtagttgaaaatcataagagccaaagcaatatttaaaaagaaaacacggtggctcacaccatccaacattttgggaggccaaggtgggcagatcacaagatcaagagatcaagaccatcctggccaacatggtgaaaccctgtctctactaaaaatacaaaaaaattagctgggcatggtggcacacccctgtagtcctagctactcgggaggctgaggcaggagaattgcttttgcttgaaaccaggaggcggaggctgcagtgagccaagatcgcgccactgcactccagcctaggcaacagagtgagactccgtgtcaaaaaaaaaaaaagaaagaaaacgttaaaatcgggatttttataacctaattttaagactagctatacttgcagtgagccgagatcccgccactgcactccagcctgggcgacagagcgagactccgtctcaaaaaaaaaaaaaaaaaaaaaaagactagctataaaacaacagtattgagacagtgtagtattggtggatggacatgtggatccatagaacagaacagagtctagaaataaatccagatatagataattaatttttgacaaaggtgccaaggaattcagtgggacattctcttaaacaaatggtgctggaacaactgaatatcttcttggaaaaaacatgaactcatttataggcagaaagcagttcagtggtttcttggtcacggggacagaggttggactacaaaagggcagggagaaccttttggaggtgatggaaatatgccgtagcttgatcgtggtaatgattttgcaggtgtacacaactgtcaaaagtcactgggttttaaagagtaatgcagggtttttgtacataagttatatttttatgaagtcgatttttaaaaatagatatccagatatgactaattttattcttttattattttccatggcaagcataagatgacctcatcctcaaattctagggatatatcttcaggggggcctgttatttaaaaaaatatgtttcaccaattcactggaattttaaaattccaagtaacacaacctttataatcagaaggaccaatttctccattaaatgacagaatgggaaacaaaataattgctttaaaataattagtccatttggcaggattcaagaaatttgaaaagatggttagttactatataagaaggatttggttggcttttaatttaaatcaggactgttagaacctacaagaggataccaaagtggttttagcatctacttttccgaagaaaaacgatagcattcaacatcccattgttcattcagttttgctataagacaaactgagatgatttcttgagacctgttttagatctatagaattaaacacaagtaatatgaagtaacttatttactctggtaatatattaaaactttttatttctttgataaagacttcattttttacacgaatgtgtaactttttataagaaaactttagtcttgggttttgtctccatctagtggtcatgttggtcttttccatttacagtcaggcttgggtaaatgatgtatcgcctatactgacagtgatctcataagattataatggagctaaaatttcctatcacccagtgatgtggtagctgacataatgtcatagcacaacacattactcacatgttcaaggtgatgctaaatgtaaacaaacctactgcactgccagtcatgtttacatacaactacgtacagtacacaacactggataatgataataaacaactatgttactggtttatgtatttactataatatacttcctgtcattattttagggtgttcttctacttattaaaaaaagtgaactgtataacagtttcaggcaggtccttcagggagtattccagaagaaggcattatcataggagatgacataggaataactccataatgttattgcccctgaacacctcccagcaggacaagatgtggagggggaagacagtgatcgtgatgaccctattttggccttgactaagtatgtgtttatgtctttgtttttaacaaaaaagtttaaaatttaaaaatatataaataatgcatattgaaaatacaaaaaaagctcatagaatgaggctataaaaatacttttgcatagctgtacaaggtgtttgcattttaaactaagtgttattacaagatttaaaatgtttttaaaaattaagtttataaagtaaaaaaaggacagtaagctaaaggtaatttattattgaagaaagaaaaatatgtttgcataaatttagtgcagcctaagtgaacagtgttgataaagtctatagtagcgtttggtaatgtcttaggccatcacatttgcccaccactcactcactgactcactcagagcaacaccaagtccttcaagctccattcatgaagtacacactctacaggtgtaccttttaaagtcaactataccatatttttaccgtaccgtctctatgtttaaatttcttaagatacacaaatatttcccttgtgttacaattgcctacagtatacagtatagtaacatgttctacaggtttgtagcctaggagcaataggctataccaagtagcctaagtgtgtagtaggctgtgccacctagccacctaggtttgtgtaagtgcattctgatatttgaacaacgatgaaattgcctaacaacacatttctcaaaacacactcccaccattaagcgacacatgactgtaattgaaattttaaaaggataacccaaccatcctggattttttttcattctgtttttgttgttcattttcagttttttttttgggtaaggattgaaaaacttttaagtagtatgcttattacctgggtgatgaaataatttgtacagcaaactcctgcaacatgtaattttcctatatagcaaatgtacccctgaacctaaaaaaaagttaaaaagagaaaaatggaaaccacagtgcatacctaaaacagtaccttttatacttatttgtgtcagtaacttctttcaagagaatatgcattggtatataattgaagacacacatgtaacaattggaaacaaaaaaaatcaaaagccatttagaaagagaaagaaggaaataaaccacctaagtcaatatagttattaaaattgataagattatctttaaggtttttggtaatgaagaaaaaagaggaagacagtaattgctttttttgtttttttttttttgagacagggtcttgctctgtcatcaaggctagagtgcagtggtgcgatcatgactcactgcagccttgaactcctggactcaactgatcctccagccactgcctcctgtgtagctaagactacagtgcaagccaccacgccgagctaattttttaatttttcttttattgagagagtcttgctatgttgaccaggctggttttaaactcctggcctcaagcgatcctcctgccttggcctccaaaagtgctgggattataggtgtgagccacggtgccagcctttttttatgtttgttttgtgcatattttttaatttgatcaaataaaccacatttttatgagtaaaaatatttttagacatttttttctaaataaaatattcttaatttttgtataattttatagaactatagcatacacaaagtaaaattcagaaatcttggtgagttcttcaaagtgaatagggttatgtaactatcacccagctcaagatctagaacataatcagcacctccaacagctactttgtgcttccactcagtgttccctcaaaggtaactataatctaacttttatttccatcatttagttttgcctacataaatgtaataacttattgtgtatatttttgcatttggtttatttcactcaacattacatctatgagatttctccatttctgcatgtagcagggttttgttctttttattgatgtattccgttatatgaatatgtaataatttatatatacatgatattgttaacttttggggggattttgcattgtttccactttggggattttatgaataacgctgccataaacattctagtacatggttttggtgtacatactatacatttcagtgcatatctagtaaagcctgctgagccacaggatatacttatattccactttagtaaaaactgccaaaacagttctccaaagtagttctaccagtttacactcttagcagcagaagtgaacgttccgattgctccacacgcccatggctcttgttactgccaggtttgttgattttcatttcatttttttttaatagccttcctagtgggcatgtagtaatagctcattgtagttttaatttgcatattcctggtgactaatgatgtgaagcaatgtttttatgtgtgatgactgaccacttggatcttctctttcatgaagtgcttcatctttctccattttctttctgggatgtgtgcacgtttcctatttttagaagttctttatatattctggatcctagttattttttggatatatgctctctcggtctgtggcttgccttttcacactcttactggtgattttaatgaagagaatatcttaattttatttatttatttactttatagagacagggtcttgtgctgttgcccaggctggagtgcactggtgtgatcgtagctcagtgcagcctcaaattctgcggctcaagcaattctcctgcctcagcctcccaagtagctaggactactaattcatgtatttgtttttgtagagaatcttgctatattgccccaggctgttctcagactcctgggctcaagccatcctcccgcctcagcctcctaaagtgctggtattacaggcatgagctacagcatctggcctgagaatatcttaattttaacgacctctactatatctattgccttcttttgattagtgcttttggtttcctgtttaaaaagtagttgtctactccaaagggtagacatgaggaagacatcatgaaggtttttttcattgttatactctagaagcttttgtgttttacctttagtgctattttgagttgatatttgcatttgacatgcggtaggagtcaaagttcattttcctatattaatatccaatttatcaatgccacttattaaaaggaacagcccctcacacaaacacacacacactacattgcagtgacacttttatcatttatctggtgatcatatttagttgggtctgtttctagattctattttatttcattgagctatctttgccccaataccacagttttaatattttggctttatcataagtcttattatgtggtagtgtagatattccaacttctttcttatttttcaaagttgttttgaccagtcttggcccactacatttacctttttttttttttttcgagacagagtcttgctctttcacccaggctggagtgcagtggcacgatctcggctcactgcaacctctgcctcctggattcaagccattctcctgcctcagcctccccagtagctgggattacaggcacgcaccaccacacccagttaatttttgtatttttagtagagacggggtttcaccatgttggccaggttggtctcaaactcttgacctcgtgatccgccctcctcagcctgccaaagtgctacatttactttctaattttagaatccccttgccaacatctattttaaacaaccctgctgagattcatattgagattacatgaaatttctagatctagttgaggaaaattaacatcattgtaatattcagtgttataattcttgaatatactgtaatacatttctgcatttatttaggtattactttttcttgataacgttttagagtattcagttggagttctctctttttaaagatttatccttaatgtatttttttggctctcaatgctgttataaatgttattgtcttttacattccatttttaattttttttactatataaaagtaacatttatttttctctattgaccatgtgtccactgcccttgataaatttattaattccaatagcttacctgtacattcatttgaattttcttttttttctttttgagatggagtcttgctctgttgccaggctggagtgcagtgatgcgatctcagctcactgcaacctctacctcccgggttcaagtgattctcctgcctcagcctccggagtagctgggactacaggcacgtaccaccacgcccagctaatttttgtatttttagtagagacgggttttcaccatgttggccagatggtctcgatcccttgacctcatgatccactcgcctcagcctcccaaagtgctggattacaggcgtgacccaccttgcctggcctgaattttctatgtatacagccatgttgacagccaataacagtttaatttcttccttttttatttttttaatgtggtaagttatacagtattgattttaaacaaccttgcattcctgcaatgatcaaaacttgatcgtgatgtatgtattatccattttttaacacgctacatttgggttatatttgctaatattttatttaatatctgaattgatcttcttgagagatattgacctataattttcctttttagtaatgttctttcagattttggtataaagatgagttgggaagtgttaacatttttttttaattcctgcaagaggttagacagaactggtgttatttcattcttaaatgtttggaagataccagtgaggctttttctttgtggtatgtgttttaattttaaattccatatttttagtagttatatttttataactacttctattaaagctatatttcttcttgtgtctattttggaaagcttttaagtaatttctctattttatctaagttgtcaaatttactagcatcaaattattcaaaatatcttcctatctttttaatgcctgtaagatctttaggtatagatttaccatttctgatattggtgaaactaatcttaaagaagtttattctgtgagaactaacaaatgacagttgacagaatgaacagcatctttaaaaatagtttcacttaaaattctgaaatatttcttatttgacttttttcccactgcttcttgataaaaactaagaacataatgttaaaatagcatcatgagtcaatcaaatgaaatctaggtgtttttgctttcaaattatataaacccatattaggtaaggatatagtgaatataagtcatttagaataactttttggaaattatttctgccatttggacttctgataggtgagttgccataattcacctatcagaactcatggtgagttgccataactcacccatcaaattatttcagccatatggacttctgatagccgaagggcttagcaaaagccaaggcatgttggcagtaacatagctgggtgagaatggcgatgaattcactccaaacatgttaggtaaaagttatacacacacgtacaaacatgtcaacaactctgttcaaatcaaatcttaggcagaatgtgagctcaactacataagggcagggatttttgtatgttttgttcatggctgcatccttagcacatataatagctcctgacacaaagcagtcattcaatgaatatgtattaaatgaatgaggagtgcctgaactgcctggagaaacactgtgggtactggagagcagtttgaaattcaaactcatgttaagaaaaatctctcagaaaatagtgcaaaaatacagagatataaaaaaggaacgcaacctttccacacaaccttttaattgcctctcgctctctctctatatatatagatagatatagatagatatctctctacagagagaaagaaagagagagcgatctcctgcttttgctatgtgagctgcctgttcctcctttgccttccaccatgattgtaagtttccggaggcttcaccagaagccaagcagatgccagcatcatgcttcctgtaaagcctgaagaactgtgagccaactaaaccttttttctttataaattacccagtttcaggtatatagcaatgcaagactagcctaatacaattgtcatagtaatgtaaacaaatattactctagccaaaatttcaatttatctataatgggagtataaaggagcaataagtatatgtgacacagggagtatgaaagagagagaaatctcgtctttcatcgtaggaaatcaacatgatatctaaaattgaaaaacataaaaagcagcaatataaggatttggtattaaaagtgtttggctctggggtacagtggagacagaagaggtctcctatatttggttgcaagccttgtagaacgatttaatactataaaacaatgcacattcaacttccataaaattaacaccacaacgtaatccatttttaaggcctgcaaaaccaaaccaagacaaaagcaaccttatgctccaaataaaaccctgaatttttctacttgctcttcaaattaaaatttgctgaatttgatttcatctgtaaagttagttattagtttgttattttgtgaatacaaaagagcttggaaactacaatgtgcttaatataataattcacaacgtgaaagttgggaatcctcagtatttacttattcaatcacgttgcgtgtgtgtagcagggagcaggacgcgacaggcacaaggctgcgtgaaaccagcgacggtgccttgcactcacctgcacaccggttccacttctaacttttctgttctgggcagtgatctgttctgtcggcttgggaccagacttctgagtccacattccaacggtgccgcttcctagctatgaggccttatgcagtttccttcgctttttctgaatctcggattctctgggaatagtaaagcctctcttgccgagctcgtgtgagaaattaacaataaattaacgagaaattaatggaaagtcctttgctttggtcaatgataataataaccccagccccataacttcagcaccttctttggtgcgcggaatacctagggcctcggaaggccggctgggggcggggagaatcggcagtcactatggcaacccgagacgcctcgcatgctgggctgcctgcgactgagctgagaaggaaaccgtgcccagggctctcggaagaccgctgcggcatgacaggcgaggaggcggtggtggtgaccgcagtggtggcgcccaaggcgggtcgcgaagaggagcagcctcctccgccagcagggctggggtgcggggcgcgcggggaacccggccgcggccccctagagcacggccagcagtgtgagttcagctccagccgcggacgcta

SEQ ID NO: 106 - DNA, 51398 bp, Homo Sapiens
aacttacattgcgtttattacaatgtaatcccaacttaaggagcatctatgcagctacagtaattcaaggcagtatggtatgagtgagtgcaaggatggacaaacatttcagtgtaaccaaacagaaagtccagaaacagatccaccattatggttaattgattttttactaattggcaaggtaatttaatgaggaaaggataattctttcaataaacagtgttacaatgactggatacttgtatgggggaaaaaaagaaccctgatccataattcacaacatacatatcaattcaaggtagatcacaaatataaaaatataaagtttatataatagagcagaatatctgaaatcttggggttaaattggagagaaaaaatatcaaacaaaagaaaaaaataaatttgaccttgtcaaaatttaaaacttctattcatcaaaagacataaagaaaacagtcaagccacagactaggtgtaatatctcaatacatatatccgacaagagacttgcatctagaatgtataaagaatttctatgacccaattatagctatcagggatatacaaattaaaaccaaaatgaaacatcactacacaccgattggaatggttaaaaaggaaaaatactgacaacaccaatatttgtaaagacaggaggtaccagaactctcattcattatattcataaattgacaaatataaaaactgctatagtagggcagtcttccttagaaagggattgtgggcatgacagagaacaatattaatctgtccattatattccttaactgtaaaatggagaccatatgttccaccagcttcacttggtaattatgatacatggctattaagagactcaaatgactccatttcatcaactaatatgccctgtcaattctacttctaaagtatcccatgttctatccaatgtcataccactatcataatttaagtgttcataactctctataatatttcaataatctaactggtctcaatgcctgtagtagaaattgcagattggctcacccaatttctgttccctaggaaggctgagaagcttttaaaaaaagaccttcatttccctaactcccttgcagctggagttccacctgcaagcagccagaacttggaagtaagttaatttggttctggcaagtagatgcacttccacaagatttggaaggtgagagtgatgtagaggccagcctcttgtcccttctgttgcttctgtttacaagggaagtcatggaaatatggcctccattcctcactgttccatttctcattctctaaacaactaatcagttgtagtgactcttgactggaactcccttcttgctggatcacaggtacatgaatatatttttgaacacagacttgaaaatcacttgtcaataaagtttgaaaaaagacattcattgtttcttaccatctccctttaaggtagaaaaagaaaacaatctcaccatttctactttataagtaggaaaactaggactctaaataagctcaaaacagacacccacccagctcagtaagaccaccaaaaaggggtacaggtctttccattctggtgaaaactaaacccatgtttgatgaagtctccacatggtcttcagtttctagtactagaataacatgtaggtgacatctgcaccactgaagccattttgtttggatcaccagagtttaggtaagactacagcataatggaaaagaaaaaatattaaaaacattatattgatattcctataatttttaatctactaagtaaaaaagcaaggtgtagaacactgcatatgttatgctatcatttgtgtaggaaattatttaaaaataggaatttgaataggactcaaaaatccctggaaagattcataagaaatgagtatcatgaatttttttctgaggggaaccaagtagctaggacaatggtggaagggtgactttagtctttaccttacgtacatttagaattttgaactgtgactatattaactatttaataaacaaaacacatttaaaaatgaaaaaaagatgcaatgacaaagcctgaaaacagaacaaacaattgttacatacaaaagaatcaaagttttgtgcattttatttaataaatttaggccataaaacattgtaacttaaatcgcttctatacactatatattcatataaccttgttggcctgaagtagatgcttactaggaagtttttccatggcttctttttaaaatcctcagttatcttctcctttttaaataaggattgtatctgcaaagaaagaaatggggttaaatgatatttagataagggatggtatttcttttaaaggtaaagaactttcaaactgtagtcacactttggcaaataggatgggaatgacaattttgtccttaggatcagatactaagcactgacatttttattttcatgtatccctttgatgttgctttgatgaaaatatggtaaaaacaaaaaaaaaatcaacaataacaaaaatcctttaaagctttaaaataattaatgaaaacagtttaaaaatgaaggtatgtttacacttctttctgtatggcttcaaagatccccattcctccccataataaaagcatatcatttgcacaaaagagcataatctacttaaatgtaattagcactttacaacattttctcctacagcagttaaacaaatatggctgaacaacccatctcatttgactaatgaaaaaccagtattgtctgtcaacacttttttttttttttttttttgagatggagtctctctctggagtgcagtggcgcgatcttggctcacgcagcctccgcctcctgggttcaagcgattctcctgcctcagcctcctgagtagctgggattacaggtgcatgccaccacgcctggctaatttttgtatttttagtagagacggggtttctccatgctggccaggctagtgttgaactcctgacctcgtaatccgcccacctcagcctcccaaagtgctaggattacccggcctgtttgtcaacatttttaccagcaatttatactgtcagttatgaaattagagaatcaatctaattggctgcaaaacagactcaaaaataatttcttcattctgtcttctcccctgatatctacctataatatagtattttattagtatttcagaggcaattattataataggtttgttaggcctgcaggaatgctgaaaatgtattaaatcagaattaaattataatcacaaagtacaactctaaaacctcccacaaaaacctgctttgaaactttaatctagccttttgtttttatgcatgtgccaataaaaactaaacaaatggtctggcattttacttgtcttaattcaaaactcaatcgtaattctactcagagctgaaaaatctcacaaatctatacaacaatttcacacaattcgggaaccgtctttttgcctgaatgcccccatacaaattttaagtatcttataacttaaccccaaacctcgatgctatagccaataaacccaattgagaggtgcttaagtaataaaaataaacacttgtgttaggtgaagggactaggtgtctatgaggacagaagaaacaaattcttaatttctatgaacagaactaaattttatatacatctctcaaaggtacatgagaaaggtgaatcaaactttacctaaaaagatcatcagcaagagactcttcttttgcatgttgattttgtacctgtcaaaattaacataatttcaaacatttgctcagtggtgaatatatagttaatgaattgctatagtgataggtcactgtcatcttagagatttccacatcctggaggtcaccacatctgagttcttgcctctacaatatttcattcaactgatcctctatattttcaatccatgctaagattattacaaaagagctctaactaaacagctttctcccacccatctccactcaaagacaaccaatagtatattgctagcttgctgagtttttaaacactctttccagcaaaacccttttactaaatgagatttcagtgcttgggggtcagaccactgatgagactaagagggcaacatttaccccaccttcaactagagcagctccacagttaaagaggctcctgtgttcttggtcccacatcagggcttagaagctgctgctaaattacctctcctctgaagtccttttaaatacaaactcactaaacttctacagcaccttacagagtcagaatcaaaaactccctgtgctgagtgcatcttcctaaagtctagctatgcccttatcatatgcaatttgaaacccttcgtgacttctcccacctaccaaggaaaacacaagcccttgcatttgacccgctgaaatgtgcaaggctcttcataacctggttccattttactttcctaatcacttctcagcctcctcttcgtggactctgtatgccggttaaaactgaatcacacaaaaaagaaaaaagcaaaaccaaaacaaaaccccagaatcatctcctaataaatatcctgtgaccctctatctgcttttgttcatatttctccctctgccaaggaagttaattcctttttttccctcttcccacatgtaaccatctttaaaggtacattcattcaatacttatttagtgcctactatgtttcaaggaacatgttcttcccctctttagcaaaggcttcctgatccccttcttctaaaaataatgcctgctgtgaagaactctcccaaaacttcagctacagaattcccaggatgcttatcaatttctaccttctgttataattatttatatttgtaccctatcctctctaaaagaccagaagttccttaaatacagatagagtaagtcctgacttaatgtttttgatatttcttggaaactgcaactgtaagtgagatgacatacagcagttccttgaatcatgttgttttgttgtaataatgagaaaaaatattggttatgtaattttgcttaaagttgcagtttccaaaaacctactgacaatgttaaggacttactgtgtttatttttactgttactaatttacatttgaatgcttccagatactatcttaaactctctctctctctctatatgtgtgtgtgtgtatatatatatatgaaatctcacttaatcttcatgtaacttcattactattatactattatctcagttttaaccaatgaggtaacagagacttaggttaggtaaacctgcagaagataggggaactcagatggaatagctgggatttgaccaggtctaccttattaagagcaccagctcttaacgaggctgcctcagggcttctgaatctctagagcaagcctacaagagtgacttgcagggattcgatcttacagactgatttttctatcatatagtgaaacaaaattacatcttatcttttcatattttctaatagggatagcaaaacataaatgggaagacatcattttaataaaacagctgtcaaaataactactggcaacatttttctaaacattcttagaggttgcctggggaataaagttgtagcatagtaaggaaaaaccactgaggagaaagcagttttatttcatatatttcagtaaaaacatataaaatagtattaagaaacagaaatgcctcatattactggcatttttcagaggtctgagataactactactcacagtctttcaaattcaaatcaggttggatacagttcaaataatttttatgtttgatgtacacaatgaaaatatcctaaattcaagggaacttcaggaactgacgcagtgattatgaaaatcaagactggtgggtctgcagcagaggtagagaaagaagggatgaaaaagaaaaatagggagggaatatagaaaaagaatagctgcagcaaacagggaaatgagatggcagtacagaacatttacataaataagcagtagccatgcagcaaaagcaagtcaagtctgttatagagtaagtcctaccaatagcaactaaaatgattctagcaaaaagagaagtgatttggtgaaatcatctagaacacagtccatctaattcctaatgaaataagcaaaaaaaaaatagaaaaaagtcagcagctgtatgatgtatcatcattctctcaacttctcccatctaaaattaatcaaacaaaactcgacagtgttaattaatcaaggagaagagtttaagccatgccatacgcttaaaaagtgcagctgtaaaaagaaccaaatgattctgatgcagctgattcctaatactgtctcaatccattaaaagtgctacacaactggtcaaacctgaggattcttactaatgccccaaatttggggaaaaggtaacctgaacagggaaaacaactgccagtgggctgctgggaagggactaatggtgtagaaggtaaagaagcagggctgacactgaccaaacacataggctccaaggatccctaacaaattaggtaaacaacctaataatgctaggttattctcttttatatagggcacactccctggtataggacatttaattaaaatcccaggagacagctagcccaagctgcacacagctccagctgagcctttcctctcccagattcaatgtcttcagacaacagaaactagatgggatatgccatgtgccactgactgtttcagcataatgccatactgacagtgaggcatgagggaattctgttctttaatttttattttatttattattattatttttgagatgtggccttgctctgtcaccaaggctgaagtgcaggggctcaatcatggctcactgcaaccttaacctcccaggctcaagcaatcttcccacctcagcctcctgagtagctgggactatgggcacatgcactaccatgacccgctaatttgttgtgtttttttgtttgtttgtttaattttcatttatttatttttttgtagagacagggtctcaagatgttgtgcaggctactcttaactcccgggttcaagtgatcctcctgctcccaaagtgctggggttatagtcatgagccacaccattgtgcctggctgaattctgttcttatgggcaagacaagaatgttagaagtaattttgattatactgaatttctgtctcacaaactggcttctgaatgtaatccctgcatgagatggcatatgatcctttatgtagcaaacagaatatctggaaaagacatttccctttactcaagtgaaggcaaaaaacagaaaagctactccatctactagaggaaaaaaaaaaaaagggatattggaacagaacatgcaaaaaacagataaagaacctaatctgcaggaaataataatccacgaataaaaagtaaaatagaaacatgaaagcaatgaaataatgacaaaaaatcagataatagaacaatgaaatgaaaaaagaacaaatgctaagtaaaagaaccataataacagcctttcagaattaaattagaaatagctaacacttcccactgttataaatgatttatatgtagtatctgatttaatcctcatatgtctgtgaaataaaggtactattattattctcattctgcacagatggaagcagagacattaagtaatttgcctaaggtcacatacttggtgagaaacattatagacacacctgaaatgtaaaattttgatacagtgaaagagcctaagaaaaccacagtgaatgcagaaaaaatagatgtggacgacaaaggtaatccaatgaaaggatagttatgtcttaaatgtcttatagagagcccagcaaatataaaatatttaaaatatataatagaaaaaagttccttgagaaagagaattacacctgcaaatcaaaacagcatactatatgtcaggaaaaactaatggagaatgatcaacactgagatgtattctgagtgttactggctttcgagcttaagaaagatgactggtcatgcatgcaagtcacctaaaaagggaaaaacaggactggcataaggtaagggaggctaggtgggaggaagtactaataatgtcctcacttttcactgtagcgagccaacaaataattgtatgtgaagttaatatgaagtttaaaactacccattccgacttacagtgatttttatagttttcctccttaatattagacagatctcacaaaataaaatatcttggagggaagaaacatttatagaaattcagcaatgccttcagtttaacttcctcctatcaatgtctctctcttccttcccagtctgtccctgcctctcactactcctcaatgaagagatgtctggaatattgttcacttaactgtttaaataggtaatttctgggctttaggttttcacatcttcattctttgtgtactgccataattctgtggaatgcacatgttacaaaataagccaattattctttcaaaaaagaaaaggagaaaggatgtgatttccattctttcattttttaaaaataagtatcctgagtgaccttaacaactctactttcataagtgactttcctaaataacccttattttaaaataactgagaaaaaagcacttttaaaagtgaattacactatacccactataaagcaaaataaggaaccctgagaggttagcaaggaccacagtcagcttttgccttgccctatgagtatctgcaagtcatgaaaaacctgaactctgctttaatgtctatacggggtatgagtgatacgaaagaaaacccaagatgttgactttaataaaagacccagcactaaaagaagaaagagaaataaaccttacaacacagaaggagctaggaaagaaacttgcccatcttcattctggcacttagtgaaggaaataaataaaaatctcatttgaagtttctaatgataagccagccttcattcactccagcttctggtccaaatattaatacatactaactgtctgggtgattcaaagaatcacaaggagagattttaatttgaagtggtctcatattggtagaagactcgaagatagaaaacgtatcttttctagaggaaatacatctgaacttaatactcaagaaaaccctacagatcgagttacaaagaaaacaatcagctcatattcaaaaatcacaaagcacaaacttgaaaacaaggtacataagagcagaaaacagatcaaacattttaggtaatggtatcattaggcaaataatataaaaggggaagcttgaaaaacagcaaggaacaagaagatttagaaagaaataaaacagacttccagtaatgaaaaaataaatgaacggatgcaatgccaactagagttgaagacagtagtagtaaatcggaagatgatctgcagcagttgccaaaaatataacccagggaaacaaagaaatgaaatacacaggaaagacaaatggaaaagaaaatttaacttacgttaagttggaattccagaaggagataatggggaaaacagtaaaaaggtaactaatattcaagagaatgaataagaaattttcagaattgttaaaacacaatccccagatttaaaaaggccagtcccttgacatacatttaagtgatatatttgtaatatcctccacattcttttagtttcccttaaatttttgtggcttttatctcccccttttcattaggatgtaaactgaatttcttaggtctcacctttttttttttttttaacaaaaataaatttagtattcttttaaagaagtgttatggaagggtatagattaatgctctgtaactcaggaatgctcctgaatgaatgactttatgtcacttattttaatttggttttaagaagaatttgcttgaaggccaccataatggaccaaagtgcaatttaagcaagtttctgggcctcacttcctactaacctccatttcctgccttagccactcttctagttctgtattctttcgagcatgatgagctattagatctgatcctccaatgatgtgtggaagttttcctgctccaggatatgtgacctattgaataataaaagtagtacagtaaatcatattaacaaacaaaaatgaccatttttttaaaaagattaaaaagcaaagatggtaaatcatgcataagtgccaaagatgtttatattctacaaataaaagtgagagcagtaactctgttctaaacccatctgtttttgcccttcttttatagctattactatatacagatctggacatgtcatgggatttatgtattaaaaataatttaacacttttcatttggagtttttattttaaaatggccttaccttatcatttaacaattaaagcaactcaagatgaacacaaacactacaattcaaagcactgtattttgttctaatgacttcaaagcttaagccctttctaatattgatgaaaatttaaatctttttcaaaactttccagttcacagagtccaagcaggagatgttggggatgccaacaatttatacttctaattgatattttaattgtttactagtaaagaggtgctttaagaaaagaaaattccatgtgaaaatgcccatcaagatcattgttaatacttgttattagttaataacattgttaatagtaacagttccttaatatttgtaacatgcttttaaaattccaatatatgaagtagaaagagaattttaaatttattttcacccctaagcagtattttaaaagtttaaaaaacgctatgtcattgatttggagggttttttgtttgttttgagacagggtctcactctgtcacctaggctggagagtgcagtgtgaggagagagaaaatcacctggtgaccatggaacaggccccagagacaaaacttcttctctaagcaatttagaagggggcaaagaccaaccggtgaccatcaaacaggctaactggaggcaaaactccttatctgggtaatttagaagtaatcaaacttccctagtatctaaagtcggcttctgattccaggcctctttcaacttttataagtaactaaaatttttatacatctctggaatgccatggtgaaactcattttacaatcccaagctcccaccttaaggtccataaatgctcctaaggacaatccgccacagtgtgctcagtcctctcgctgaggcacccctctgcattcttctgcagtgttcttcctttctaataaactttccttttccaaatctatactgttgtcggtaaattcttttcaccaacccgcaagttgaccacttcctggtgctggggctctgatacctggcccggcacagtggtgtaatcttggctcactgcaacctccgcctcctgggctcaaatgatccttcaacttcagcctcctgagtacctgggactacaggcagacatcaccatgcctagctaatttttatatatttttttgtagagttagggtttcaccatattgcccaggctggtctcgaactcctgggttcaagccatccacctgccttggcctcccaaagtgctgacattacaggtgtgagcgaccaggcccagcatgatttggagatgtaaagaactcagacaaattcctgcattaatatcaatccagttaaacatcttcctatagaaattttggattggatttcttctgtagtttcagaacagattacttggttaaggatagcagtatttttaaacattttaagtatttccaaaccactttccagagattcatattacttcatacttcttcagttgttaataaaccactctgtgccagtagtaaacattactgctgtttctttgtaaaactataaaaaaagtcttttgaattttgatttaatgagatcttataacacaatattaaacatgaagtaaccatgcagtaagaatgcctttgtgctattcatgagcctcagatatagggtgagaaaaagtggtgttaaacaaaaaggtatagtggtgccatttaagtggaagatatttccatcttctgctctaagtagaagagattcttcccatcaaatggagttcagaaccctttaggtactattacagaaggcaaaaaactaatttaactgtgaaatgttaatagtaaatgctcacagtagagagaaaaatctctactacctcacagtcatggcaagatcatgttatagaggaaagcagttctccacaaaaattacttttgagtaattactatactctgatcaaatggataagtaaaggctagcagtcagaagtaggtctggagcaagaagcaaatgtaagacaacaaaagaatacctactggatagaagtctttttttaaccattactgataaaataagtatcagttccttaatgagcagaaactcaggtctgatgatcatactcagcatatatatttatattgtgttttatatgtaaatatagactatagtttgaattactgaatatgcttagttattttaaatacattttaatcttcataaagtcctgagctaaagaacctcctcaagtagttgtagaccaatattagactaacagagaagatcctgtgattatcaacaaaaacttcctgcttaaggtagagaaaaccaggtaaacagcaacctctaaagaattcaatcttgatgaaatctatttcattctaggtgttcaatatattcattaactgtaagttcatatccttcctagaggaattttttaaagcattttaagcagaagaagtatcagttttcaacataaactgcttttatctttgtttagcatcactggtatctctaaaaacatttcaaacactgacctcttgtgatacagttgaaatacctacctttttgaatttcttgaaattttttagttgaccataatcatcatttatgccagatggatttctggaagtagagtttttaatcaccagtgatctaaattcagtcaataacagcttttttggaagcatctcactatcatcctgaagtttgtcattgttcttaaatggggttaagatggataggtaagaaagagaagaaataacaaagaaaagtcacttgtcatttgggaatctatagaaaaaagttcaaatacctgaaaaaatagtaaaaatgttttatttcttgtacctgaactttgtatttggaatcaaattgtagctaattcaagataagaaaattacttactcaaatgctctataaactttggaaacatttataacatactcatctgtgacagaaggctaaaaactgtgaagcatttttaacctagtagttattctaataaatatcatctcagtaaacaatttacctccagatatatatcttattgacacaaaatctcagcactgtttgcttttcattaaaattgtacactgagattataatatatcctgttctacaggtcctcatctacttttcttaaacttttgggattctcaagagtttgtatcttttattattcttaacacctcaaaaaagtcaatcatcagttctggacatactatctcattaattgacaagccatttttaattcaagattaatagctgttaaatttgcctcaagagtccttcctgttatctttcaattgctggatgagattcttggcttcgtgtcatttactattaactagtcagttacacatcaacattattacagctgcttaaggttgacatcttagttcttttaactgctgtaactacataattaatatgcaagttgctaataggtctaagataaaagcagtcaaaaagaaaaaaaaaggggaaagtcagaaaaaaaggttcatctgatagtgacagaatgtaatcagcacattattaagaacagcctaaacttttagagtttacaaatatttcccatccattactcttatctgatataaatcctgctagaaaagcatcaacctcattttatagagtatttgaggttcttaaatgtgaaaatgacttgttcaaggccacatacctaaggagcagaaggcagggaattacaccctggcttctctctatactcttttcactgcatcatggttataatacgatctatccaggccgtgcatggtggctcaagcctgtaatcccagcactttgtgaggccaaggcgggcagatcacctgaggtcgggagttccagaccagcctgaccaacatagagaaaccccgtctctattaaaaattcaaaattagtcgggcgtggtggcacatgcctgtagtcctagctactcgggaggctgagggaggagaatagcttaaacccaggaggctgaggttgcggtgagccgagatcacaccattgcattccagcctgggcaacaagagcgagattccgtctcaaaataaataaataaacaaataaataaaataataataataataataccatgatcaatccatttcaaggcacaatcatgaagtaagccataattaggaaagagaaataatcctaagaatgtaaaatcacaaaaattgatgagatgacagtccccgtaagccaaatctgtataaaaattaataaaacgtttctcacagatatttctttagctgaccatagtgagtcttccttgagttcacgtttcttcccaatttcattttcttgctaaagaaataaaataaaaaatactgttcataggagtaataaaatggtatgtttctatcacttcttggccttttgaataagatgaagtgtaaaatggttcctttctaaaaacttaagagatattcatgttatgtatgaccaggcatttggctttcaactgtctttccaaaagaaattatgagatgaaaatatatattgaaagagatactgcagtatcaggacaaagaattggaagcgatctaaatccatataaatcacatgcttagagaatatttaacaatatgggaaaatgattataagtaaatttaaaaaatgactacaaaattgcactaacagtctgcaaaataaaatggaaagagaaaataccaaaatattaaccatggttgtctgtagatggtaggattatcaacaaactgtctgttttattttctacatgtctgtacgatcgtgtattacttttaaaatcaaaaaagaaacattttaaaagaattcaagtttacaatagtatcttaaatcatacttaaagaagaaacagttacttcaactgttcaagatatttgtctgcaataaaaatgaagactgccttgtatattagtcacagtatctttcacattaacatgtctggatcatgtcctagacggaacaatattacataaatgggtaatgatttcagtaaaaactacaattctcttggatgcaaagtggggcacataacattttacgtcacattttcagtaatacagcagtaagtcttaaaagttttaaaaatgaagttggaaacggcagaaaaacaaatgtactttgtgcttccccacagagtaaagaggatattttaatcaatagaattaaatgtatgtttcaagcctatcaagtgccattttacttaggcacatatcatttacagaaagttgttatcacaatcagaacattttactccctttatacataatcagaatacaaactccttttatgtaccttctccccatcctgccctactctctcaaagttgctcttcctcttgagcaagttttgattttccaactcagagaatcatacgacctacctagatactcagaatataagcttggaaattatcttatattctttcctatctatttatttcccatataagtaaaccaccaagtcttggggattctacctcaatgcctatcaaacttctcttctcaaactgcctttcatggcagatgcccaatgcctacagtaatggaataactgagtgaattacacagtgaaagctaacaaaaggatcagtcagaagagcatggcagacctgtgtttaagtccgagttgtcaaacctagctatgtgaccttggcaagttacttaaaaactcccactatcagtttccacacatgttcaataggatattaattgctgcattgtagggttgctgtaaatataataaaagtatccaataagtggtagctattactacagggtactggaaaatgctgtagttttaagaatttactactgggtattgaaaaaatgctatataaaaatgcttgacttgagaaaggagagtacaatgaagtgaagaggaaatatactatagacacagtgggtgctgttaaggagaagaatgttaaggatcttgagtcagttttgcattttatagagactgggaaactgaaagtaaggccaagactcaggcacagctatcattcgtataaggataaagtcctaggaggaatattaagctaatagttttccatttcagctgacaggaaatcttacagacatgctataatctaaatttagatccaaaaacagagaaatgacagttctaccatcaacatctattggaaagtgcctttctgaaatatagctagggattccaacaccaaagagaagtatcacattttttgccttcaaaaaatcgccaaaaaaatgtttaaatgaaaggattaagaagtatttttctctgacagtcacttctgtagctaaaaaaattaagcaccaattcctttaatccatgagattaacatggactttcagacaaattcttaaaataacaaaaataaaataatttaaaacaaccccacattgagtaaggttgatggattttatcaatgtcaatttcctggttgtgatactgtactgtagttatgcaagctgtaacaatcaggggaaattagataaagggttcgctgcatgtggacaaacaattgtctcaaacagtttttaaaagtaaccttacattgaaaacagaaatacttttgtagctattacagattcttactaaaaatattatagtgctggaatacagtgatttaacttgtagtagtcatccctgtggtatccctgaggaactggttccatgacttcccatggacaccaaaatccatggatgctcaagtccctgataaaaaaaagcataaattttgcatataacctaggcacatcctctcatatactttaaatcatctctagaatacttacaatacctaatacaatgtaagtgctacgtaagtagttgttatattgcattgtttaggaaataataatttttaaaaagtttgtacatgtacagacgcattttttttttcccaaatactttcaatcacaggttggtaaaatcagaggatgtgggacccatggatacagagggccaactgtatctcaatgagagataccgcaattaaattgctattctttctccaaaagcctacaacaacatattttgtactgtaattttcatttagaatgtcatgaattctcaaacagtaaaataaaggaaaaatggaattatgctatagaatcatagggcaaaataaaataattatatttcctcatatcgttatacctcatataaaccttacatattaaatgaaagtttctttcggtctatgaaagactgtttgatggctcccatgtcaagggtgtatagtgctcagttcttgtctttccctgtctgtgctctaatgcccagtgccctgagtgacataagccctgggagaatgtgcagtgaaagtaggtcttcaggaagattaattagcagtcatccaggatgagccaaggagggctgttacagactaaaaccacaaccatttccagatagatttgtggccaccatagcagtagactaatctgggatggaatttaagggaaaaaaagtggggtgggggtagctacttaaaaaaaattaaagtcactttgggaggccgaagtgggtggatcacgaggtcaggagattgagatcatcctggctaacacagcgaaaccccatctctactataagtacaaaaaattagccaggcgtggtggcgggcgcctgtagtcccagctactagggatgctgaggcaggagaatggcgtgaacccgggaggcggagcttgcagtgagcggagatcacgccactgaactccagcctgggtgacagagcaagactctgtctcaaaaaaaaaaaaaaaaaaaagattaaagcatgtactaggacaagaagactaaagaaaataacatgtcagagaaaatcagaggagaagagagcacagcaagggaaatgtatttccaaaggtgtggccaaagtaatgtaaaaagtgcctaactttctaaacacttacatgtaatattaagtaacctgaatacagattctgaaaagtctggaactaaagtaacaatgtaaatccataataccaacagaataaagatagctttataaacatatgtaaatgtattaaacttagcaaatgatgtcttggatttcaacaaatgtcacattaaactaatttacctagctctccaccatagtaggaattgcgacagaagtgacttatagaacatacaaatctcttgtttcacttagtgcatctgtgaaatgagagtagtcttaaatccttcacaataaaaaaaaaacctctgtctctgaacttctcactctggctgcaaaatggaatccgataattcaacattcattctctcttttttccttaaatgcaactctttatcagggacagcaatgtgccaagtttaaaacatttccagactcttctagattgaggatagagagtggctaaattatttccaattctggccaataacaaaagctattaagttgggtttctgagaaagctccttagaaaacagggaggaattcagctggaaaggcctttacctgtcccctcatcatcacattctccctccctggaaagtagacttgatggctggaggtatcctctcaaagagcagaaagacagacacctagtaaattaataccatgggaagcagctctgattatctacttccaggacacttttataggggaaaaaagatcctattttacggaagccactgattttagaatttttaaaaatatcaaaggaattcttagctaacccaatgagggaacttatcctgggaaggaaaatcagatatactgaatgaaaatctctggggctctggcctgggaatctatattttagaaaagcttaccagctgactccaatgcagctggtccacagaagggcatttaggatcactcagaagaagtaacaaataatggggattcccttgcctatatgaagataacaatacacaggccaaataggacataggttctgttttttgaatagtagttgtagatttataaggtccttgatacacactaggttctcaactgcttagctaataaactataacttccgttcacttaatcctatcctttcgcctattcctgtccttattctgcaggtgttactggagaggatgaccacagccatgaatgagtggagctaatgaatccacattggagatcagaatattaaagttttacttcatcaggtctgtgctctcatctaaagagctaacaaatctacagataagtcaacttactgatgtatacaaaaaagaaaataatctcaggtgttttcatagatcaaagtgggtaagacaaattatcaacagtcatgaaaatagacaaggacattacaaaacctaaatgaaaatgaaaattcctagtgatgttatatcctaaaaatttattgagtagatactttgttttactaacttcatctttctgtgcctgtttcttatactgaagcatctcctacacttatcatcatagccaaatgtcttttataatagtacagcctaatttggaaatctagtaaaacaatctcatatgaaagtttaatttgtggtcatttattttacactactgaagaatcactgtacttttaacatttaccatttaccttatcaaccaacaaatttctatagtactgagtgttaaagacattaatggatgctcatactgtcaatacaaaatcgaaagtacctgttagcattctaagcttctatgtactatacctctcatttaaaatgttacttacagatattttgctactttctggtactgcttcatcactgaaagtgtcatttgtttctatatccatccttggcctttttctaacattgacatcttcctcctgtttttgaactttcacatcaatttctaactctggttttgtgtccttgaataactgttccaatacttcatcttctatggccacatcatccatttccctttttttatttgatcttagcttttctgcagcatgagatttactggcagaatttttcacaatagattttaaatctgtatctgtaaataagttattgtctgagtttgtgtccacaggctcattctcagatagatgctgctccttatttttccacaatgagggtgtagcaggttgtgtttgttctaaaagagaacaagacgtttctattcttgctgatttgcatgaagacatttcttgattttcttcatccctttcccttagatttaaaaaaaaagaagaaaacaaaacaagaaaatgaacacagctaagtaaccatttagtttggcaatattcatcactccctccatttagttcacaatgtactcttgattttattaacaatattactggaaatcaacaaatagacctttgaaaacagtgcagaactcacatacattctgctgttttgatagaactgacggaccctgtggctaaagcagtacggtgatctctatcttctctgcttaagttgcattagttgataaattacaggaaaaggtagaaaaatataaaaatacaaagaaactgttgccaagagacagcaacttactttataacgtagtaaggttgtgggcagggaaaactgccctgggaatacaatctgatgggttaatgagagatggattcaagacagtaagtcagagtgactaaatctacaatacggtactgactgtatactgcaaatgctatgtgaatatatcactaaaagtttcctatacaatactgtatcattcattcaataaataccaaacactttatgcaaactgtactaagcccatagaggacacaaagacctgggactctgttctccaggagtttattggattcatgttgaacaagaacagtcaacccaatgttctattaacactaatttaatgccaaggtactggacaaaccaaccaatcgagaggtttttgtaataatttaggtggtcagagtttgaacctggcaatagatggaaatggagggattgacagacactgaaaataacaatcaataacactgatttcaggagccagaggacaagagtcaaaaattgtaacaacataagctattttactaaaaaaaaaaaacaaaaccacatttggtgagaggacagaaaaagtttttaggtctattactggggaaacagcatgaaacccctgtggaaaagaagtaaagtttaaaggaaaagttagggccacatatgttgattgtcagtaataaagtctcaaaacctgaaggtagagtataaagagcagtacggggaagaaaagaagtcctccaaagttcatacagaaatgggagaaataacatcatcttttctgagaagcttaacgggacggcacaagaaaaaaggcagcagtagctagaggaagaaaccaggtcaagagaaggttttcaaaaataaaggtgagattgaacttttgaaaacagaagaaaaaaatctgggatgatcaatatattcaaaatatggaaattgagaaaataattgatggaatatggtcctagagggagtgagagcggttctcaaggaaaaccagcagaaatgtgattttagagctgagacagggggttagttcttattgaagagaattgcggcaagtaaaataacacgtaagtacatacatagaaggagatgaaggagaaactgtctagtggctctagtgaaggagatcagggacatttctgagagggaaagcggtcaaaaagctgcagcagcagaagcatacttaatcagaacagactaaagacaataccattctacaacagtataaaaaactttcatttttttttcagagacatgagagaagttatcaaaaacagacctttttttggtagacggctgaaagtagtttctgatggagttggtctgctgctgctgagaagccctatctttacttttatttatacttggcaatttagttggtgaaagctgatagtttgggattctcatcttagccaaagtatttgataccatactattattattagagcttgttttgcaggactcctttacagtgggtgcatcttgtgaaagcattctgaatttttgttccattttggagactttgatttcttttggcctttcactcaaatccctgtagaaaaagaaaagaatgcaaggtaaataatcaagtttacagcaactttaatagagaaacaaagatcgttaaatagttctaacgtaatataaccttagaagataatttttagacaaaaatacactgaatatattttaccatcccaagaaagcaactcctttattacctaagcatcctgtggaaggatgataccttactcttcttcaccccctacagcacatattgttgctccactatagacgactgacaaacacacacagaataccaacttagcatagcctattataagttaaactaggtgataatcctaggcaatttctgttttgtttaaaaattttaaattattcccacgtaaaatcactattatggtactttcattattatttattattatattattatagtacctttttattaaaaatggaaaatcagaataaaatcacatataagatattcaggtcactgtaaatgaactgatatcattatttcagccagatggcagactcgagaatagaacagaactttagattaccagaaaaatattttcaacatacatgcacagagtatacttttatatactttttacttttacaaagtatggttaaattagacactgcctttgctattcttattttacagaaaaaaaaaaaacaaaaacaagaggtcaggctgtcattcaagcaacttccaaaaccttaacaatttctcttgaaaaagttaaatctggcctcaatatgagtgtagcaaaaattaaaataaataaggtttaatacagtgatatcttaagtatcttaatatgaacacttcattatgtcatatttaaaataaaaaacatacggttgtaaatagaaaataacaaataatataaaagtgctaaccccttccattaaaaacaaaacaaaacaaaatccctcttcagataaagaaccatagaaaaactatctttatggacaactattaactatttaaatagctaggtagacacatataaagtatcttcaaaattacaagtaacattcaaatataggcaacatcacgcaatacaaatatatgtatttcaaacttatctcaccagttacaaataagttgaacaattctttccagtcatccatgtacatttgcaaggaataaaaaaactatcctaagacaggagttgccaaactacagcctgtaggccaaatctgatctgccacttatttttataaacacagttattagaacacaacactttcaattacagtcacagacactatataatgatatttctgtcaacaatggactgcaacatatgatgctggtcccataagattataaaggagctgaaaaattgctatcacctattgacagcacagtgcaacctattaagtgtctatggtgatgttgatgtaaacaaacctatgctgccaattgtataaaagtatagcacaacagcacatacaattcggtacaatacataatacttgataatgataataaatgactatgttactggttaatgtatttactatattatactttttatcattagaatgtactccttcttataaaaaaaataactttaaaacagtctcaggcagtcccttcaggagggattccagaagatgacattattatcataggagatgacagctccatgtgtgttagtgccccagaagactttccagtgggacaggatgtggcaatgactgcgatgatcctaactctgtgcaggcctaggctaacatgtatgtttatgtctttgtttttaacaaaagtttaaaaagtaaaacaaaatttaaaaatttgaaaacagaaaaccttatcgaataatatgaagaaaatatttttgcacagctatacaatgttttaaatgttttaagctaggtattattaaagtttacagagtacaaaagttacagtaagctaaggttaatttattattgaagatttttttgcatataaatttagtgtagtctaaatgtagtgctaataaggcaacaatcatgtacagtaatgtcctaggctttcacattcacttaccactcactcattgacttacccagaacagcttccagtcctacaagctccattcacggtaagtgtcttatacaggtataccattttttatcttttatacaatattttttctgtaccttttctatgtttagatacacaaatacttcccattgtgttacaattgcctacagtatcagtacagtaacatgccatataagtgtgtagcctaggagaaatagtctataccagcagttcccatcctttttggcaaccaggaccagcttcgtggtgaggttccaggtttgcgggcagaggggggaatggttttggataattcaagcatatttattatgtactttatttctattattattacgttgtaatatataatgaaaaaattatacaactcaccataatgtagaatcagtgagagccttaagctcgttttcctgcaactagtcagtcccatctgagggtgatgggagacagtgacagatcatcaggcattagattatcataagaacctagatccctcacatgcacagctcacaatagggtttgtgctcctatgagaatctaatgctaccgctgatctgacaggaggtggagctcaggcggtaatgcaagcaatgggagcagctgcaaataaagatgaagctttgctagcttgcccgctgatcacctactgctgtgtggcctggttcctaacaggtgatggactgataccgtggctgagagataaggaacccctgggctatctatactatacagtacgctataccatgtaggtttatgtcaacacactgttcgatgttcacacaatgccaaaattgtgtaaggaagcatttcttggaaagtatccttgtctttaagagactacgtattgtctcttgacaatgactacatatcgtctatggccactttcatgctacagtggcagagtggaggagctgggacagagatcaacagtcttcaaagccgaaaataactactcgccgctcctttacagaaaacctgctgacccttgtcctaagatatcattttccctggtatcccattcttccatgctttctctctcaagagacaacctgataaagggcattacttcctgaatatactattaatttattgatagaataataacaatagtacggtaatgaagaagctttaccatgtatctgcttgctctgattctgtgtcagctacgtatgttgtagtgttcactggggcgcttggcattagtttttcatcaactgacacgccttgtgaaaggcttggtcctggagttgttgtctttaatcctgtaaatcacacaagtagaaagaaagaatcacaactgctagatagaagatgaacatctggtcacttaaaattgttagactataccatgctgaggggattaactagggaatactgcacatggttttctccaatgagtggtaccaacaaacacaaaacagtctataagcagcctgcgggcatctatgacgggcttatctaaaccaaatcattttaaagccacatcagatactttgtgctgaagtcttatcaactgaaagaaaaataaaataagcaaattctaattcaaattatgttttaagtcagtgggccaaaaaattacatttattcccccacagaaagtgtatacaccctaccatctatagaaatcagaattagtgagttttattttcataaggaatacattatttgaaacaaatcatgtaaaaccatcttagacataaacttctggctactccagaaaaccataatgattacctcatctttttacttaccagaagaacaacttagttcaagtgctgctcttctggaatactttttttgaatctcccacactgaattaagtgctctccaattctccttccataccaccacgcaaatcattctaataacaattcaagccaggtgcagtggttcacgcctgttatcccagcactttggaaggctgaggcaggaggatcacttgagcccaggagtttgagcccagcctgggcaacactgggagaccccatctctacaaaaattaaaaaaaacttgccaggcatggtggcacacacctgcagtccaagctactcaggaggctaaagtgggaggatcacttgagcccaggaggtcaaggctgcagtgagcagtgattgtgccatggcactccagcctaagaccctatctcaaaaaacaacaacaaaaaagcaataaacaaaattcacttatgactagctgagtgacctgtgtcaagttatttaacttctctatgcttccctttcctcatctataaaatgagaataattataacatctgcctcacaaagttgtttggagggtaaaatagcccctagaaaaatgcttggaacatagtaagcactgtgccagcattagctgttatcattatcatcacttgtttacttgctactttcccttgttagactggtgtatccttgagaataaggactaagtcttgtgtatttctgtatcaccagtacctagagcaatatttggtatagagtagatgtaaaaaaagtttacactattaactgaaaaaaattttaagttgatatttactaaacacctaagctaaattatcattctgctaggtccttgtgacacaggatgtgcttaatatttactactaattctaaattcagatatttaaatgacttccgccactttctctatgtgacctctagaagctcactggcatttcctttaagacacatatctctagaattcattttcagctgcacataagtttggaaagagtaaaaattataaatgttcatatcatcactgaataatttaatgtaggctcggtgaggtggctcgctgctgctcagcactttgggaggatgaggcaagaggactgcttgaggccaggagttaagagaccaacctggtcaacatagtgagacttcatctcaacaaaaaaatttaaaaattagctgggcatggtggtgcacacctatagtcccagctactcaggagggtgaggcaggaggattgcttgggccgaggagttcaaggctgcgtgagttatgatcatgccactgtactccagcctgggtgacagagcaagactttatgaaataataataataataataagctaatgacccaaaataactggtgtttgttaacagattacttacaattttctccttgttaaaaataccataagggcaggaacttggtctcatctattcacctctttatttcaagtgcttgccataatacaggtatataacaaatgttcaataagtatttgttgaataacaaaagagtgaatataaaaacaaaggaaggaggagagaaaagggagactcattcactctgttcccccaaagttggttgtgctataaaattattttattatcagaggactatgacttggaacccacctaaacctacctacgaaaatatgcaagaagtaatactacatacagtgtactttttaattcactctcatgactttgtttctgtaggaaataatacatcagaaaaaagcaccagtctggtagtcagaaaaccaaattttagaactggcttggccatgaagtagttatgtaccttaacttttctcagccttggtataccttatcttttaatagaacgattagatgatctctaaggccctttcagctataaacacaatttcaacagtgggtgacaatattttgttgctccacactggaaaacataatcttgtgtaccaatagcttagttcaattacgcaaaatatttatacctattacaaacaagtaccgtgcttgctgctgttaggggatcccaaattagtaagagcctacaatctactcagtggctgaaagaggtgtggaaacaactggttatatccaaagtaggaagaaactccggctggaatgcaaaaaagctactgagcatagaaacagaataattacatctgacttggaggagttgggagtgaaaacaatttagaagagccttacgaaggaggtaatcatttgtagaatgagtcagattttgacgagcagtactgaacattctaggaatggaacatgatgttcaaggtgaggaagtgtgggaactataaaaaatatggcacacatattctgtagagaaactatgtaaaaaaggcgaggtcgggaggaggaaggctgcagctaaactactgaggactcagaagtctagacaaagggcttggagatttattctgtggataataagagctagttaaaatttttgagaaaagagaaggtaattgaatagtggcatagtgaaatattaactgtagagatgagtctggagtaaggaccattactagggcaattactaatacaaccagcactccagagagaaggatgtagagggttcaaacagggtactggctgtgagaaggggacagtcacagacctcttgagcagaagctgtagagtgagaatttcaggtcttggtgataaaatggaaaaggaagaataaaaaatgtccaaagtttccagtctgagtgcttcttctttttatataaaagaagactcctctctagttcatttcttctcaagactattctaatttagtggtttctagagtttgtataggaaacaggagcttaaaaatcaaacaaaaccaaccaaaaaactcagatgtctaggatgcatcccagaatgttctgaatcatggacaatgtacgtttgtattcagaattgtttctgaagcatatatctagttgagaattgattttctaaacagagaaacacaggacagtgaccccaaatgggtgctgagacaaggggagctactgacttagacctaatcaccgtttttatatgtttgttgtaattaaagtctaaaattactgatactgatcttttttctgtaagagaacagaaatctatcaacaaaataatatctacagcacctgctagttctaaaagttgagcatatttctagtagacaaggaagcagtagtttctccaagaatatggctctctttggcatccacatttaaaaagttcccttgccaagagcctgaagagttggtctttagctttttactttatggatgaattctgggaatttggtgaaaatattaatcatatcacgattccaccaaaataagtgatttggttatatttaaaacttcacaagaacttacgactgtgtgtatttgaaggttacctatgtacagacacaaacatatgtagtatactcaatgggacagggtagagatgtcagctgaataaacattcttatccaaataataaaatactagcctgtcaaattttatcagatgtctatgcttttgcatcagctcccaatcatccctacaccaccatttctcaaaacgtcacacattaaaatataagccatttgtactgcaatgtgatgtcgtaacagctttaagactcagcttgaaccaattacttgctatgtgacctccagctaatttcctctctgtccgtcagttccctcatctacgaaaagtagatgatgctcttccctctatcttataaggactgttttgcagattaaagtttgatgatggtaaagtgcttactctagtctctgcacactccagagacagcagttattattactatgcatggttactaacgatctacatacctaatagcttcctggtcattaggccgtaatggctaactccttccaaaatttagcttagcacattccttacttgtttaaaccaaggttgcagagcactcaggagatacacggactgactccatagttgccattcaatggactacagtgaatgatgctccccggagtgtgcaatctggtagtgctgttctctaacttgtctcttttagcccaagttcaatagctgctgatgaaataactacacaacaaatccagggagcaaataaatatataaggaatacagaatggatgctctgagagctaggcaaattagataaaagttagtagagagaataaatgtaaaaatctccaaggtaaaaaagcaagaagaaaagaaataaaccatttttacaacaacttactaaaaaatttttttaaaaactatggaaatgtgttttaactaataaaggggaaacagtgactgtctctgaatacattggctttcatgattaacactgagattattataatgcacattcttcatctcagtaaatggcaccaccatccacccagttacttatgctaggaaactaggagttgtttctaactgctccaccggaaagtcccaccaggtctagttctaaaatatatcctgaacctgttcatttttctgcatctctactattaccatgctggtccaaggcatcaggctctttcacatccagatttccacaatagcattctattcacatctcctcttacactgtcgacccttagaattctccacacaaacctaagagtgatctgttccttctacctggaattatccaccacccagatcctcacacagctgccttttcccatcattcaggacacatggctcaaatgtcacctcctgagactttccttgaatacctatctaaatagcctactaccatcactattacatacatcaccttgttttacctgtctttatacttggcttgatctgaacttaccatgtgtgtgtgtttggttactaaatcttgatcttcagaacataaagtttataataacaaggatctttcttattttatttaccacttcataacagtttctgctacatggcagccacaaatatttatggaatgaataaatgaaagtataaatggatgaattttaaaacatggtgaatatggtcacccctagcaagtatatgagtaacgtatatttagcttatcgatttacataataaagttgctaacgaatcaataaaataatgcttcaattacctgtactgggatggccctgaggatcacagtaattctttgtagtcatgaaaatcaccgccaatccaatttctgcttcaggaataggtctaagaccttgcctattagaataaaatagtttaagtatgataatatattaaaactagcaacttttattcagataatgtcaagataaagcaacctcttttttttcctcccaaataattttatggtatagacagaatttcaaatgcagagtactataatagcttactcgctggggcactgttacgttgacaagtctaccatcttttagtaactccattaacttcatctgtaaaataaggggctaaagaatatagatcttcccagttctaaaattctacaatttttggaataaaaagaatacagtactacccaaattaaacaacagaacaggcttttatggccaggcatggtggttcatgcctgtaatcccagcactttgggaggctgaggcgggtggatcacttgaggtcaggagtttgagaccagcctggccaacatggtaaaacctcatctctactaaaaatacaaaaattagctgggtgtagtggtgcacgcttgtaatcctagctactcaaaaggctgaggcaagagaatcgcctgaacttatgaggtggaggttgcagtaagctgagatcgcgccactgcactccagcctggatgacaaagcgagactccgtctcaaaaaaaaaaaattaaaaaaaatcaccacaggcttttacaaacaaatctacggatactatgagcctaagatgaaacttcaaagagaagaaaaaaagaagagagagaggaaggacggagagaagtagacagaactatacctaaggtatatctatacatgtgttacaacttttagtaaatcaaatcattttgccaaatttacaagtattaaggtatcttcacattaaaggaatcttatggtgaacctattttttgttgttctgtaaggtcaatgactgattttataaaaacaaaaatacaccatttaatatcatataaaaattacacctcaaattttaacaaacaactacaaaatgtcttcaatactcattgtaaagatttttttttttttttctgagacagagacttgctctttcacccaggctggagagcagtggtgcaaccatggctcactgcaacctctgcctcccaggttcaggcaattcttgtgccctgagcttcccaagtagctggaaccacaggcgcgcaccaacacacccagctaatttttgtatttttagtagagatggggtttcactacgctggccaggctggtatcgaactcctggcctcaagtgatccaccctcctcggcctcccaaagtgctgggattacaggcgtgaaccaccttgctcagtcaagatattttaaatggttagttcgtaaggtctttttgaaatgcttaatgtgtctttttgtgtgtactgagcttacttaaataggattcagttatacgtgcaattaaagtatcagactaaaaaaataaaatctaaaaaacctttataatcaagtgatcacatatacctacctgtaatttaggtaattcaaaactggtattttatttactaacttttgcaactataacttatactatgtgaattagttataaagaatggttacataaaatagaaacatttttaatacatatttaataatgctctacagaaattacatcacccttaatggagaaacactggaagcatttattttaaagtcaacagtgagataaatgtggccattttcaccacttctgttcaacactgctctggaggtcccagttggtatggaacaaagagacagaaaaaagaggtatcagagaaataacgattacaaaggagaatggaaacattccttatagatgataatgatttatagaaaagactatagataaattattaggaaaaaagaggagtctggcaagatggctggatataagatgattatctgaatgtcagctgaatttctttacagcagtagtgaactagaaaaggtaatttaagtgacaatatcattcatttataataatatcagagaatatgtactagctaggaataaatacagtaagatattcaagatctctctacagaaaatataaaattctattaagagatttcaagcaaacctaaataaatggggataccacattcaaggataaaaacaattaaaatttacataaatcgttaattctcaagttgccttgtagattcaatgcacttcctaatcaaaatccaaacaaactttaacaaaagatgattctaaatgtaaatgaaaaaataaagggccaagaatagccaggatgcttccgaagaagagcaaaaaaagacttgttctaccagctaggaggacttcatggaagttatactaattaagacaatgtggtattggtacaaagaaaggcagactgatgaatgaaaaagaataaagtcaaaaacacaaaagtgcatgtaactttggtataaaacagaattccagataagttaaaaacaaatgtcaaaaacaaaagatggtatcaaaatactagtaaaaaacataggtgagtatctttagcactgactaaaacagaaaagatttttactatatagcaggtcctcgaataacatcatttcattcagtgtcatttcattatgacatcggcaagaaaaaactgattcctaaccagggccgctgtctgtgtggaatttgcactctcccccagtgtccgtgtgggttttctgtgtgtactctgctttactaccacattccaaagatgtgcacattaggtgaactggtgtgtccaaattgtaccagtctgagtgagtgtgggtgggtgtgtcagtgtgccctgcaatggaatagtgtcctatccaaggttggttcccaccttgcaccctgaactgctgaataggctctggccacccacaactgtaaactggattctggatgacagttatttcacacaggagaaaactgggctaggggtaaccacgtaagttattttcaaagatctggctggtattttagatgacagattttttcaaacacttgctgtctgaaaaataactaaataattggtgaacaaaataaatgtgtattacgcataaatcaatgatgagcatgtgtcatggaccaaggattatgattcatccaattctgtgcaaggctggggaacaggtcaggaaagaaggaaaagcaggaggaaataaagagaaaataattaaattaataacaggaagagttaccaaatttgagctgagataccggaaaaaggtctcagcaagaacaaaaatcagggctgtattgttcccctagacttctaatcttctccaaaagacacttaatctttaccacagatttcctatactcacttctgacatctaatcaatacagccatggcaatcaccaatcacaatgttgccctgttgaagttcggtcaatagctggctttactggccactctgcttcatataattgctccttcattggcttgaactaagttaacaggtatcattttaagtgacagtctttctcaaaatataatactgcattccctccaaaaaacatattgtggccaggtgtggtggctcacacctatgatgccagcactttgggaggctgaggcaggcagatcacttcagctcaggagttcaagaccagcctgggcaacatggcaaaacccagtctctacaagaaataaagaaattagcagcaacgtggtggtgtacgcctgtagtcccagctacttgggaggctgaggcaggagaattgcttgagcctgggaagtggaggctgcagtgagccaagatcacaccattgcactccagcctggagtgaaaccatgtctcaacatccccccaccaaaaacccaaaaaaccatattgtaacaggggccaagtgtcacctcatgatcaaggcaccagggtctgagctacctggtactccagctacttttttttaacctcagggtgtcaatatgtgctgaaagtaaagagcctggactccagaatccaactgcctgggctcacatcctggccaccctgctcactgcctctgctatatgcaaacccccttctgcctcagttccctcatctgcacagtgaggaccacaacagtaaataatatataggttgaggattaaatgtttatacatacataaattcttagaccagaacctgctatgtaggataattttttttttaatgtattactgctgttgctctgcttggcacattctttgtctggctctttgaaaaactggtcataggtaagacattgcctaaaagaggccttctctgtttagaataagcttcttccccactgccgggttactgcttcctttatatacatgtgtaatgatttgtttacttgtctttctctgtctctgcctctagacagtaagctccagtgatggcagggactgtgactatcttgtttttcattatatttccagtgcctaaaacacaatggaactacagtaaatttgtgttgtagtaataagatagtatttttgttatatagtatatcttcttttttacagtagttaatatatctcaattaagtaaaatatttataggatagatgactaaaattttactttttatttcagcaagcctgtaagagaaaaaaagaaaatccccccatggtcagaaggactcctgggacaggaagaatgaatctttggtaggaagctggctgtggacttttcaggcatataaacactttagtcctcacctactttttgccacatgaagagcaatttagtcagaagactgccaagccatatatttctacaatacttactggcttcaacaatgctaagattattaatgcaaattaaagtctaagaaaaatccttcagttagctcttttacagtctccctccactctacaaacatcatttcaacctatctgactttttgtctgctttcccataatagcctatataaggataggaatgtttatatgtctttctaatgggtaataaccatcaaagggcaaatacatttcaacgctaggcaattgcagaaaaccttttaccgttgagttttaagtttctcaaatgcaacatattctgtaaaaaaacttaacactactttgttaatttacagaggtaaattctacaaattctattaaagtaacaaaaaagcataaaatatttttgagtaaaactgtcatgaataaagatattctatatctaatataccaagtcacaattaattttcaagtatactacactataaaaccttttattaattcttgtatcggccgggcgcagtagctcacgcctgtaatcccagcactttgggaggccgaggtgggtggatcatctcaggatgggagtttgagaccaggctggccaacatgttgaaaccccatctctactaaaaatacaaaaattagctgggtgtggtggtgcacacctgtagtcccagctactagagtggctgaggcagaggatcgtttgaacccagaaggcagaggttgcagtgagctaagattgtgccactgcactccagcctggacaacagagcaagaccctgtctcaaaaaaataaaaaataggccaggcacggtggctcatacctgtaatcccagcactttgggagactgaggcaggaggatcacctgaggtcaggagttcaagaccagcctggcctacatggcaaaaccctgtctctactaaaagtacaaaaattagctgggtgtggtggtgggtgcctataatcgcagctactcaggagactaaggcaggagaattgcttgaacccagaaggcagaagttgcagtgagccgagatcgtgccactgcactccagcctgggcaacaagagcaagactccgtctcaaaaaaaaaaaattcttgtatctacttttacattgttaggtgaaaagcaacaaaaaaggttaaacataaaatctcctacttgcagttttttactaataaagaataattctatacctttggagcatatccattattgactgaatccatttcttctgacagtcaggaattaaggtctgtgagtttgttattcctgtatcaacaacacacgttcccggagccaaaaagaaattatgttcttcttcattctcttctgttatcaacctagcttccccacctccaaagacaactgcggaactcaatttcttatgctaaaaatggaaggaaacattttttaaagtaaaatgtagtaattttttgaacacataagaatttgatttgggaaacatagaagtacaattcaagaagacttggtgctacttcttgagtaggtcatttcagcttccactttgagaaagtccctagttcaacaggtctctgcggccctggaactgttacactctctgtggttcctcatcacacttcctaacagcactctaactgtgggcttatctgcatttctccactacaacataaactcttggaaaccccactttggtacacagaacatattcaactgatttaacttctttagtgagcttactaactaaagaggtttagcttactaactaaagaagttaaaactaagtttcctgtccttctcacttgcatatttatgaataggccagttatcacagattttaagaaaccccgtaatcacagccatgatcactgggcaggtctggtgcctggggtttttttattctacttcacacttttacacaaaatcccaaaatgaaatacgttaacaactactgataagagttaataatgtatcctagtttgtaatgtattctttaggaaaatttagcttataacataattacctgtttggcattcaaaaatataaatgttttccctttgaagatttgttttctttcctgccgtcctgacagatcaacatttttacttccaatagatggttcatcaagaggtgggtaaaaactgtaaaaataattaaagtatattctaattatatactactatgtttgctattaaattgtaaacggagtgactatctgacactcaaaaggcataatttccataatacctttatagtattttttttaagtaagaattttatctgggacaaaatgacaaaaagcatctaatcgcgttttctagaaatatggtggcaggtgacacaaagaagagctagaattgatcattaatatctcaaaataaataatccaaggtagacaatcataacaggatgaacattaaacacacatgactcaaacaaggtgtctgaattacaaaagtttgagagaaacatcatccataaagatcaaattctattagcatcttgtgtttacttaggagccaatatctattaaaacgctcatgtttcaattctactagcacaatctattatgagtgttttgttagagatctctttggagaagttcaggaaatttttaaacttacattatttactcagttcaaataaaatttccaaaacaagactaaagaatataatgttttagctctttaatttaatgctataagaacatcttaatcatccatgaaaataaaggaaaataagaaatggagaaatatcaacagataattcttaagcctctcatcagtctagagtttcaacttcctgtataatcagatcttttgctacagctgttcataactgaccggcatttcgacttgtctctcttcctttcagtaaaaattactaacccatgatgatgatgataaggggacaatgtagggagggagaaattcacaacctggacaatcagtcacaaatcaagagttaactatctgcagagatcaacatccaacgtggtaaaaacactgcagtcattaagagtcactatccagcactttagaactaattaccttacatctttcccctggacttctccttggaaacatacatatttcataaagtaaagctaagttatgattgaagagttacaatactttaaaatttttttgataactgatgcatgtattttaatttcactacaatagatgctgtaagtctgttttaaagcaatgatttctggaagctgcaatctcaaatgagttatctgcaggcaagagcagactcacttggcaggacagaatgcaggcaactgcgttagttatggtttttctaaacaaccgactttaaaattctatttattttacttttaaaatatacagagaacagtggaaactattttaactgttaacaaaaactaaatctacaataagagcactggaaagttagtagacattcggacacataaaaaggatcaattttaatatctctttgaatcctttttatcctttatctcctaataaatattcccccataacttatacttctttcttagtgtaaaagccaactaacactttacttatatacaaataactagtttaccaattagttcacacaataatgtaacaacactaggacagattacagagccagttacagacaaaaacagtaaggaaatgtttaacacatatgactgtgtgttacagtcaaacatgactataaaactatgactgagtagatgtgagattcttcctgctttcccaaaacactaaagttgaatgatttttaaattatctacagctttctattattcacactgtcattcttaattatgccatagataacagtttacagtagccagggagcagctaactgtagcttagttcgatgaagtttgagccaggttcctaaacatatgtgtatggtagcctgttaggcctctctaatggctctaccagagttctaactttattagtgtcattctttaacagctggcttctccactaagtgccatgagggcagaaactgtaactttttttggctcatcattatatccacaagtctatcttgcctgcttcactgtaggcattcaatacatatttacaaataaactgacattacaaaatataaataaaaattcaacttaataatttaaaagtgaataaaaagtataaacatccttcaattccctcaagtatagatttaagtattaaaattctagaacttgaacaatgtattttggttttgttttgagaacactgataaatttgagccccaatacttggtaagatcaatcttgaacaaaaaaatacaaaactgtattatctagaagctaaccaaatgctggctatgactccaacatgggttattcttagtaatacctacatttgatatatgatagacacattcatacatagataattgataacacagtgatcaaaaaacactatgttctagaatttcaaatacctacataagcctttttctctttaccagtgtaatgatgagagcaagaaagaaaagactagtgatgaatgtgaagagatcattgaaaatcattacgtctgaagcattacattctagaagttttaaagcatttctgacactctagtaatttaataaactagtacaaaaactggaaaataggaaagtaacctgtcagagacctaggctagaggcatattgactgaatataacgatactacaaatataaagtgatctccaatttctatcattaaaaaattaaaatgttttgggttcgtttatacagaaactttaagagctacaaataattatgttttattacacagtaactggtacatattatgaatcatacattctataaaatgatattaatctagaaattttgctttttcccattcacattttctatttaaattctttacatgatcttcaataaatttcatctaacctacagtatatcattttcacttctgtacgaagattttgcaaatacagaatttttctgaatccatgtataattctggctctagaaactgtatcccaagccacacatacttatttgttcaatatctggacagctgtttatttcattagtcctgcaggcatatgttcataatttctagaaccatttactatatggcttttttttttttttttttttggtgatcttgaaaaggctagactacagtgacatccacaatttgcaaatgtgaggttccatatcctgaaaaaaattactaatactagtcatatttcttaccttcgatttaaattaactatgtaaggtgacttctataagcttcctaaactgtcaaactttcatttactgagattatttcaggccaatgtgtctgttgggtctgagatttgattatcagctggtaagttaacctgttcctgtttcatggatgctggcagaagacaaacactcctgagtcacagcaaagcaagcagcatgagccccagtatgtttgctgcaggtctcctctctgaccaagtcccatagggaagacgtagagggtacatacagtgaaaggtacatacagtggtgtgtgttacaggagagaggaacactgaacttgggaaaccaccggtattataacaagctttaagcaagcctacattttgtcacaggaaggaaacattacttcatccctcgaggtttctcactgcaaacatacccttgagaaatggtctgtgtaaaggagggtcaaggctttgcattcttggcctattcagcaaattgtttatgaatgcaagggacccatggaggactccatctctcaagagtgtctcactaaaacaatacttgttgtttgaaataattaatacaccatcctacaacatgagagactttgtaaaactcaaataaaagccaactccccctcctttctgggggataatctccttacatttagacatacaaatctcctctattagagcacagattattgaaattaaacactccttttaaatgtattcttctaaaaatgacttcatctactttactactttgatgacagtcaaggaaaatgagatattgcaaatcatttcatgtacatgaagttataactgtcatatcctgtttcttggtaacagtgcaaagatgtagacatagctgtactaaataggactgtatattttattggaaaaaatattatagtatgcctcctaatttaaatccaggactagcagtcatgcttttttggaacattagaggtacttatgtaatcaaaggcgtcaccacaatttatttcatatccttttcgtaacccattccttctactaatgtttataaattgaatcttttttctgttaattgagtactcagacaaataagccttcaacaagcacatcaaaatggatccagataggtataggactctattaaggcaaataactaaatatatttaaaaattgtattatcaattgccatcatcgaatatgggttaataggataaataacctgtcccagttaacaccgaattaggagggattcaacaatcttatggtagggatgttgtatagtcgtcatgtacattgatacaatcaaaaattgaatctagaaaaaaattatgttgaacttggtcaaaaacaaccttaggttaaacacaactgacaatgtgaacaaaaagaggaatcaacgactaattctaaaaactccaagaccatgaaatatatctactagtagtgaaaacttatcagactcctctatcctcaagtataatctagaattaagaatagctcactatttgcagctagagtcattatttacaagatttatgtacttcctcagggaggttcctcaagaggcttcagggaaaaatgtgattctgttaaaatactatgcaagtttgtagttatgtcggtgaagtttcttgaggtgagatcagtgctttcaacttctttttttttgagtcgcccaggctggagtgcagaggtgggatctcagctcactgcaacctccacttcctggattcaagggattcttaagcctcagtcttccaagcagctgggattacaggcacctgccaccacacccagctaattttgtatttttagtatgttggtcccactggtctcgaactcctgaccccaagtgatctgcctaccttggcatcccgaagtgctgggattacaggcgtgagccaccagggctggcctgctttcatatttgcaggagttcagtcagggtggtgggaaaaaatgtagaaagatgcaaaccttggaaggccaaaaggttttacatcagtttcggaacaggatttggctgaaagcagccagattcttttatacggtgcctgaaagcttaggttagataacgggatgttaagaaactgatctagataagttacttagctcggaacctggcctttaatcattcgtaggactgctctctcctgggaggggaaccatgttaattatccacaagtgtgttgactcaaagcctttgccattatatctatactgaataaatgaccacagcaacagctagtcgggaccgcggctgctaactctttacagcaccctcctcagtgtctgtgggtggcccagccccctagctcactctttcactggatacctgtgtttgagtgcatttgttcatctgtcgctgggtcagggtctgcgggtcagacctggcacatactgaggggtcttggactcaaaaaattttaagaatcttctattttaaaatctgagtatatttttccagagtccaaatatatcacattacctgccaactggagtataaatacaaaaaaacttcccagataaaaattataaacaaagaggaaaacctgattttttattacttttaaaagcagacagctgttatccggtataaacagtccctaaaaaactaacattaagccaaatagcttatagcagctcaaaacacattaaaattagcaataaaattcctaactggcataacatttaaaattttttttttaatgttactttaagttctgggatacatgtgcagaacatgcagatttgttacataggtatccatgtgccatggtggtctgctgcacctatcaacctgtcatccaggttttaagacccacatgcattaggtatttgtcctaatgctctccctccccttgtcccccacccccaaacaggccccggtatgtgatgttcccctccctgtggccacgtgttctcattgttccactcccacttatgagtgagaacatacggtgtttggttttctgttcctgtgttagtttgctgagaatgatggtttccagcttcatccatgtccctgcaaacgacatgaactcattctcttttatggctgcatagtattccatggtgtatatgtgcataggtatggacatatacccagtctatcattgatgggcatttgggttggttccaagtctttgctgttgttaatagtgctgcaataaacatatgtgtgcatgtgtctttacagtggaatgatttttaatcctttgggtatatacccagtaatgggattgctgggtcaattggtatttctggttctagatccttaaggaatcaccacactgtcttccataatggttgaactaatttacacccccaccaacagtgtaaaagccttatttctccacagcctcgccagcatctgttgtttcctgactttttaactcagctaggtaggtattactctcaattttgcaatgagtaactggagctcagaaaaactaagctccattcccaaagctatggtgctgttaatattctggactatgtggcttgcaaagagggctgctgcaccacacaattccagagctaactgtggcgtgatgcctggaactgacatatgtgctcttctgaccatgaggttacctcagtgccatttactgtctttccatttttttctttaaatattagcacatatttaacatttgtttcagagatacagaataaccaacaaagaaatttggggaactctttctttacaaactaacaaaaaaccttccattaataataccgaactataacacagcaactattacatcctgaaacaagcattaaagagggaattaacttaaataaaaatcaatgctatcatataagtgacatcttgttatatttaaaatacataatatacctttcaatttgtggaggctgcttcttggactcaactgctttcaggaattcagtaaaatattctggctttacaattggacgtccacaaatgagtgcacatattgtctacaatgaagaaaacatgtgaatatatatattcacatgctagcattttttaaagaaaagttttaagttataaactacaaagaggctgtttacatccataaaaaataatgttttccctttcatctctctaaatttataaagaagccacaatctataaaatagaagtcggtctttggtcactgcattattttagaacataaatcacagtataatcactcaattataagaagtcaccgattataatactaatttttaaaactgcttttttggaaagggtggaacaacataaaataaaattcaattttaaaatgcattccactttcgaagacattaaaatgttaaaaatatatttcagaattgaggaaatgtaacatatctgcttcagggaagacaatattaggagatgaacatgagctatttttagactaattgtctttcaaaaagattgtaactatgcaataaagcctttttgagaaagtaaataaaataatttttggtaaaagcacaaaataagtacatataaagtggaaaaaaagaaacttaaactcacatgtgaattaagctataagcctcaaatatgatacatccaaaaaatatgacaaacattagaaaatgctacagtgggcaatgaaaataagattcagaataatataaatatgcttttttatttttgagacagggtctcgctctgttgtccaggctggactgcagtggcgtgatcctggttcactgcagcctcaacctcctgggctcaagcaatcctcctgtctcagcctcctgagtagctgggactacaggcacatgccaccatacccagctaatttttaaaattttttgtagagatggagtctcactatgttgcccaggctggtctcaaattcctgggctcaagcaatcctcccacctcggcatcccaaagtgctgggattacagacgcaagccactgcacccagccatgaatatgctttcaataacacagggtattttattgtctaaataggggcaagcagatttagattgtctctcaagaatggaacctgaaagataccactttccaatgtgaaagaaataaactagcatgaaccagtaatgtgcaaatcaacactgtattgggtaaactctaatacatgtgacttgggaaattaattggtccatgcctcagtttacacttcagaaaataaaagttgaactgaacgctttttttgttgttgttgttgttgttgtttttaagtagctaatagtaagaataaatggtctttaaattcctttttggctctaacattcaatgatttaaaaaatataagctaactgtactttcagaaaatttaccaaaaaaaaaaatataacaacaaggttttctattttggcatatgaatgaccaggaattttttttaacaaattactctgtaaaccacgttggtgtgtgtaatggagcaattcacaaggtggtcatcagcatcccactcgctggaagtgtccaggtctgtcacagatgtagtaaaatatctctcaagacaatttaactacctttgattgtatttcacaccaaccaagctagtgtatgattacttactctatttcttaagtaatatcttaaagaggactgtgctagggcccacacttaaatattctggtaaaggtgcatccctactgaaaaccataaatggacactttgatttgtaaatctactatttgtaagtttatatgcatatattagtactctggaggctaatcacactgctgaatttataaaatcaatttcataaatgtgcaaaaataaaaaaacccttgattacagacaaccccaccaaagtacaagttgagttccagctgagcggcaagcctttctccacgataactctttagctataaaacataattctagtttaattatattaaatactaaaggatttttaataaaggaatctaagtatttgtggctttttactatagatattaacctaaaaggatcccacaaatctataggtcaacctgtttaaaaggagatgaatcacctggagattggagaaagacaacttgatagaaagacatgagatgcaaactttgaagactggcagttaatctctagttgcgttgctttaagactgaaaacacaaagtatgcactgtcataaccttctcggtggaaggacaacagaatcgctttttaaaatgctaaacaaaatctgaaatataattttagttgcttttggcttgtctcagataataaacaggttatatgaaaagccactcaagcctaaatggtatacaaagggatggagtgggtatatataaatctacaactaacagttctgatagttttaaagtaattaaaaaaaaatctgtgtatagtgggtaagcttaaattcaaataacttatttttaacataagaacaagacattcaacctactttaatggtaactttcactgataccatgacaaggtgagtgcattcttctgtccaattgtttacagtaaatcctccaagttgcaatatagcttgatttaaagcagttttcccagagacatctaaacaagaagagcatgcaaccaaaggctcatactctattctgtaaatgagaataagttaaataaagtcatagtatcagagttgcagagatggcaatttttagtactttaaaactttaagctcacatcatatactgttattgtaacttttatttattgttaccctttgtaacctatgaaattatcagttcctcatcattaagctttgtaacctagaaaattatcaaatcctaagtcttgagtccaaatgaagaaaaaacaatgaccaaaagttaacattataccttcaccaatgaggaatcgaagaaatgtaacttcccatgaagtccctcagggcccactcaaactctcatcaccgtgatgtacaaaatgcactcaccacccatggcacagagtccaatactgtgctaagcaggaactaaattatactgttttaaattcattaatcagaaatatcattttcctttaggatttggctgaaacaaagctgtccattttaaaatcaattttaaaatgtcttacctgaatttacttccaaacactccaaaagtaataccatcccccgacttcaaagttcgggaaaagccattctgcattttttcctcattaacaaaggtaccatacttagaattatcttttaatgtcaatacagggatttcatctgtttgactctgaaaagttagcaaataatttaaagtcttttaccactcagtacattcacttctcagagaaaaagttttcaaaagaaaagacaataggcaggtggctaacctcccaacacggcagacaacaattactgcttcggttgccttgagaggaagatcactcaactaacaattcatatttccccttagggaagtttcttaacccaggaatacccctcctagaacacacatgttctttatttgtgtaagtcagtggggattctcctgacccctcacacacatttgagaattttttgctttggtgcagtctgtttcatttaaaacatgacaatttcattcctagatctttttttgtttgttttacagtatcaaaaccacattgtaaaaattagtcccatgagaatacgaggttataggctagtgtttctgacttacagtaacaattttactttttctgtagaaatttccaaaatgtttttctatacctaaaagaacagaaacaaaacctaaataaaactgaagaaattcatatcgcatatatgcaatctttgattaaaataatggctcatctttcttattaccaccagcgttatcatgagtacagatattcctatgtattttttttagcacttttatcacccaaggttatgatcaaaacaaactgaaagccatttaaaggagctgtggggcataagtaagcatttccctaataaaacaaatcaattcccattgcaaaaacttgtattatatgagaaatgcccgtttccacacagctacataacctctttaagagccagagtcatgaaggtctgttcattgttctattcgcagggttggcacagttactgacacataaaaacacattactgctaatggcaaaaacagcaattacttttgcaccaaactaatagtaaacaataaatgtttagtaagcaaataaaaataactatgtcctacttcctctgagtttctaactaaaacaaagagtaaattactgaaatagaaacttcaaatctcaaaatgaacaaataccactggtaccactgccacaatataagtatttaattttgttaacattaaaaaagtctacacagctctataaaatgacaaatcctgtgaactctctctcacatacaaaccaagagaatattttgtgatttcaacccccttactggaaactagtgaaataaaattagtaacataccaggttggttacagaaaagttagcagttaacacagcatgatttcggctgatcgactgatcattttcaatcagaatggcacagtttttccttccaacaacgtactcaacgccagtcaaaagtctgtatggttctcctgagataaatttttttttaaaaaaagataagttgatagacacatacacatgtacacgaacacacacatacatgtaagtgtatatgatataggtatgacaaatattaaataaaacacctttgttattcaaatgttagtcaactttacatatgtcaaacttgtgttttcagtaaagcctcactgaaggctatcaaaggttatctaactatggtgtttcaggagtaacaacaacaaaatttaaaatacaataaaaaagagaaaaagaaaaaaaggttatctaaacagatagaaggctacatcatttttctaaagggaaagcaatgctgaaaggagtcaatgttccctcaaattaacttaaaaacttaatgtattacctagcaacaatcacaatattatgtttggaacttgataaacaaaaatatcaggaaactataaaaaaagatgctcaagcctgtaatcccagctacttgggaggctgaagcaagagaactgcttgaacccaggggatggaggttgcagtgagccgacacagtgccactgcactccagcctcggtgacagagtgagactccgtctcaaaaaaaaaaaaaaatcaagaaaaatgtgaataatataataggagcttgccctaccagatggcaaaatatgccataaaactaaaagtatggtactggaccatgagtaaacaacacagaccaatgcaacaaagtccagactaagatgcacgtgtacattttttgaaaatttgtttttatcttaaagataacatctccaatcagtgggaaagggttatcagtttcttttaaaattgctgtaaatcataagttgttggagtaacagtatatatattggagacatgcggagttgagtctgggagcataatttcattacccgagtggcagggagattagggcagataaagagtagggagtccagaagagccaggtctccagggacgccttgacctgtgagtcttcacagtataaaatttatttagtttggcgctctccatactctcttaccctgccagtccatttagtctctacatagatctttgccaatcatcatgtaaacttcccgaggacaagacccttcacacccaccacgggcaaccaattaacatgtgatcacatttcacaccgctggaaatgaatgggaaaaaatcgacttttcccattgttctgatgacattgtggaaaaggagtctgaaacaaaactgaaagtaagccttttcgtggtagtcatttccccaaactgtccagtagttcttcacaagtcatgtgtggcccccgtgtggtccgcccatgctaacttcctgccgggggttcccactaggcgcctgctgccgcttacccgcaggccatccagccctagcgctgcaacggcgcgggggtgaggctgggagggagggggagtcaggggaggggcgcggaggactgccaccagggggcgccgcaatcaccccaccgcccgcgctgaattccagctcacagccgccgtgctgcccgggaagaatatgcgcttgccatacagcgtactcgccgcttctgcgaccgcttccgcagcgtccccgggcaggaacggacgcgacgcaggaatcacccgcaggccctcccccgaggcagtcgctaccgggaaaataggccccgaggcttcccttctgcccttacctcctgccgggcccgcggcgggcagcagtttccacatcggtccggctcctcagggctggggccgacgtgcaaccgcgtaaccggggctgctagacgagcgcggatacggcgcctgcggtcggcatgggctccgggacgtgcgcgctcccgggagccacgcaggctgccttggatgaggcgggagtgcgacttgggcgcttgcccgccac

SEQ ID NO: 107 - DNA, 112366 bp, Homo Sapiens
gcactcagtatatagcttagatgcagcagaactcttccacatagcagtagtgtctagcaaaccagtgtggtccagagaggtggtgttcactgatttaatgtttaagttgatagattcagggaaagtgagcagtgaaacaatttctgcttttcaccaagagcagaggttttctaaataagtcgaagggtaagtatatttttaaaatttctcagtttcctatgcattttggaaagttaaattaagaaatgatgtttaaaaagataatcaatttttaacatagtaatacctgcattataccttttctgtaaagctagatattgttttataacacttgcgttatgttcattgattgtttgcataaaggttatttggtatataatattctcttactatgcttttctgtaagttgtgcatggctatagtcattttaaaagctggactgaataattttgccaaataaatttcacatattaatgatttacattaagccatctacttccttcataatgtaactattatgttttataggctgttgctatatggtaacaattttatatggtaaatctaattgtggataaataataattgcccttttaaggccaaaaaaagcattggccggctggtgatcctaagtacattcattagaggaacaattcacagtaaaaattgaggagtgtgaaaaacaaagaccgtggaatctggtaactgattaactattggagctcaaaagcacttgctgagctgaatagaaaggaatgaagacaggttttgtcatgcctattaggtctgaaaaactttttaggttaaagaatacctggatcttcctttcatttatattaaaaatcttccttttatctctctctttacgtaatccaattaatttattttagtagtttgtatcatgtaaaatgaaagttaccaatccctttagatttatgttggcataccatcctacccctttatttactgatattagattgaattgaagcacatgtcttctagggcatttaatttaacataacagctgacatatgattttatctgggaatttaaaatttttttaacatattatactgaatgctttcctgtcatcttagtaggactttgctttgagctgagcaagactgatgcatccttttcattgtccctagggttcccactttgtcactatgttcaaactcaaaggctataaaattattttctaactcaaaggctataatattagtttccttaggatgttgacaaagaataaatttaaaagtgtgaataaatgttcagatgagatttcattttttgcagggaaaacccttggatgcttcatagtcctacttctaggcagttctgcatgaatttctggtaatccaggtaaactgctgaaaagctatgtaatgttgtatctgcaaaagcaatgtgctgattcagcaagccaatattaattttattcagcacaaattgtattttgacaagtttttggtaatatggatcaaaacttttaattggctgaatttttctgaatttactacatgaaacctagttttcaggtaatatatatataccaatagagcacattgttagtatttctggtgaatatattgcatatgataatttaaaaaatttaaaccacaccgtgtttaaaacatagggcttactgtttaaagataaatttaatttgggattctaatttatttattgagcattttttatgtttatggttttgaagaaagctatttaagaactagatatacatttatataaaatccatgggtaaaatttcaagcttaactctgtattttgggagaggattttacaattttcatttaatggaattttcattttcaaatatatgtaagtcctattagatattactttcatgtattttccataaatttagtcctttaaaatattgatacattgcgatatttttgttaaaactgaggatatataaatttgtcaatcaaattaggagtgtgtatgtattttatacagaccaacatacttcagcgcctagtcaaaaagtattccactcatttaaaatttttttactcttttagtcgaggatgcatttctttttattcctagctgcacaatttcgcataactctttctgtcaacaatgctagctttcttaacaactgcaacttctttccctcctgaatatcttcatgtgttttccactaaaagcacttagaattatgtcattttttacctaagagggacatttaaagaataaccaatgaatccaatatctcatttttgagttaagaaatgaaaagccccaaaatatagctaagtcactattatataatctaagggtagatctggggccagaacatccaggtttcctgacttccaccaagaccagtaattttttcactaccctacattgactcttctgaatactacatgaaatctaatctaaaaaggtaaaattatgttgtatagtgtgttaatgaatctttggtgaactaaaaaatcatttgtttttatattttaatctataccattattgccccaaacatttttgggacaatggctgaatatatatgggattgccattgataacaaaggtgactaccacttcaaaccccaatctcttaatgccatcatattattttgtttcagactgatgaaagcctcacattctttcatatttgcccaacttgtggatcccgctctcattttctgactcaatattgctttaagctgtctcaactgtctattttcttagtatgtatatatttttgtattattttagtcattcttaaatgctcataatttaggatttgcctaagttaatatagtattctttaaatttggttagaactgacaggaaaattttgttatgaagacagaaattgcaggacttaaaaacccatcttagaggtgatagaagctgttattgaaggggtaagctttgcacacaagtgctcaaaaaagttttaaacatttttaatttgaggaattcctaggaaatgtgattacagaaagttggagaaccaaaggccaaaaatttcaattctgattcctggtactaaatgttaattctactaattaccttatcttatcacaggtaaaatcctacctggaaaatgcttctaaatttggtcattttagttcagtccaagtggactctgaaaaaaatcgctttcatttgtttcttaactttacaagagaaaaggcagtatactgaaaagcatgtgagcttttgagccaaattgacatgggtctgaataactctgctacaaattacgttccccttggaaattatttaactctctgagttagcttttctccatctagttaaggaagttaagttaataccattctttcagagttattggaagaattaaatgagatatcatgtaaaacacttcacatagttcctagaacatagcaggtgctcagcaaatgtcagtatccttcttaccccttttacagactatataatacatttcaacaaatagcttcggtatttcctgaagtatttcagtattttctttcagtaagagaagtcaactttaacttagaatatgcacgtttttgtcagaaagataaaaataaaatcagcaatcttggaaggcattaagatataatgttggggccgggcgcagtggctcactcctgtaatcccagcactttgggaggctgaggcagccagatcacaaggtcaggtgttcgagacaagcctggccaatatgatgaaatcccgtctctactaaaaatacaaaaattagccagtgtggtggtgcgtgcctgtagtcccagctactcgggagactgaggcagaagaattgcttgaacctgggaggcagaggttgcagtgagccaagatcgcgccactgcactccagcctggtcaactgagcaagactccgtctcaaaaaaaaaaaaaaaaacatataatgttggaaaatattttaaccttcttaaatttaaaaaatcagaaacccatataatccaatccaattaaagattcacttcaaagaagtctttgttaaaagtattttgagagtggtacaccaagatgattaaaagccttaaatactttttaaaaattcaatttcaatcatctgtactaatggaagaaagcgtgacatggataattcaaattataatgcattcatgcatcaagtaacaacagggatacattctgagaaatgagaaattaggtgatttcattgttgtgtgaacattataaagtctacttacaaaacctcaatggcagagcctactacacacctagactatatggtatgtcttattgcttccaggttataaacctgtacagtatgctactgtactgaatactgtaagcaactgtaacatagtgtgtgtgataagtatttgtgtatctaaacatatactgacatagaaaaggtaccgtaaaaatatgtggtattataatcttataggaccactgtagcatttgtgttccactgctgatcaaaacactgctattcagtgcatggctgtaccttacttgtgccttctgagttttccaacagcttttttttgtctattatctaacatgacgtcaaattaattggccaagaatttattttctttcttctttttttagatagggtctcactctgtcacccaggtttagcctcccatgtagctgggaccacaggcacatgccgctacacctggataatttttttaaaaattttttgtagagatgtgttctccctatgtttcccaggctgatcttgaactcctagcctcaagcaatcttcccacctcagcctaagaatttctatatgctctaaggattgtgctttttctactaccaagtaaattattctttcaggactctggaatgtgttttctcctacaaaaaaattcccttctgaattaaatttattataggctaatattaaattatattgcattattttgatagcaagtaatgatgagcagagtgagtccaaaatgtatagagcacaagaagatagaagaggatttaacattttctaaagataatattaaattagtcttagactgattaattgattagggaatgaagccgatgagcaaagatcacaaaggaggagctttttgtgaaatgtattggtcagagggagttcagaataccacgacaaacattctgagagcttgcttaactaaaaagaggtcaattgacacatcttccaatgaatgaataaagagcaaaaaattggtttagagttaacattagaaccaactaataatccatttataacacaaactgatcttattgagctcttgtaatcaactttaatttcctgaaagatgtttaatcgctttacaaaaagctttctgctgatgctataatttcaatttaagtccacgataaaagaatcttttcacttaaattgtagacactgtatgtagatggtgtgcagaaagacaaaagcatcatttcaccaatttagcccactaattaatcacatattctttttttctttttttgagagagagagtctcgctctgtcactcaggctgaagtggcatgatcttggcttactgcaacctctgcctaccaggttcaagcgattctcctgcctcagactctggagtagctgggattacagggacatgccaccacacctggtgaatttttgcatttttagtacagatgggatttcattatgttggccaggctgatctcgaactcctgaccttagatgatccaccctccgtggcctcccaaagtgctgggattacaggtgtgagccaccatgtctagcctaattaattatatattcttattaaaactattttattagctacgtaagcaatttagcctatgtgactagtcattaaaattagtatttaatttgcatttacttttaaatgtttacagtagatattactacaaacaattgcaaagaaggcaggaaaaaaacaaaaattttaaatatgtttttaaaatgttctggtggggaatggtggatcacacctataatcccagcactttgagaggccacggtaagcggattgcttgagcccaggagttcaagaccagcctgggaaacaaagtgagacctctgtctctacaaaaaataaaaaataaaaaattacttgggcacagtggttagaaggatcacttgatcccaagagatcaaggctgcagtgagctgtcttcacactactatactccagcctgggcaactgagtgaaatgctgtctcaatagataaataaatggttttatacaaatagctaatttgcataactcaagactaacaactaaactgcctataaatccaaaactgggaaatagagtacataacagttcattgtgttaaagacatacagccttaagaacaaccagaaactattatcttagaaattatgtatcactgacaaagtgaaaatgtaacttgaataacaaatttttagtttcaaagttataccttaaatctattcccttgaaagttctttgcctatcatatctacaatgattcagattaggagtgagaaacacttccttccaacatgaaaatattttaaatctaatgaatttctcaatgactctcgaaacattaagaaatataagattgattataactttatgtagctaataatacccaggagtattactactataataacctagcaatgtttctcaaagtgtagtccatgaccatctgactcacctggaggaatgcctattaaaaatgcagatcgataactccattccaaacgtatcacattagaatctctggttggtagatcctaggagagcagcaagaaaagattcttctgcctataacagagaatgagcaagtgagtgaatcttttcaaatctaacccattaacattatcagaaaaataacctcaaatgcacatgttcaaccaatcttgggtcattaacattcttacaaatgactaatacaattaatctgcctgtcccatccatgcatgcaaatttttaaaagttgaaacttccattaataattcaaaaatagtgaaacagaaatctcaagtttccccttttactctaggttctccatgagagtaagagcctgagacctctggcttatgtgcgagttctttatttgggaaagcacccagaaacaggagtaagggattagtgaaaggaaggaaggaaggccaatacaaaagttcatccttgagttcatccaccactatgagcaaacagagctcaagcccagtatcttcttaggagccatcaaactaccccagaatagcctgtcagaagacacaagagaagagcacttatccacaacttctgacttccatcagttaagagttgccgcatgggttgctaatttcttacactttcaagttgcatacttgtttctattggcttcagagaagctcctaggacagaaagtcaggtgagggactgtaaagtttcacctgcatgaatctggttgccactgaaatacctggagcaagcagggcccaagacgtgtccgatacatcatgttataggacaaatgtggtcaaactgcttttcctttagttttataattctaatacaaaatacaattaaaacagatgttctgagaaatgagtacagcaatttcaaatggagaggaaggaactttagcctatttttgtctgatgtatttgatccattcccacaaaacctgagatgcactgaaacttgatcttctgtgagaaaggtattttctaataaacttcaatttatttcctgaatttgcttgccaatttttaaagggccaaacagcagcaaaatggacaattagtatgtacgctgtaaatacttttatgtccagcattgatccaaagactttattgtttaagttttcacactagtaaagttatagtaaaaacagattgactacattggaccctcgagtaacacttttcattacagtgaaacacacaattttgaatagtacaagtttgtcttggactgtgtccaagagggtctagttacaagaagtaattcattataacctataatgtgatcctgaggcttggctctgaaaaacacattatatgaaggctctagtcaagcagattaaaaattttaaaaccgaacagataaacagtactttaattaagtaaataccatacttgtttgtataatatgtaaacttagttcagagaaagcgaaggagaaataggtgcaaagaaaaaagaaatctgaccaaaagcacatcatctttttgtttaacttgaatttctgttagaataactaaatgtgagtttaaaaaaaaataacactatctccttagaagttaggtaaagtagctaatgaactgaataaagatgaaataggaaaactgaagagtgcacagcaaatacaaaaaagtggagacacacactgctgaaaaaagcccaataataacagatattattttattattattaatttttttgagacagggtctcactctgtcacccaggctggagtgaggtggcaagatctcagctcactgcaacctccacctcccaggctgaaacaatcctcccacctcagcctatggagtagctcggactataggcacgcataaccatgcccagctaatttttatgtattttctgtagcaacggggtttcctcatgttgtccagtctggtctcaaactcctgggctcaagcaatccgcctgccttgacctcccacagtgctaggattacaggcatgagccgccgcacttggccaataaataatttcttataaccactaattctgaaataaataaagagattagtttctcctttctatataattttgccattgggttagatgattttttaaatcccttggaatataataaaactaataacaacaaccatataataatactatctaacttacctgaactcaattatgtaaatcaagataatacatgtaaaagcatttaacaatatagtgtaattctttctataattataaatctttcacaatttgcctagcaattcaatagtttcactataactatacaactttagccattgaagagatctgattagctgtagctcttaaatctatctaccgttaacaacagtttcttacattgttacagtttcttacatatatatatatatcttctctctctcatttaatcctatcaacaatcctgcaaaacacttaaagtacatattattaccttcatttcattgatcaacaaccaaagtacagagaaattaaattatttgctcaacaagattagaattaaaaattagaattcattcagcaaattagatggtgcagctgatgccttcccagtatcaacttatacaaatacattactatacacttgcagttatagaactcaacaatgattccccacagtatagcctttgcacatgccttctgcctggaaagccttctgccattcttctcccaataggcaagctgcttcaaatgtctcttaattcttctttaagaaatttcaaatatattatttcattcttacaacaacccctttgagcacagtgagtattaatatcctctttcagtgagggaaataagacttgtctaggaaacatgcagataatcagagatagggtcagaatttaatctctcatcctatctcccagctcacgactctttccatagtacaagaaggctgggaatatggttatatgccagcactgactgtagaacatgatcacaattttttggagcacttcctactctgtcccttctgagattacaacataatttaagacccttcaatctacttgattttaaattttgtacatgaaacaactcacaaccagggctgggaaagctagtataaccattgttctaattctattagaagtaaatttatattcatttctcaaatgtacatatctattacaaggcaagtaaaaaagcatatgtgccaaaaatgctaagaaataaattagcctaaaaaatgaagtgagatgattataataggtgtttcactccaatcctgactgagaaagtccagtttattttcagctctgaggctaattaaattacaatcaaattttaaagtacttttagttacctcctacagtgtaaagcattttttagttagtttgtttttggttttttttttttttttttttgagacggagtctcactctgtcatcaggctggagtgcagtggtgcaatctcaggtcactgcaacctctgcctccctggttcaagcaattctcctgcctcagcctcctgagtagctgggactacaggtgcacaccaccacacctggctaatttttgtgtttttagtagagatggggtttcaccacgttgacgaggatggtcttgatctcttgacctcatgatctgcctgcctcggcctcccaaagtgctgggattacaggcatgggccactgcccccagccaaagctttttgaagtaaaaagaaaaatgtacttgctctgtcacccaggttggagtacagtgcatggctcactgcagcctcgtcttcctaggctcaagagatcttcccgcttcagcctcctgagtagctgggaccacaggcatacacaccgtacctggctaatttgtttttattttttatagaaacaaagcctcactatgttgcccaggctggtctcaaacttctgggctcaagtgatcctcctgccttagcctcccaaaatgctgggagtacaggcatgagccactgcatcaggctctgaccatatggtttacagtcatccaaaccaggatgttttttaaagtaaaagtgagctgtattaataattaagctagagcaataggaatcaaccaggactgtcactggtaagctagggcatatgatcacctcacataagaggtctaccataactgagaaaaggaaggaagcttttttttttttcttttttttgagccagggtctcgctttgtcacccagagtgtgagcaaggctcactgcagcttcgacctcctgggctcaagcaatcctcccatcttagcctcccaagtagctgaggctacacacaacactgaacccagctagatttatttttattttcttgtagagacagggtcttgttatgttgcccaggttggtctcaagcaatcctcccacctagacttcccaaagtgctgagattgtgggcatgagctgctgcacttggccggaagcctatctatttcaattttagtatcctaaatagtccacaaaaacaaactgtcaccaagagtatgaactgaattaaaacacaatttcactgtacatttttaatctttctgattataacttacataaaactgaaaacatttctagctaaaactcaggatctcctttaagtactgaacgttgaacataaaacatttttaaattttttattttacctttggaaaagtaactatcaaagcttccttaaacttagattaacatggattagaaaaaacaaaaagccaatattttaaacaaagtcttttttctcaagcataattagaataaagaccaaaaaaagacagtgcgtttaaagatatatctgtaatctgtgaagcacataattacattaaagatcacaactatttgctggcagtgaataaatccatcaattcacaggtgaaaaaaattagtgtttaagatgcgatgattttttcacatggacaaagcaatgaatattaaacatgtttgcttgtgtgaacctatcaaagaattctttaattaatagaatccaaatgtcactgacttgttccgacggttagcccttcataatattttccattgctgtaaataaatattactcccacagcttgtatcatggtagcattatacataggtacaatgcagtataatactttaatagacaaaatggtaaagatttgtttttcgagattctgaaaataaaataaacttttttactctacagtcttagtgatcactcttaaattatcttattttttcagcagttaagttctgagatccttttaagtgccagggttagaaaaaaggcttatgggctaaccaactaacaaaattcctgggcttcataagcttatatgaatagatacgaaatattgtccaaacagccactgcattataaatagatgacatggaagaaacaggtgtccctttccattcataagaaatcattttgctggctgcggtggctcacacctgtaaccccagcactttgggaggccaaggcaggtggatcccttgaggtcaggagttccagaccagcctagccaaaatggtgaaaccctgtctctactaaaaatacaaaaattagccaggcgtggtgccacatgtctgtaatcctaactactcaagatgctgaggcaggagaatcacttgaacctgggaggcggaggttgcagtgagccaagatcgtgccactgcactccagcatgggggataagagcaagactctgtatcaaaataaataaataaataaaaaagaaaccattttgcaaataacagatcaacaacgttcttcatcaccccattataatttaaacctgggcaactatgaatatactgtttaaccttctttatcaagtataaagagatagttcctaaatcgggcaaattatgtgccagtaaaactttggccattactgatgggaaatgaagcagcttggtgaatgatgtttaaaaacaaacagaaaactatttcaacagattaaaaagggaaacgaagaaggtatgaagtccaatgtagctagagtgaagatcaaaataaagcttccttatctaaactggaaattggccaggctacacgagactaatctttctaattaaaaagcaaggtatactctttaatgtccattatgagcatttaaatgaacacctagaatattgtcaaaataaaaactgtgatgctgacatcttccaccaatgttaaatatatatttttatacaattataaaacttctcaatctggaatcttggcaccatcaactcaaatcataaacaaaacattttggcacttgaggcaagatcactgattgatgtatactcccactcacaaacaacacttactaattactgtaaacaacttttaaaaaattgaatcaagtgttcattcaagttaacacaaatgttgccagttaagatacttttcttttgtcttaaagtttctttccctcacctctcaaacagcctttgttgtgttcttaaaatagttatgactgcaggtataacaattcaccccagtttaccagtattgtgtgttcatgtcagagatactagagagttttagataaataatcataaaggatttaatcacttactttttaattttatgcctggagacacaggcacttaatgctgggtgggggatgggatgatgcagggagcaggacagagatgggaaatgcccagcacaaatagcagaaataaacgaagaattggatacccacgtcccagttccatcctgcttctttaagtaaatcacacaacctcatttgttcactcattgattatattatatatgctgggcctgcgctgtacgatacagtagccactagtcacatgcagacttgagaacttataatgtggctagtctaaactgagatgtgctgtaaaggtaaaatatataacagatttcagagacttagtatgaagaaaaagaatgtaaaaagtctcattaatttttatattgattacatgtttaaataatattttagataaactgggttaaataaaatatattaagttaatttcacctgatttttacttaaaatgtaatttttagaaaatttaatattatatatgtggctctgtgggatagttctgtgctaagactctagtaaaaagtaggaaagaacccaggaggcagaggttgcagtgagtcgagattgtgccactgcactccagcctgggcaacagagtgagactctgtctcaaaaaattaaaaaaaaaaaagcaggaaaacagggctgggcgtggtggctcatgcctgtaatcccagcactttgggaggccgaggagggtggatcacctgaggtcaggagtttgagactagcctggccaacatggcaaaactccgtctctactaaagacacaataattagctaggcaggtgcctgtaatcccagctactcgggagactgaggcatgaggattgcttgaatctggagggtgaaggctatcataagctgagatcgcgccactgcactccagcctgggggacagagtaagactttgtctccaaaaaaaaaaaaaagtaggaaaacagaagaataaagaaagcacagtctgacatcaaggagcccagctgaagattaaaaacacaaaaataattacaatataatggtgttaagtgcaatgataaagatatatattgagggcatgggagaatgaggaaggccatttgtgaaagggtatagaaaggaaggatgaagagagatgttaggttagtcgcctgaaagaggtagtgcctgagctgagacttaaaagaataagaaagatgaagtgtaacaaatgggggtgaaagtaattccaagagaaaaacattgtatgagccaagagtaagacacagccaagggaaggagagaggaataaaagcagtttcctgttgaaagagggaaagagcaaggggtacagcagagactgtgcaaggataagagcttgtgtgacattttaaagaaactgatttttaacctttaggcaatagcctttttttcttttttttttttgagacacagtctcgctttgtcgcccatgctggagtgcaggggtgtgatcttggctcaccacaacctccgcctcctgggttcaagtgattcacctccctcagcctcccgagtagctgggattacaggtgcctgccaccatgcccatctaatttttgtatttttagtagaaacagggtttcaccatgttggccaagctggtctcaaactcctgacctcaagtgatccaaccacctcggcctcccaaagtgcagggattataggcgtaagctaccgcaccagtctggcaacagtcttttgaagagttttaagcaaaggaatgccaggatcagaaataatggtttagatgttgggcagctgtgagactgaattaaggtgaacaagactggaagcagggaggctgttgcctaggtaagaaacatcagggcctcaactagggcaataagtgaggttggaaaggaaagcactaattcaaaattatatttaagaggtatcatcagcagaatatagtgcctgactcgtcctgacaccatggaaaggagtttggattttattctagggtgatgggaagaccctgaaatgctttaagcagggagtgtgattttctgatagattttaaagaacctctcagactgctgttggagaatatactgtaatggagaacagagtggataacagatttttttttttttttaaaggaggatattgccgtagaagaggttgatggtagcttgaaccagggtggacacaaaggtgagaagcaactggattgtttgggcaggtgtgtgtgtgtgtgtgtgtgtgtgtgtgtgtgtgtgtgtgtgtgaagagacaggcgggtgtgtgtgtgtgtgtgtgtgtgtgtgtatgtgtgtgtgtttaagagacaggttctggctgtcattcagcctatactgcagtttctcaaatctcaagtgagcctcccgcgggcctcccacagcgttgaggttacagatatgagccaccctatctggcctcaggttgtatttttaactgcaaatggttttgcctaattcgtagggttgagaaagaaaaaagcaagtttaggaagatcacacttgtggagctcaattgtcttgtttaatcaggaggccaggttgtccacctagagtgaaaatagcttcagaggcttgaggactgaaaatagtaaaggtctggaagacagcagagaaaataaaaagagctgaacaaaggctattttaaggattaactgatgccctgcatgaagtttgaaaccatatgactttagtgatatcagtctaacgtgatacgtcattttcccttcacaacactcaactacccagctgcaggagttaagcatagattctagaatctacaggatttcatttgtaaatggcttgagttagatgacttttaaatctacgtgagttccaaaactttacttttaagaatcctagagtctgtactgctatcacacaatttattttaaattggtgcctagatatacataatgtaaacttaccattttaactatttcactagtttatttaaattcagcattctagccaggggcctccaataggtgtgctgggacattaaaaacctagccctgaaggtggcagcactgggcctgaggtgactagtctcaacttctgttgccactggatggaagcagcctcatcttttcattacaatatataacacaagtgttcattttctaagcatgctgaaattgaaaaagtttgggaagtactgtcctaagccacaacatatgagaaacccagtattatgaagagttcaaaataactgcttctctgttaaagatgttttttcagcagatctttggaacctcaaaatttattccatgtggttcttaaagctttagaacctatctatgaggatgcccgccatttccattgttaaagtggccatataaaatctcatttaaaaatctaagaattttgaatgtacccaaaggtttccatttacatagaaatgggatccaccagggaatgcccatttcattcattcatagaatattgatttggtggcagacactgggctagttcctggagataaaagggtgaacaaaccttttttattttttatttttttaattttaagacagggtctctcgctctgtcacctaggctggagtacagtggcacaatcatagttcactgcagccttgaactcctgggctcaagcaatcctcccacctcagcctccacagtaactagaactagaggcacgaaccactgtgtccagctattttggtttgatttttagaataggagacaagatttcactatgttgcccaagctcatcttgaactcctggcctcaagtgatcctcttgcctcagccacccaaagtctggcccaagacgtggttttttatctcaagaaatttacagtccagtggggagacagaattaattaaataactaaaacaataaaaactgtaagatggggaggttacatggtactgtaggaggatctagtagaagagactattgaaataagataaaaacatgattagtagatagctggggcaaagagtgggggtaggtttggtggagaactccaggcagagacaatagcacgcaatggcctaggagacatcaaaagtctagtgagaccagaggacagaaaatgtctggaaataaagccaaaggggtagcagaggcaattcaaaggggcttccttcacagagtaactggaagccactgaaagggtttaagcagcatagtgacattaacagatttacttttcaagatcacagtagctgcagtatagagaagtggtctcaaagtagacacaatttaaggtggaggagggaagatgtatttttattctattttttatcctttaaaaatgcttttaaaatggattataatcatattagctaagaaatactaattatggctagcttttgggcacatagtatatatctgaatactaagcagtttacatatattcatttaatcttaataccctgtgaggttggtactattattatcctcaatttacaggtaggtaaaatgggacagcgagcttaagcagtcagtccaaagtcactcagtaaggaagtattagagcaggatttaaacccagatgtctgacttcagagcctgtaacttcattagatcatgtaccatttttcaacagtacatgtatgtaatttaaaattaaatatatatatggagaatagaagttcaaatttttttctgaacaccagtgaaaacaaagatttaggaggggtggttggtagcgtggatgtggaaaggagcctagcagtagactaggtaagaaataacagtatcttggattatggaggtagtgatggagagaaggggatggatttacatgtttagtaagtaaaattggactgcgtgatggcttggatatggaagttagggatgaataaagtgtcaaggatgactctttggtttctgacttgcataaatggattagagagtgagacacaggcagaggccataggaacaggttgggtcattctgctcagtttttctttggaccacagtagagaccacagcacactgctctttcaatactctgttaaatgacaaacttattacaggttatttctgtcataaacataaaagcttcactctgtcaattatgtttcctatcttgcgttaaaaattacatagtcaaaatttcatccattttcttttaaaaatgtggagttaagtcttataaaatggggaagtgaatgatagttgctgtaacaggctaatagaaggtttagcacccctcttctgtatactaactttttaagttatatttattcatcccttaagatgtgggacaggtggaaaaattacctttccactttgtatttatgatttctaagtactaaacttttaaagcctgttaatattatcccttcccaggtcttagaataattacacaaaagtactggactggtttaaaagatatttgattctagtctattttgttcatttgtagaatttctagtggtctaaaaacgattcttttacaaatcaggagaaataggaatacctactatcggtttgaatctcaaacgaacagccacaagaaaaatggactttttaaaaaaaattatctaacagcatgttgtcccaataaataatgctgaaggagattccttctcgtttcaaatttgccagaaacttcccgtttaacctcagcaaaatacagatcgttttgatctatggcgttaccgcacaaccctgtcaggtcacatcactaaactgcagataacagcgacaaggccgaaaactatgttagacggatccgcgtccataccccccatcagttaattttaactcttcattcggtacaggtcactctacacatgcttccctgcaaaatgcttaagctagacacagtgtacagataactttcacagaaccgcaagggcttgatgctcccccaacagaacggcttgagctttccccagcgcaattcagaaatgctgtggcggtcgccagactcttcgggtagctcccggcagctccgaggtagcgctcccctccccaaccatcgccctccgggatgggccgcaccgaagagcccgctcctcagctagggcacgaagtgcgccgccgcgatgggcagctggaggaaggggcgtgacgcaagtggaactcccgcgtgacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtgagtaaaagcaatctctttaccccacccggagctctgggtcggagcgactgcttctggtctggagctgcgtgcttggcgaagggctcccggggtaggggtggctcccggctctggggttgtgtctgatgaaataggccgggcccgggctacactcggtggtggtggaccggcgggaggacgagcgctacctcagtactacttctgggtctcccgcgcgggctgaggaagcgcctttcgccgccaagcccgccccgcgcatgcgccgactgcggctcgcgcgcgcgcttcggaggttttttggccagacccgcacgcggaaccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtaggtggaaagggttttgcgagccagaatttgcaagttgaatgttttgtttttatgttttgtttttaaggcactgtacatcacttacttgaagatagatacgtaaaggatgcttattttacactctttaaacgaatatgttaatactttttcggtcattgaagtaattaaaccttcattttaaactgttgacttaatagaaatcgtttatgtcttctttttttttctttttgctgcagagaggtattttttctttattttattattattttttatactttaagttctagggtacatatgcacgacgtgcaggtttgttacatatgcatacatgtgccatgttggtgtgctgcacccattaactcgtcatttactttaggtatatctcctaatcctatccctccccccaccccacggcaggccccggtgtgtgacgttccccttcctgtgtccaggtgttctcattgttcagttcccacctatgattgagaacatgcgggctacagagaggtattttacagttattggtctcatgacttgatttccatccctgacatagccatgtcccagctgtgtgaccttggacatttactgccttacgcctcttcccccaactctaaaatgaaattatagtagctgtcttacagagtttttctgaaggttaggtagaatataaatattctataatatataattatatattaaataatatataaatacaaatattaatattaatattctatagtttctggtatgtgggaaacaaatggtgacttttattcacaattatatataggcccatttgtttatctgttagagttaaagatagaataaaaacctctttggtaacaaaactaatgcagtgcacctaattctacttttaaaaacttttttacagaaataaatgtacacaagagaaatactggaattatgaaccccattgtatacgcacccacccagcttcagaaattgttgaagttcagcccttgtttcatctcttcacccaacatccatttttgtttgtttttgctggattttttttttttcaagcaaatcgcagagtatatccctttacctgtaaatatctcggtaaatatccctttaacagataaggcctttctaaaaaaaaaacaaacaaaaccgcatcattatcatacccaagaaaattaataatttcctaatatctaaaatccagctcatatttagtttctggattattttttaaaagtctaatcacaatttttgcaaagcttgatagtttatttttgtagctcttgacggttcaccaagtggcttcacatatactcctgctcccttcagaattactctttcagcccctttgtcagagacctcaggaaatggttagcaggaaacaatcagtttgctttggctaaggagccagatgtgaggtttagtagacttgctgatcactattactttttaagttgtagctaattaatggtttcattttaagaacacatattaaaatatttactaatccattcaaacttcttaacctgttggtttcttcaaggactatgtaataaacttaatgattcacctttattctaagagaggcatgaagtaacattaccctaattgtcttatgactctaagatgtttctgtattcatagatctttgctgtgtttaaatcttactgacttctcttgtttttggaaagttatacagatcctcatctgtgttaatacatcagtcaactgtctcttttataaaatatatatagatatgtgtatatatgtggatgcttgttaagtcaagactaagaatatttttcagttttgggctcagtatgtttcaccaattcaaaagttaaaaaaaccaatttttttttttaattgagacagggtctctgtcgctcaggctggaatgcagtggcacgatctccgctcactgcaaattccgcctcccagtttcaggcaattctcctgcctcaacctcctgagtagctggggccacaggcacgcactaccacacctggcaaatttttgtatttttagtaaagatggggtttcaccatggtggccaggctgatctcaaactcctggcctcaagtgatctgcccacctcagcctcccaaagagctaggattacaggcaagagccatctcccccagccaaaacaatacattagtctatagtggtaaattaatactgaccatgaatgataaaaacccctcaatatctgaatcctttctgtttaatataattgagataatttcttcctctaagagaaataagaaaatttgcctgaaaatttacctcatatagccaaataactgaaatcagaacttttctcaccattatcatctttccttattctttccttcccctcccaaattctaaaaatgattgattataggtaaataaggaaatggtaaatgaggatatctgggcttgtgtttcatcctgatttcaaagtacataaagataaatgcaaagttcatttatgttgcaatctgtcatttcaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtaaaatcttttcttaaatacttacagcagtattttgttgagactgtagtggctttgtatacctttgtatgacagtcctgtttattatttctatttcagcttttaggttccgggggtacatgtgcagatttggtacatggatagattgcatgttgctggggtttggtgtgcaaatgatttcatcacccaggtagtgagcatggtaccccataggtagtttttcaatccccaccctcttcccacccccctgaccctccaccctcatgtaggtcccagtacctgttgttcccctctttgtgtccatgtgtactaaatgtgtagctcccacttataaatgagaacatgcagtatttctgttgtctgctcagggtaatggcttcatctgcatccatgttgctgcaaagaaaataattttgttcttttttatggcttcattgtattccatgatgtatatatacttttttttaattcagtccactgttgaattttgtacatttaatggccatctttaaattcaaagatatcttttttttttttttattttttttgagacagggtctcactgtgtcaccaggctggggtgtagtggtgtgatcacagctcactgcagcttcaacctcccattctcaagtgagcctccctcctgtagttgggaccataggcacacgctgccatgcctggctaattttttattttttgtagagtcagggtctcactatgttgcccaggctggtcttgaactcctggcctcaagtgatccttctgtctctgcctcccaaagtggtgggattacagacgtgagccactgcgcctggcccaaagatctcattatttatttatttatttatatattcatgtatttatttatttactaattaattttcagagaggttctcactccgttgcccaggctggagtgcagtggtatggtcacagctcactgcagctttaacctcccaggctcaggtgttcctcccaccttagcctcctgggtacctgggactacaggtgtgcaccaccacgcccagctaattttatgtattttttgtagagacagagttttgcctttttgcccaggctggtcttgaacttctgggctcaagcagtccactggcctcagcctcccaaagtgctaggattacaggtgtccgctgctgtgcccagctgatctttttttctttttctttttgagacagggtcttgctttgtcacccatgctggagtgcagtggtgcaaacatggctcactatagtgtcaaactctcgggcccaagtgattgtcccacctcatcctcccaagtagttgggactacaggcgcacgcaccatgcccagctagtttgtttttgtttttgttttttttaaacttatccttcaccttagaacacctagctagtttttgtattttttgtggagtcagggtttcgctatgttgcccaggctggtctcaaactcctgagttcaggtgatctcccgccttggcctcccaaacagctaggattacaggcgtgagctgcgcccagccagatctcatttttagaggacatttacaattgtagtttttgtgattcatttttatggtcaaattggtgctttttaaccacagaacatagtttgtatacaacttgctgttatttacttgtggtaatatgtatgagatagtggaaaacgtatacaatttgttgactgaagacctgcatttgaattctgatttcatttacccacttgctctgtgatcttagcctaattacctaacctctaaatttaattttcttctataaaattctttgcaggatatagacataaaaatactacataaagtcatttgacaaacccgtagcactgaaatacaaaagtgaatggccacttaccttcagacagcctgcagtcttagtagagtcgtgtaaacagataattacagtacagtgaaataacagttaaaaggtttttatgacgtgcaaggagttttagaggattaagcaattgtggttgagatgagtaaatattatttgtgttaaaagatacaccatatgaagctaagctcaaggttttaatattaaattttaatatactttaattctgtaactttccctatgtccctatgtatgagaaatgcttcatattacatttgtttcttgattacctattataagtttaatattgcagtgctttatagctgtatcattacactggagtactattaaaacataatcaacctgaatctaaagtgtagtatgtgagtctgtattagaactttcttatggtaggctgggcacggtggctcacgcctgtaatcccagtgctttgggaggccaaggtgggcggatcacctgaggtcaggagttcgagaccagcctgaccaacatagagaaaccctgtctctactaaaaatacaaaattagccgggtgtggtggtgcgcacctgtaatccccgctactcaggaaggctgaggcaggagaatcgcttgaacccaggagaatcgtttgaacccaggaggcggaggttgcagtgagctgagatcacgctattgcactccaccctgggcaacaagagcgaaactccgtctcaaaaaaaaaaagaactttcccatggtaagtttagtttcttgcaaaacttctggtgacacccttattaattaatgagttttgaaatatgaacaaccccaaaagtattctttcaagccccagtgttcatggagacacaaagaaatgttcaagaaatgttttttgggcacttactatgtgccagaccttgtgaataagaataaatcctatatagtgctagctttaagggaatttctagtctagaattttaatgcagtatactatgttattatctgaaaacatgaaggaagaactgagggtgtgtgtggttgcatggggaagtgggtttgtgcatggtttatgtcagaccaggcttgataattaagtctaattagccaggcaaggaagatggtggaaggggagggaattttctgagtagagagaatagcacatgcaaaagtttgcagataagagcttgattttattcaaggaactctggatagttaggtttagttctaagaggaaatggaatgggagattggagttttgggggaggtggataggatatgatgctagaaatgtacatagatccaaattatgtaaaatggtatgtgctatgctgaagagattgtcatcttgccttgactttaggacagatttctctatttctgcaaaaaatgttgggattttgggatttgggattttgataggtaatgcattgaatctgtagattgctttatatagtattgacatcttaacaatattgttttgtagtccatgaacacgggatacctttctattagtgtcttctatatttcttttttttttttttttttgagacagagtcttgctctgtagcccaggctggagtgcagtggcgcgatctcggctcactgcaagctccacctcctggattcatgccattctcctgcctcagcctcctgactagctgggactacaagcacccgccaccacgcccggctaattttttgtatttttagtagagacggggtttcactgtgttagccaggatggtgtcgatctcccgacctcgtgatccgcccgcctcagcctcccaaagtgctgggattacaggcgtgagccactgcgcccggtctatatttctttttaagattttttaatttttaattactaatttttagagatgaggtcttgcctcattgcccaggcttgagtgcagtggcacaatcatggttcgccgtagcctcaaattccagggtgcaggcaatccttccgcttccaccttcagagtagctaggactacaggcatgcaccaccgaacctggctaatttatttttttatagagacagggatctcattttgttgcccaggctagtctcaactcctgggctcaagcagtcctctgacctcattggcctccaaaagtgctaggattacaggtgtgagccaccacacctggtcattctataatttctttcagcaacattttctgattgtcattgtacaagttttttgtctccttggtgaaatgtattcttaagtattttattcttttgatgctactgtaaatagaattgtttttttaatttgcttttcagattgttcattgttagtgtatagaaatacaactggttttagtgagttgattttatattctgcaactttcttgaaactcttgatttctatttttgttttttatgttttgaaacagagtctcactctgtcacccaggctggagtgcagtggcatgatcgcagctcactgcaacctctgcctcccaggttgaagcagttctcctggctcagccccgcaagtagctgggactacaggcacgcaccaccactcctggctaatttttgtatttttagtagagatgaggtttcaccatgttggccaggctggtcttgaattgctgacctcaagcaagccgcccatctcggcctcccaaagtgctaggattacaggcaggagccactgtgcctggctatttataagctattaatttaatagaaataaaatatttgacagatttcttcttcctattctttggtgttacaggatcttcatgaaatccctattttacagtgaggaagcatcaagaaacaaatggtatactctttaataggaacaatatgccatatttatcaaattatagaatatataaagcttgcaaatattatgtagtagataattcctttaaagtgtactcctcatggttatgttctaatcacattcccacaaaagtttctatactctgaataactttaagggaggaatacagtaattgttggtgtatatgataaggtccatgtgttttatgaatattaggtattggatatatgagctcataagagaagataatctttggtacgttatattgatcatgccactttcccaatttcaaataacttatggattcttaaaggtattaaatgaataagtactattttttaagtagatatgtcattttaaaacattttggtttgggccatgccttcgtcaatatgttccacatagttccatataaaattagagtctctatatgataacatcaaagacatgcctgaagggaacttaatttttttaaggaggtggggaatccatttgtagaaaccagtgtaagaagctgtttgaaagacatcaaacatggacttgtctggactttgcaggttttaaggtatatataggaatcaaaattgactcatgacttttaaagcttcatgtcagtaaaaaataaaagagaaatgttgggaatggtaatatttgagatatatagtttttacttagctacagaaatgtacccataggaacttgcttgaatctgaatgctctgctacacgtgtttagaattatttttgcctcttttgccaaaacataataaaatgatagcaaaatatgacagtatgtgcactgatcacaacaatataataaactgcatccatgtcttttaaaactaggcaagaatagacaaaatgctctaatttctgttggagactagcaatatgcaaaccagaccatttttgttgaaaaattctggagacatttatgaccgagtttttatatcctttaagataattttatcctttcatgattgtatcatttcatgatatgttccttttgtgacaaatgctgctagtatcagtgtcacagattgttactgatgatatacagtgtttatgctttaaattccgaactcacagaatttaatggaaacttcagaattctttaaatttcaaaagttttaaagcatatttatttgggtacaaaattttattgcctttaaaaatctttttcagtatcaagtttattatcaaaagcacaaataataaaatagaatttaaaatatttattttcagaataccactattttaataaatgatcttttgcctatgccagcgtctgctattaacatctagctaatatattttctgtgtctagtaaatatggtaatcagtttcaaagaaaactaggtaggttttgtgaggcaaagttgaaacaccttgaagaaatgggaaagtttgggggctctaataggacaggataaatatttcttgattcattttttaattgctccatttattttctatacatagaatcaaaaattctaaaaagagaacattatcttaagactgcacaaattaacagtgaaaggaattgtcccactcattattaagaatgctgtcaggctgggcacagtggcacacacttgggaggccaaggcaggaggattacttgagtccgggagtctgagaccagcctggacaacaaagcgagaccctgtctctacaaaaaacatttttttaattagctaggcatggtggtgtgtgcctgtggtcccagctacttgagaggttgaggcaggaggatcgcttgggcctggtaagtcaaggctacagtgagccgtgattgcaccactgcaccccagcctgggtgacagaaatcctgtctcaaaaataataataatattattattattatcagtaactctcacaccttttattttttatttgcattcacatctgtaaataataaaatccacaaaaattaatttacccattttgagataattcaatcttaagcaaagtgagcacagcttaagtatggctttggaatttaaataatttgttaggcaattatagaaatgctagcagtagtagttttggttgaagtttaattacttcatttgtatataaagcccccactgtttgtcaagaaagtgatgttaggggtattatttataattcagaaccataaataacttgtttaaaatgacagtacatacattttatatatatatatggtttggtctgggtaaagaactaaaataagaacatagcagtgatttttgttaatgcataaggaattcttgcctcatttctgaactcttaaatttgctttgtgtattacaatatacaggcccttgattgtttcatttcctccaaaatttatgtatgagtgtgtgtaaggttaattgtagcacagtgcttggtcttgtgaacactgtttcctcaataggtatcttaggttgccagtgttacaatcccagatactttgttcaacagattacctgttcatacaggagctacattgttgtatagcctcattccttccgatgggtgtggagcaggattaaagcacactttataggggttctaattgtagattcctaattgacttggtgaatagcaaatgctaaaatttaaacacacacacatatacacatataaacctgtttcagggtgatctacgtgacagaacaaatgcctcacaggtgttgaatgcttaccagataaaagagtagttcttcccctgtttcccaaggattttcttttgaagtttatatggattttctgtctcattgtttcttttcttaaaatggtttgtggcaagaatccatttcatctttggctgcacttttcacttttaaaggcagaactgattgttagaagtcagccaaaattaaaaacaaaaaaaaaatctgtcaagtaaaatttcgcacatttttgagaagggaaaacatgtgcatggatgcaccacaggttttggttttttaaacaactcacttattgaaggatgtttgggttgtttctaatgtttggctaagactgctgtgaacattcaatacaggtttatctgtaacatttttttcaccatcttatttataacattttatttattcaaattatagagcatagaatcgaagataaaatgtgtcatatcagttggacattttctaaaggtgaaatttgagacataaggaaaaaatgtaacatccaaaaaattctccagggcctttatttttccacagtatatggatttcctggcaataaatcattactatggagggcaataagaagagatgacttcttctttagtgtctatgtgaccatggttgggaaatgtataggtttgtttttaaaatttgtatttgtctaaattatgttgtccaaaagattgtatcaagtttaacaaataaagaaaaattatgttcttaggaatgataaatatattaatgtttctatacacatatatgaaaaacttttctgatttataacttgatagaatctgtgaactaccaaaggcatatagtaaatattcttgggttcttcggaaatcagtcaactagtaattatttattggtaactaactgccaccaaataaaaattcttgagtagatctataattgggtaaattgtagaatagtaaaagcactgattgagaaattaaagagtaaatattgagggcttttttcccctttatgttaatcacattgcagaaaatggggagcatagagaaaatagagggcacagcaatattcaacagaaaaaattttctagttttttactattttaatatttgattaaataacttcattttattttattttgttttgttttattttattttattttattttttcagacggagtttcgctcttgttgcccacgctggagtgcaatggcgggatctcagctcaccgcagcctctgcctcccgggttcaagcgattctccccagcctcccgagtagctagggttacaagcatgtgccaccacacccggctaattttgtctttttattagagacggggtttctccacgttgatcgggctggtctcggaactcttgacctcgggtgatctgcccaccttggcctcccaaggtgctggtattacaggcatgaatcaccgtgcccagccgattaaataacatttttaaatcaatattgggttttataatttttacaattttgctagttgttttggtttgacttatatttagttgctgatgatgtatgtattttcatatttgttcagtgacttttttcttttgttaattactgttcatgaaaattagaaatgtcaccctgttttgtccatatccttccttgcagtttcaatgcctgtcagtctgctttcttctcagtaattacctgagtccataggcagtggtcttctcttatgttttgtatcagacttaattaaaattaaaaattcatgtaatagatatcttgagataaaacattcatgccttttgttaggtacttttccataaggaattttgctactagtccaggacttcctaccacagtctagtttaatcccagaagatttgtgcctacataaacaccattgctgttagcaaatacacaggctatgtcagaacatagaccttcatttacagtgaacttctaattatatgcttgccctgctattagaaaagtaataacttactttagatggggaaaatgttattccatttgactgtcatatgatagactaaaagcaatacattgcagatatgcttttgtgactgcagagtacacgtaaggggcatatactgtaaactaatgagacctggtttattatttagaggccagactgatgtgacttaatagtggagcatttgactcataaaggaactgttgtagaagtaataccttttctttttacttttcaggtttacaagtaaaagtaaccaagctaaaacaggaacgaatcttgtaagtatcagtatgtaatactcatgtgttatttatagagtagttgatactgatgtccaatttgacattcatagagtagttgatactgatgtccaatttgaccttaatgtcttatttataaaaaaaattagccctacttagtatgggccttggtagtcagcagcagttttttttttcaaattctaaagtaaaaagaataattttgcaattttaagtgtagccttaattatgtatgtttatattgtaatacaacttacatatgtaatcttttcccataaagtattaaaatgacaattgatctgtagtctcattttgatttgtcagcggagttctttgttgagccataattaacacatggaattcaacatgctacaagacgaggagcagaataattctgggatttctaaactcatatgaatggaaactaaatgggtattttaagactccttttaggtagtttgaaattacttgaagattctctgaattgttttgcttataaagttctaaatcagatctgattttttaagttcgggaacatattttactcatgattctctagagcttccacattcaggaatctgaaacagatggcagagtagctttgtaacacttactaagaaaattctctttagctgctgagaaatttagaaattctggaatatagactattcaccttcagataaactcttgttttcttttaaaattattttaattaagaaatttaaagaattgtaaagacaaaaaaaattttccagttgtgcagcactgttttcatgcttttgattccttatcacaaagtttctttgtagagggtataactcgaacataatgttttgtccattttattcatagtagttcctatccctccctatagatccccccaccccagcccccatatatgacatttgatttaaaagtaatgaaaaaattgttgaatgtgctgcataggtatgtaaaagagacaggaaggtttgttatctattttattacagttacattttcaaatacaagatttacccagcttcttatgccagttgtatttaaaatgttcagttaccttagaaagacagaaggccaccaattaggaaaatgatactgagtttttagtaaaatgctgctaatggcattgagcttgctttagaaatgaagttagtgattggtgtagtaataactcttcctttggatgaggtccagggtagacctgtctttaatatattagacacttccctgtttttgaaattgcatgactctttttgcactgtctggaattcatcaatttgcttttttaaagaccttgttaaattatttctgcaattagtaaatgctctttatgttaccactttcttgacctgaatattttattaagtaattgaagttagttttaacttcaacttaggttattcatctacataatagtttagctttaagacaaatactgtcatgctctgcgttattctaaatagaacagtaatggaatatatgaatatgggaaaatcagataactcactactattacagagttctgttcatcatttaagaaaaaaccctttgctattaacttttcactccttaagagtgaaaatgtatatgtgtgtaaatcttcaatgtgtgtgtaaatcttcaatttaatatttactgtattttatgatacagattatttaaggcaaatgtgtgtaaattttcaatgtaatatttactgtattttatgatacagattaagttaaatattaaatttgaatacatgttggcagtctgttttaggacatgattaatcacacctccaggcttagacaagttatctggttgtatttgctgaataggatcagtgaaaacctggtgttccttctgaattaaatatattttctagaagtagtaggaaatattttatttatttatttatttatttatttttgttaaatgagaaatggccaggttaacaagcttcaatgatatattactttctgttattttcaagttctcagatgtccctacatgctaccataactatatttgttgtatagccagaaggtgttgctcttacgtgtattggtttttcaattaatataaacttttcaacaaatatttaagaaattccctctatatttgatacctgacattttggcttagttgttttactcatctattttggtgccagtgacactatattctagccactttgacacaatcattttgacatctactttttatgacagactgatttgccactcttaattgatttgatattttagacccttcaagggactgggagaaggtgtttgaatcatagtattacattttcagcttcaagactatacagaaaatcctaatcaaatttctaatgggttttcttagaattaaaatatgtgaatactttatataataaggtgatttttaaaaataatgatagaggggtaaaatatgacaactttggaaggtaatcaggtttaagtagaagaagattctggttgtctttgttagttttttttctcactataaagtcataatggtaaacacttaacataaagcctactgtgtgccacactgttccgtatccaatacatacattaatacttatttctcagaccttttggagtagatattaatgtatctacacttggtgaggcacagagagtttaggttaattgtatcaggtcacacagctggtaaatgaagagctggactcaaacccattttgcatctgggcgtagggttcccgttcgtccacttcactgtaagctctgacttaaaagcaagaccaggtaaaaattttaaacaacacagaaattagtaaaatagaaagtatgagttccccataattgaagagatgatgtgagtagagaaatactatttacattaataaatatatgcaaaataataaaataatgtacattttgatagctattttgacaaagttgagtcaatagtggcatgatgactttatggtatataagagctctgcagagaaaattctggtataatttgaactgtgatttacaagatattccaacctgaccttttcagttgttttgttttggtacaagaaatttgttatataaacacggtggagctcttagaattatcctgttaagagtatttttatctgaaaaacttatttattttttgacctttagagatgcacaaagactagaagaattcttcaccaaaaatcaacagctgagggaacagcagaaagtccttcatgaaaccattaaagttttagaagatcggtgagtctggcacttaggtcttgagtaagaagtgatttcctccataataagaagtacattgactttcatttgtaattagttttgggattgaaagtgatctttcccacagccttctctcacctttgaatgaatactttatgaaaacaaggatctattctttaagattttcattaattctgagatcacatcagtttaccctttaaatgatatctttatctggtgtttgatgtagtggaagctcaagggtagcaatgttctaattcatttaatgctttaattccagttttacttctaagtaggtggaaactgcttcacaattctgtttctgtcgtcttttcttgttcttgctgttctcttttcttctttgcagatttcctcactttgagggagtctagggatcttctttctgagtattcctgaaataatattatcacttacttccatacacagacttctttctttcccactcctatgaggttaacactgaggattagaaaaggcttccagcatttgctgttttcccttttctgaattgtaagtgctatttaggacctataaactacctacctgctatagtaaacaatattccagccaagcgtggtggctcacacctgtaatctcaatactttgggaggctaaggtgggaggatcgcctgaggccagacattcaagaccagcctggacaaacaaagcgagaccctgtctctacaaaaaattttaaaagctgagcatgatggcctgaacctgtagtttcagctactctagaggatcgcttgagtccaaagtgattgaggctgcagtgagctatgatcgcactgctgcgctccagcctgggtgacagagcaagaccgtgtctccaaaaaaaaaaaaaaaatacaaacccacgatatcccatactttctttatagtttttatttttccagggtaggcatagtggctcatgcctgtaacctcagttctttgggaagccaaggcaagaagatgattgcttgagtccagtagttcaaaaccagcgtcgcagtatagcaagaactcatctctacaaaaaattaaaaattagccaggcatgtgactggagtcctagctactcaggacactgagacgggaggattgcttgagtccaggagtttgagcaagctatgattgtgccattgcactccagcctgtgtaacagaacaagaccctgtctcttaaaaaaatttttttcttgatatttttgtatatgttacggaagggctgggtgatttgagtttgtctctatccttttagtggtgaaataatttaatattcttcatatgtgcaaactgaaattgagtactttctacaactaccaactcaatggatgcacatttgttggaataggcagtgtattgtggaataaagacctgtgcgctttagaatcacatatgtttttgaattccagcttcaccctgtgttcttaattcagattccacaacaaatatttgagtccttgctgtcttaggtgttgctctagggggctagggatgatacttttcctagtatgtcatggattaaatgagacagtgcaagtaacaatacataacagaagttgaataagacttacatatcttagttggtgaatataatttagcactcctgtctgtgcatatatttaattttcaaaggttgggagtgagccatacgacaaacaaatgagacaatttcagattataaatgctatgaagaaaataaaatcgaattatgtaattgagtaaccacaggatctgtgtagaaaaaaaaaccaaacgcagcttttcccactgtactcgtacaacatgcttcagacaccagatgtgaggaggagtttcccctaccaacaagcaaacaattaattctacagcagacactagctgggtatcctcttaattcaattcctacactggatatggcatcaggtcccacaggttgagggctttgtccccatgactgtgtccttccctcaattctgatgccaatttcaagccccaggttgtttacccatgctttggacagactctaaattggggttcccacaaccccctcctcgggttatatttactagagtgactcacgaaactcaggaaaacatttatatttatcagtttattacaaaaaatttgttaaaggttacaagtcaacagccaaatgaagagatacatggggtgaggtctagaaggatcctaaacacaggagcttctgtcaccatggagttggggtgctgtcttaactgagacttgattgacagaaaggaaccatccacttgaagaactagagacaaaaggaaatagaacagacaaatgtgaaagtctagggtagaaataagtttgaaatatttgaggaacagaaagtctactgtggttctagtttaatgagtaaaggggatgagtgataggagtgagattggaaatctagtggggcaacaactagatttcgtagggacataggcaaaaagtttggattttaattgtgatggaaaccacttaagcaggagaataacaaagggatataagtaggtagcaacagcctgtctatccaaatggaaatgtcaagtagatagatgtatatgtgaatctaggattcagtggatctcttaaggacatctttgaatagtataggaagaaagaagaggtcttagggctgaatcctttggcattcctgattaaggtttcatgaagaataaggacccagccagcaaaagattgagaaagagaaactattaaaatagaagaaaagccaggaacataggtcttgaccactaacaataccttctttgcagggctattttgaagtttaaatgagataatggaagcagcagtacataacagatatttaataagacatatactatctcctaattggaagatgattccaacttttagcactctaatctgtgttatataacacagccatgtctaggctgtctagctgagaagccaggaaactagaaagccatctctcccactcaccctttcccaggtcagcaatggaaaggaaatcattagttactcatctgtagtgtggtgaggcgcttccttctgttttctctggatatgtagtagaggatttcagggaacatatctctctcagcctttaactccagccattgaagagcttccttctcttatttcaccacgttttttctctcatttctaccattacaccactttctacaagcagtgaggttggagtgagtaatggcattaacgccaagagattaggaatgctttttgttccatcattcctatgtaaagaaaatttcaagattggtattaataacgaaatatgttagcctgagttctctgagaagcaaacatcaataagactttggacactgaagagatttattgggaaaaatacctgtaagaaatgaggcgtctgggagagctgtcagaccctcatgcctctaactctgtgaagaagagagggaagaggatactgtacttgtaagagagctttgacaaagctaacagggagtcctggagccatagttgccctgctttcctcatttatagcaggatctgactatgggatgcctggtgtattcacctatgtggaaacaggtgaaggatttcacagcacagaaggtggagccagggattttattctcctactgtggtaggagacagtaagatgactggccaacttatattgacttccagtactcttcctgtttagttgttccttagcaagttgttagagcccaaaattattacactcaaatttactggataacattttcattatgtttttcttgaaacattggcttaatacaattggctctccatttcatccccaagatagtattcttcatcctgccccttgaagacattgctttccagtgtcttcaaaacactcttcattttatggcttaaagtttgagcttcctgttctggtaacctttgcagtcttgtacttcctttttaagtagtttttcttctccaggccgtttcagagaagaaatcagtggatgagtgcctcatctccttcccattaaattactttcttttatgtagtctatatattttttttttatttttatttttccctgtattagtccattttcacgctgatttaaaggactgcctgagattgggtagtttataaagaaaggtggtttagttgactcacagttctgcagagctggggaggcctcaggaaacttacaatcatggcagaaagggaagcaaacacatcctttttcacatgatggcaggaagaagtgccaagcaaaagggggataagccccttataaaaccatcagatctcatgagaactcactcactatccacaagaacagaagcatgggggtaaccacccccatgattcaattacttcccacagttgggactgtgggaactacaattcaagttgagatttgggtggggacacagccaaatcatatcattccactccttgccccttccaaatctcatgtcctcgcatttcaagacaatcattgccttccccacagtcgcctagaatcttaactcattacagcattaacccaaaagtccaagtccaaagtctcatctgagacaaggcaagttccttccgcctgtgagcctgtaaaatcaaaagcaagttagttacctcgtagatacagtggggatacaggcattgggtaaatacacccattccaaatgggagaaattggccaaaacaaaggggctgcaggccccatgcaaatccaaaatccagcagggcagtcaaattttaaaactccaaaatgatcccctttgactccatgtctcacatccaggtcatgctgatacaagaggtgggttcccacagtcttgggcagctctgcccctgtgattttgcagggtacagccccattcccagcttccttcacaggctggcattgagtgtttgcggcttttccaggtgcacagtgcaagctgttggtggatctgggtgtttctggggtctggaggatgatggccgtcttattacagctccactagacagtgtcccagtggggactgtgtggaggctccaacccaacatttccctcccacacagttccacatggttggggaggcctcagaaaacttacaatcatggcgaagggggagtaaacacgtccttcttcacatgatggcaggaggaagtgccaagcaaaagggggaaaagccccttatgaaaccatcagatctcgttagaactcactatcaagagaacagcagcatagcgttaactgcccccatgattcagttacctcctaccagatccctccctcctgatttcaagcagttctcccacctcatcctcccaaagcgctggtattgtaggcataagccactgtgcgcagccagttgatacatttaattgttaaaattatgtgttttattctgcatttcttaaaactaggttcttttctctttaagatctattctacctctggtggatgccatgctgctttggtatttctcattctaaatattcccttgcctttcattccattcacctttacatcctcaggtacatgggcctgtaattcattaggtggtattaatttggtggcagggagtcggggtgggatgagggatatgtagctcgttgttttgtagacttgcttttgctcacctttcttcaaatgcaaatccaaaatttcctgtgggcacacttaaagatttatctcttgtttcatgaagctccatttaattaagctgaagatctgtttttttaaatacagtagttagtatgtattgaggattcactttgtacttaggcatccagcgctaaatctttctattaacgctacaggatagatgatagatccattttgcatgtgaggaaactagctggcaaagagcaaagaagctttcccaggatcacatagttaatacataattaggtttatatcttttttttttttttttgagacagagtcttgctctgtcacccaggctggagtgcagtggcgcgatctctgctcactgcaagctccgcctgccaggttcacgccattctcctgcctcagcctcccgagtggctgggactacaggcgcccactgcctcgcccggctaatttttttttgtatttttagtagagacgggttttcactgtgttcgccaggatggcctcgatctcctgacctcgtgatctgcccacctgggcctcccaaagtgctgggattacaggtgtgagccaccgcgcctggccaggtttatatcttaaatctgatccccgcttccatttttactatttcatgatgcctcccctttatattgtcttaactttattaatgttatataaattaattacatcttaaatgatcatctcaaagtatttgtgcttgatctaaagtttaccaaaacagacactctgaaatatcaggtcttcaacattgcctattgtatagtctgtttccttggaaggtttttttttcgtttttgtttttttaattgttgctaactaaatactacctttaaaggactaagtaggtaacttttggtgaatttctgctttatttaaaattttcttttagttctatgtcatatgtaagaatgattatctagagtaagctttaaaaatctgtacaaactaacattttgctgagacctttaaaagcaacatgtattttgttaatttttttttcttttgtttggtctttttgttttgttttgttttgtttagagacagggtcttactctgttgcccaggctggagtgtaatggcaccatcatagctcattacagcctcaaattccttggctcaagagatcttctcacatcagcccccccaggtagctaggactacaggcaagcaccacgccatgcctggctaatttttttgtttttatagagactgtcttgctgcgttgatcataggctggtcttgaactcctggcctcaagtgatcctcctgccttggccttccacggtattgggattacaggcatcagccactgtgttcagcctattttgttaaaatttctgaacagtaattcagcctactcttcataaaacaaagcaattcttagtatgttaatgggaaaacactgagatatttcaatgaagggaattacctagtaaaagtaaattagataataaaaagttctaagttctaattttatgtggctcatttatgtttaatgattattatgttttatattatgtttaataattattattatgtttaatgagtatatttacagactttccttccaggaactaaagtatttcactaaatctaagaaacagtcactgtgctggagaagtagatagaacgcattttttttgaaaatctgaacaaagaagttaaaacacagttgtctaatagagtttaatattttttaaagcattttggcagtcagtgagctcattttcagatgctgttaaaaggaaaattgatacttataatcaggagatgtatggttctgcaactatttttcaaacactgaagcaagtgtccgcttttgtgttgctgttattcatagatttgaatttaaacatcatattattcaggagactttctctaacttgctagactaggttaagttgctgtgtgctttcatagtactctgtatttctgctgtcacagtatgaattatactttgttgtaattactttttcttttttttttttttttttttgcctgtctttctctggtagactataagctttttaaagaaatggcattaccttcatctctgttgtatttacagcactgagcacattgtaagtaaacagtgaaaccatattgaatgaaaatgaataaatgtcaataaatctttttgggctatagcaaacaattgagcataattgttactctgataagttttagtagcaaatggaagcttttatttcttcatctttgtgaactggaataaactcagaatgcatgttgctttctgccttttgtggaattgcccttttttccctttacctgttacatagctactgaaactgcattctcttgtgaaattgggagtgttttttctttagcagcagcagtggaagataggcaagaggaaagcaatggaaccatgctgatggaaacaggagctagcacattttcttgcttctatttaaatttaaactaggatcagcaatcaaaaattgaccctttttcacagatactattatcaagaatggtaggtgataagaaaaactgaaagtaataagctagggaatattgcttcattttgtttcattttgtaaccatctagccagtgatattttaaaaatccctctcctgtatttgaaaagttattgttttagctcttctattttacctttcaaccttaatatatatatttaggtctttgttttatattgcttcacctgtgaacagtttccctgttcttaccattatgttacaggaagatactggtgtttcttaccctttcctctatcacttttccgctctttctaccatctgcctttgatgagctgaacctttacgatataaatatggtcaaggttgacaatagttatcttcttttctattaccagatttcagtcttttttgtattttgtttataagctgattctagaagttggaaaatagtaaactgagtttatttattgactgtataaatattcactgcagagctaggattgcatttctttacgtatctgatgtcatggcctttctgccactgagggaaattgtttctaatgtccagatgaaatacattgttttttactttgtccccaatcagttgttcaaatcagctcataattatgttatgataatgacttatttaaatgtttttttctagaatttctcactaccctttttcatgttgagacaagaaccatgtttccttacatcattaatattatttaatgccttagttattctactcattcattaatttttttttgttgtaggttttgtttgtttgttttgaggcagggtctcgctctgctggagtgcagtggcgcgaccttggctcacttcagcatctacctcccaggcccaagtgatcctcacacctcagccttagagtagctgggactacacataacactacacctgactaattttctgatttttttatagagacaaggtcctcctatgttgcccaggcttgtcttgaactcctaggctcagaccatcctcccacctcagcctcccagagtactgagattataggcatgagccactgtgctcagccagttctttttcttgaagaaatatttcttgggctaaaaaacttcttgtactaatttaggtcattcactttctagactattctagaaagctgtcattctggatttctcttcattagatccctgcattaattcagttatttcatttctctcatgttaaacagtcaacaaatacttaatgaaccacctgttttgttccaggcactgttttagaccttggggatacaccagtgaatgtgatcgataaatgtgggcctttctattggttttttaagctcattttgttacagcttaccctcaagtaactgctgaaaaagaaggcacaggaactaaattttcaaagggtccttgcattctcgaaaatatttttattctactgtttattatatagttgatattttgactggatataaatttctaggtttaaaatagttttccctgaaaactttgaaggcatttctcattgttagcattccagtactgatacagtctgccattctcgtgttaattcttttgtaggtaacagattttcttttcctttctgaaatttttccttgttctgatcaaccttcgtgatgctctgtgtgtgtgtgtttccttcattgcactggacactcaacctgttaacctaaaaactagcactcaaagtctggtaatttttttctgccactttctctattttttaatggtctctctttctggagcacttcttagtcagagactgattttttatcatcttttctcttattttctattacttgtttttcttccatgttctgtgagatttcttttattctccaaccctactattgaagttattttgacaatcacgtacgtaatatccaagaactttttattatttgttgattgttgctgtatatttatatgtgtgtgtgtgtttgtgtgtgtgtgtgtgtatactcttgttttatggctgtatcatttcccagatttttccaggaatgctagatagcttttgcttttccccctcaaggtctttttgtgtggtaaaaatctatataagatgaactttctttttttttttttttttttttggtggtggttgttgttttgagacagagtctcgctctgtcacacacgctggagtacagtggtgcaatctcagctcactgcaagctccgcctcccaggttcacaccattctcctgcctcagcctcccgagtagctgggactacaggcacccgccaccacgcccaactaacttttttatattttttcgtagagacggggttttaccgtgttagccaggatggtctcaacctcctgaccttgtgatccgcccacctcggcctcccaaagtgctgggattacaggcatgagccaccacacctggccgaactttactattttttaaaaaacaactttattgagataaaattctcataacatacagtttaccaacttaaagtgtacagaggctggtgcattggctcacacctgtattcccagcatgggaggccaagtaggcagatcgctttagcccaaaagtttgagaccagccggggcaacgtggcaaaaccctgtctctaaaagtacaaaattacccagcatggtggtgagtgcctgtagtcccagctactcaggctgctgaggtgggaggatcacttgagcccaggaagtcaaggcagcagtgagcagtgatcatgccactgcactccagcctgggcgaaagagcaagaccctgtctcaacaaaaaagacaaatgattatcaatgcttatattacagtctccctttataaaaaaaaagtttttttcttctgacagtctcgttcagtcatccaagctggggcgcagtagtgcaataatagctcactgcagattctcctgcctcagcctcccaaagtgctaagattataggagtgagccactgtgcctggcctataaaaattttttataatgtaatttttagtatcctgaaatgaaatttaaataatataacctacctacatacataattattttttaaatatcacaactatatagagaaaattgatttgtagtatatcagaaagtaaatattacgggtatgtctgttctaaaagatgagttgttgagatactcgttcctttgtataaaatgatcattaatgtgactgatacaagtatgtttattgatgattcaagtaacactaactgcatttttcgtcagtgacatgatttttcaaaattgtaaagattattggtaaataggaacagttccaacagacctaatcatttttgtttgtttaattaaagttgtactagctcctagtttaacttgtaaaaagcattatatgtatgtgaccagtaatcagcaagaaataaggaaaagcgaatgacaaaaaagaaaaacttgcatgtgtagctgggagatcagcatcaatatcagatgcctgttagccttgtttaacccttctcttagctgtgagtttaagccagacttaaaagccaagcatgagtggaagagctgggggcccagctatacaggtaggaaagctaagcatgtaatgagtgctgatgatgaaacttattgcaagccatggatggctccataggttcaaggcataccatacttcttacaccccagagtgagtggtagggcaagtgtgtatattttaagtactcaggcattagattttcactgttaacaaaatggctcaatataaggataagacatgaaaagaacataggtaggagaagatgagagtgccttattctaaagcaagcttgtctaacccacgacctgcgggctgcatgtggcccaggacagctttgaatgcagcccaacacaaatttgtaaactttcttaaaacattatgaaatttgtttgacttttattttttaagctcatcagctatcattagtgttagtgtatgtgggcccaagacagttcttccagggaagccaaaagattggacaccccgttctaaagctttaaggatcaatctgtgaagagaagcttctgagcagattcccgggccccgtccctgcagattctaattcagttgatcatgggtagacttacaaatctttttcctctctttctccctccctcccttttaaatctgcttaggtggttttgagaaatagccaggtttagggaccactgatctaactatctattcaacatgtgtttaaaattaccttcctaatttctgagtgatcgtcttttctgtgcttaaacatgtccagtgacaaatgaaatcactcccttcttaggtaacacattccatccttaaatactgtaattggaaagttttctttatactaggtttatatctgtagaattgctgcccattggtcctagttttagtcctttagatcataaatctctttcacatgattaacttttcagatatttagacagctgtcagccctcagtacccttctgacttttttttttctcctgctgattttcctctttgctttactctactgaagttatactggcctccttgacatttctttaatagtccaggcacttttcaactgtaggaattttgtactctatcctcattcacctgtaacagtctcttgcaggtattcttaaaactcactccctctcatcatttacatctcctcgcaaatgttaacttcacagtgaagtttttcttcaatagcctatttaaaattgcaccaagttccccaacctaactggatcttctatctccctctgtgatttgtttcctcccaaagcacgtatcaccttgtttttttttcctttttctttttttgagacagagtctcactcactctgtcgcccaagctggagtgcagtggcataatcttggctcactgcaacctccacctctcgggttcaagtgatccccccgagctcacacacatacacaccccctcctctccaccccccctacctcaacctccctagtagctgggactacaggtgtgtgccaccatgtccagctaatttttctgatatttttcgtacggacagggtttcaccatgttggccaggctggtctcgaactcctggcctcaagtgatccacgtgcctcagcctcccaaagtactggagttacaggcatgagccaccgcacccagccccaaagtacataccaccttctaatacgctatacaacttactttactttcccttttttttgtctattttttattgtgtctcttctaccagattccaagtcaaacaattgtactgatctttctcatctttataatttcagccaaaagaacagacatttattcagagtaggagatcaacaaacataattaagttctccttctttccaatttccccttcttcagaagcagtcattttcaattcttcatattgttttgctgtttacttcaaaaatctctttttaaaaatgtttatgagctatctataaatttttcttgacttaggtgtttttttttcttttttctgctttctacatagacgccattcccatttccctcttcctcctatgtagtgtataataattttggttagatcactattgagtttttattttatgattatgtaaatgcagttcaaagctgaaacatattgtaaactgtaatttttcttcctatgcaaatttctgttgtccatagtgtttatgatggacctttttttcatatgcttagtgttcttaccaaccactagttcaaccacaacgttctatcatttatctaaatgtatcaaggtgtttagatgggttgtatcttctgtcatttcaccttttcaaacagatctgtctcagaggctctgatctgcttcaatttggactctgtcctctttacctgctacgtagtggtcatcagaggttccttttactgctttcctttttcatatatctaggacttcttttctattttttcttattttggtagaatgcctcctccagtagatttctgagacggagtgtatgagacctaaaaaaagtttattttagaaaatcacacatatataaaagtagacatagtagtataaccaattccgttgtacccatcacttggtttcagcagttaattgtggccattcttgtttcactttatttcgattagtccctctcactaccattttgagaccttgtctcaaaaaaagagtaccattgtcatgcttaaaaaaaattaatgataggaagcaaaatttttgagatttttacatgtctgaaaatttttgttgaaataatagttggagaatataggtttaggttggaaataattctctttcagaattccaagtcacttcttttagcttctaatgttgctgttgaaatcccacactattctgagttttcttttttcccccacaatccccaccaaaacagtgctgttagtctttgtttgtttttgagatgggatctcatgttgaccaggcttgtctagaactcctggcctcaagcgatcctcccatctctattctgattttttatcttttctgtgtactctttaaaaagaaaaaaatttcttctgaacgcttatgggctcttatctttgcagcatccagaaattccataatgatgagttcttttgtatagatctgttaacatccattgtgctggagacttaggttttttttttttttttcttttcagtcctttaagtagtgggccatgttcttgattttcttcactattccccacactgcctcaaatcccctcctgcgtttccttgcttttcctggaactcctattctttatatgatagaccttctagaataattgcccagttttatctaaattttctctttactttttgagtagattttcttagctttactttcttaccttctatttgtagttctttcttaatatttttaatttttaatttttattttattttattttattttattttggtttttgtttaaatagtgacaggatctgactatgttgcctgtgctggtcttcatctggcctcaagcaattaattcttttttgcttcagcccccaaaaatgctgggattacaggcatgggctgccacacctggatactatttttaatttctaaagtctcttttttgttctcagaatatttccttttatggcaatcccattctcattttatagttttcacatcatttcttacctctagaatatagtatgtcctcacttaacattgtagataggttcttggaaactatgactttaaaagaaatgacctacagcagccttcaaataacatcctttcctttgacatcatttctttttaacagtgagggggaaaaattagcttgcttatacatcatttgacttaaagtcacagtttccaagaacctatcaatgatgttaagtgaaggcttactgtattcttcataatttgatgattgtgactgtgatagcattggcattttttctttttctttctgtatagcttattatttcttccagattttttatttctttttttaatgttttgtttgctatggtttcttataatttataagcatttctcagatgccttttgatacttggttatttgttatatttaagagatgagaataaagtaattggaagctctgagtgcatgggtagagctgtagactgtgagcttctctgttagaatgatctggctggtctgtttcctcgaagatgccctaatgtcagtacctttaggtctttcctgtcaggttggtcagatttcctaaagaagactccttaattctattttctagaatgtgtaatagggctgactcccagtgttcttggagccaagtagatgacgagggcctaggctggaatctgagaatttggtgtgtatatatattcatttcattattgtactcctactcctaactgagcctcatggctcccagaccagacactctctgttttagattgtctaagcattaaacctccagtctgctgctgggatgtcaaaggggtaatcacttgactgctcagaatataggagagaatgttcgtataataatttcttaaaacgtgcttttaatcagtcactcccagaaccaattgttgagccttttgggaattttacagtgtgaatcaggttggttctaggtcagtactgtctaatagcattttctgtgatcgtggaaattgttctaaatctgcactgttcaatatggtagcaagtagacatgtggctgctgagcacttgtctgcaactgagaagctcagtttttatttttattttatttatttaaattgaaatagccacatgtgtctgtgtctaccatcctggacaatgcaattctcagcttttcctatcattggcttatgatttagcattctcaggtcactttctatttgcccaccagctgccttgctttcgtttttttgttttgttttctcttccattcttcttgtcctcatgtgtttgtatctttaaaatatagatatatctttactgtaattttatgagattctagaaaggagcagaaatagttgcaagtgttgactttaccatctttagttaagtggtgttctttatacagtgtgattttaaggcttctgatctaattcctgtcttcagactgcattccacttaaatcatgatgcctagctgtttgttcattcattctagaaattccgattctattaatgctacatatgacttcctatcttttgattttacatctatatcaacattgtttcatatgagttttacttttgtataaaatgtctgggttctggccaggcacggtaactcatgcctgtaatcccagtactttgggaggccagggtgggaggatcacttgagctcaggagtttgagaccagcctgggcaacatagtgagaccccatctcattaaaaaaaaaaaaaaaaagtctatgttcttttattttgctttgctttagttgtatacttttcatgttttatctctaacttattttaaaattcgtggcatatgctaccatgctgtgacttccacagacacttaaatacttactatcttttttttttttttttttttttggagagagagagtcttactctgtcacccaggctggagtgcaatggcactatctcagcttactgtaatccctgcctcctgggttcaagcatttatcctgcctcagcctcccgagtagctgggattacaagcatgagccaccacatccagctaatttttgtttttagtagagatgaggttttgccacattggccaggctggtctcttaacacctgacctcaggtgatctgaccacctcggcctcccaaagtactgggattacaggcgtaagccaccatgctctgccaacacttaaatacttattatattattggcttagttattgacttgaaattattatctttgggccaggtgcagcggctcacgcctgtaatcccagcactttgggaggcggaagcaagcggatcacgaggttgggagatcgagaccatcctggctaactcagtgaaaccccatctctatgaaaaatacaaaaaattagccaggagaggtggcgggcaccggtagtcccagctactcgggagactgaggcaggagaatggtgtgaacccaggaggcggagcttgcagtgagctgagattgcgccactgcactccagcctgggtgacagagcaggactccgtctcaaaaaaaaaaaaaaaacaattatcttcgaatttatttcctgaattcttaacgtggggtatgtgtctcctttttaactgtatttttttctgattaggtaaataatgaaattggaaaatgtttcaaaaatatggaaaatgaagaagagaaaatctcccataatactgtcacctacaagataactattattaacattttggaatataactcttcctcacctgcttgtgtgatatgtgtttttctcttcaacagtcacaaataattagtaaaagctatttcgtatttttttttttttttttttgagacggagtctcgctttgtcacccaggctggagtgcagtggtgcaatctcagctcactgcaagctccgcctcccaggctcacgccattctcctgcctcagcctcccgagtagctgggactacaggtgcccgccaccacgcacagctaattttttgtatttttagtagagacaggggtttcactgtgatagccagggttgtctcgatctcctgaccttgtgttccgcccgcctcggcctcccaaagtgttgggattacaggcgtgagccactgtgcccagcctgtaattttttttatgtaatacattgtgaatttttactaataatttttttaatgccaaaaggaaaatatgaggtgactttttctcccttgtatttcttgacctttattcaacaatattgacaaaaaaaaattttttttttttttgagtcagagtcttgctctgtcccccaggctggagtgcagtggcatgatctcagctcactgcaacctccacctcccgggttcaagcgattcttctgcctcagcctcccgagtagctgggactacaagcgagcaccaccacagctggctaatttttgtattttttagtagagacggtgtttactgtattggccaggctggtcttgaactcctgacctcatgatcctgtcgccgcagcctcccagagggctaagattacaggcatgagccactgtgccctgccaatgattggcaaataaattttgatgaatttaatttttcatcaaaaatattattgaacactcactatgggtgacatactgtgctgagcaaagcagctgcaaagttgcttcaggtataattctaccccttggtattagactagggttcatattttgaccataacaaattaaaacaaggtcagcttcttcaataaataagttcccttagcatgagtttaaaattggcagatttttatagaattgcaatctgaagaaaatggtggtataacatgatttcagcctatataagaatatgttaaaggtataataacatcattaatctagttgattttcacagtatttgccaagtcagttccttaaatctttataaaagtcttggaattccaaagaaggaaatctcttttagtggatgaaaaataccttgttttgtttcataggttaagagcaggcttatgtgatcgctgtgcagtaactgaagaacatatgcggaaaaaacagcaagagtttgaaaatatccggcagcagaatcttaaacttattacagaacttagtgagtttcctttcttcatttattatttaaagtatgtaatgtattatttttaagacctattagtaaattggttgtaattaaatggatggtttacatatatttttccttatttagtaaaagttcaaatgtccttttttgtactttttgtagatttaatctcatgcttaatttagtaagaaatagggtacaaaaaggttgtgcaaatactgtccacattggtcttaagtcatcagttgtaagacaagaagcaggtggtgttttttttttttggacatgtccatatttgcttctttggttttaatctttatttcatgtaaccttaatacttagtaaagttaaatacaaagcagacaatttattgttctacacttgttttctctcttggtatttatgacatactgttttcataagtatactattttcagtttattctccttacctattgagtgtagagtttttctacattcttagccgccttcttttattcttttaatacttctgttaaccttattctcttataactatttatttcttttggtgaccattacctggatttcccataagcaactcacaatcaatatattcaaaatctaattaattatcttcttttccaaactaattctgtcttttatttttttctgttaattatattgctaccctgtggttattcaagcaagaatattgaatatatgctcattgtttttaaaagaggtaagaaagaatatagctttattctgctcccagaggtaactactgttaatagtctgatacatatctgtccaggtccaggtttttctgtctctgtgccttgttagaccccgcttccctcccttctcttttgaattttaatgttatcataccatactttgtgttctaatgtgttacttcactttagactatgtcttggaagtctttacatgttaatatgtctatagattctgtggtgtatatgggtgaacgtgtgcatacatttatttaggaatgtaagaatattatcaatgagtagaaaattgttacatctcaataaatatgtagttgttccttgtcatctgtagggtattggttccaggaccctgacgcataccaaaatccttggatgctcaagtaccttatataaagtcacatagtattcgcatataacctacccacattctcttgcatactttaaatcatctctagattccttataataccaaatgcagtctctacgcatcacttcatttgtgtgaattaaatgtagtattcggtgtctggcaaattcaagttttgctttttggaactttgtagaatttttttttcccaaatgtttcccatccacagatttagaactcacagatatagaaggccaactgtagttgagatccacagtaatattattgttagtactactggaaataatctccaataatgtctacatatctaatagatttccagcaactttatctaaaatagagccaaaaactccaagcaagcaaaaaagcttatctaggtgttaaagtataagacaacgtttttttaaatggctgcattgtatgccatagtataggtgtcaattttttagctattgtcactttaatggactgctcaactttttgtttgaatgtttgagaatttttattttcttacatcctcttcagatttgggcaaaaatgtattaataatattcaatctggtgggtgaagaatgatacctttttaaaattggcattccctgttactgttccagtcaagtattattttatatgatcgtcttcttgggtgaatggcttatttattctttgcccagtcttaaattgccctatttgctgtttgtatcttttaatttagtgaataactaagagttatttatatattatggaaggattattacactttggtagatatgctgtgcatatattttctactttgccattacctgttgacttcattttataactacttgacaagtggaagttttgtatattttcttaccttgtttaggaaggctttctctatccccaagaatataaaaatacacacacgtaaatttgcatatttaatccatctggaatttttaacatggaatgtgaagtagaaatttaccatctttagaatttgcaggcattcatcctcaagcttactgtctcacagtcaaaagatggcaggtactttttcaggcctcgtaactgcattcatacaagaaggaagaagcagcagcaaaaggctgaaatgagcatgccaggagagtctttaaaaaaaaaaaaaagcttctttgaacacccacccaataacttttgcttcagtctcactagccaggaaccaccccgaccctcccactcactccatcattggaagatgactaaggatttctgaggtctttcattagctttattttgctgtagattgtctaggtaaaaatatttgcaaatagtgacaatttcgtcttttctttcaattatttttacagtttcttttggtgattgtttttctttacatactttattggcctaaggggctttagaatactgcccagaatagcagttgatacataagggaagactagactatattacatttaagtgtgctgtggccttctagtagatacgtgaaattaagttatggatatttctttctgtacctcttttgccaagttttgcttaattgtgaatttataaaactcttagcatctgttcatgtagtaagttttactgatagcttttctagggtgaaccaatgtttaatttcttttttttttttttttttttttgagacggagtctcacactttcacctaggatggagtgcagtggcgtcatctctgctcactgcaacctctgccttccaggttcaagcagttctcctgcctcaacctcccaagtagctgggattacaggcgcccaccaccacgcccagctaattttttgtatttttagtagagaagcggtttcactatgttggccaggctggtcttgaactcctgacctcgtgatccgctcacctcggcctcccaaagtgctgggattaccgttgtgagccaccgtgcctggccccagtgtttaatttctaaaacagacaggcttgatatgttaatgttttaattggggaacatacatttaaatcatcattttgttcattcagtttttctgccagcaaggttctgttacgatccaaagaattagggcaggcgcgttggctcacgcctgtaatcccagcactttgggaagctgaggtgggtggatcacaaggtcaggagttcaagaccagcctggccaagatggtgaaaacccgtctctactaaaaaaaatacaaaaattagccgggcatggtggcaggcatctgtaatcccagctactcggaaggctgaaacagaattgcttgaacccaggaggcagagattgcagtgagccaagattgcgccactgcattccagcctcggcgacagagcgagactccctctcaaaaaaaaaaaaaaaaaaaaaatcaaagaattagctgggatgctttgaatcttgtttatttctttttttttttttttagagatggattcttgctctgtctcctaggctggagtgcagtgatgctatctcggctcactgcaacctctgtctcctgggttcaagcaattctcctgcctcagcctccccagtagctgggattataggcacgtgcgaccacgcccgactaatttttgtatttttagtagagatggggttttgccatgttggccaggctggcctcgaactcctaacctcggttgatccgctttgcatttttaaagttaatatcttaattctcttccgaataatataagaattttaaagcacttaactttgatgatcttctccacttacattctgctcttgcccagtatttcatttctgtatagttttggggttttttagccctacaagctagatatttttttaaaaaattacctttaagtaaaattacctttcaattagcccaagggagaatccttgctttgctgataataaatcttacagggaccctactctaatgactgaaaatgggagggaaagacaccttgctagagagcttttccgtatggatagttggtcttctgagcgtgaaagcgccttttcttgtgtctactataaattacttgggagcactgctctgattttcttgtctcggtatttattaatgactcctacgtcaaaacttttagagatctatcctcatgactttagcctaagggcaactattaggcaccttttatttacccgtttagcaatttgtgggccatgttgcctctgatactagaattggtatgagattcttctaagaatactcccttttttaaaggccctttttcattggattttaccatcaatctgagcctatttttaaataattcagaaattttttatagttctgatctgttagtgacaccctttctggctttttaatactgcagtagacttattttagagtgttgtcattttatttggatttggagagggaaaatcaagtaaaccatcttaatcagaaatctaaggtcatctttgacttctgtgaaccctacaaaggatgagttgccaaatactatgattctgcctctgttacagttcttctactggtctttacttcctgtttatccacctctacataggtccagatattcatttcttttaatgaccacctgactttttgtcttgtcaatactttcttctcacattggtatatgctatatgtactaacaaatcagtcttcccatcattcatctataaaaaatgattcctggtaatctataagataaagttttaatttcttaacctgctattgaaaactttctaccgtttattatacccagtctttgttccactgattctctctgtagaataatctcctgtccagctcagttgccctttttttgatgaatgccttcctgatcttctcaagggcccaaagtaacctctttctccttggaaatttccttagtactttatttgtacttctcgattgcccttgtcacttttaaacctataaaacatgtttatgtagtatcttgtctcctttgttagactgcacattgctttaggtcactgtctatatcttaatttttttggatcctccacgaaagtagtttaataacctcacatgttgtagatagtccagaaaatttactcagtgtaagaaaatatgtttagatttataaaccactaaattattaacaaattttagagtacaattaaccttctttggtgaaagttgattgtatttactgtgacctgatttctgggatccacttcttttgctaaaacacatgcttaaccagtgacatcatactaagcattgatgagagttttatgctggttccagtagaagttacagcccaaaactggatttctgctttacaaattaaataaatacagataggaaaatttggtggagattcaaacaaacagatactcttcaatggatatatttaagttactgataaccataattattcatgaaacctagagtatgactaagaagaaaatttgatttgataaatgtgcttgttataaaaattacactgatattcagcgtttttggtgtttttttgttttgttttgttttgtttttgagactctccgccacccaggctagagtgcagtggcactattttggctcactacaacctcagcgtcctaggttcaaatgattctcctgcctccacctcgaatagctgggattacaggcatgcgccaccatgtccggctgatttttgtgtttttagtggagacggggtttcaccatggtggccaggctggtctcgaactcctcacctcaaatgatccacccacctccgcctctgagtgctgggattacagctgtgagccactgcgcctggcctattttatttttatgatcaaattaatttcaagatagagactcttgctaaaatggtatttgaaattagtaggactgagtaaccagatggaatgctttcttgtcctcagtatgtataattatactccctagtacatgaagtaccctcttttgcctgcaagcattacataaaattatcagttaatcagttacatggaactggcacggtgtgagatgtagtactccctacctagtaacgaattagttttgcgcacactagtgttaaccctgaataaacattatgatttaggattagaagtactaatttcttcatacatgctgacatattttatttgaaagcctaacatagatgttaatataaatatattatttgccttctttttcacattgtttttaagtgaatgaaaggaatactctacaggaagaaaataaaaagctttctgaacaactccagcagaaaattgagtaagtattttcctccaaccttgttattttattttatttagctatacaaaccatgaagataactgtaagagttgcagatttcattttaaaaattatgaagtgttctgtagttaaaaaatacaaagaaaatcactacatttttgtgttttgagagtatagtgtgaatgcatctcttagattagtgcttgaagaaagtgtcaacattgtaattaaaacattttaatttttataatgatttattataaataatacattattaaaatacttatatttcaaacagatgtttgagttttgttagctcccttccagccctgtcccagaagcttcataagggcaaactgaataagtgtttcctcttatatagtactcaggcctgtagaacttcttccttcctctgtttttctcccttttctccccatttctcttaaagaataaaaccagtaacttttatcttgtgtgccacttcctcttgtgttttatgtttattatttctaattctcactgtgactttgcaaagtagttttattatccccactttacaaatggggaaaccaaaggtcacagtcaaataacttgcctgtcgtcttacagctggtaggtaataggactgtcactcagacccatattttttctgaaaagcctcttttctttccattatccaacactgtctcaaaagaagaatatttttctagatatgatctgactaatgcagagcagagcagagatatgactaacttttagttcccatttatataaagcttatatactatttttgaaaacttaggattcaggataatcctaatggcgttatagcgttcctaaagatcctgttgcgtttaagtagacatctacaaaaacttcagtaaaactatgtagatgtaacattattttggcttagaatagttatttttgtatgaacacatctcacaagtagaattatcattcttactggtatacttttaggataatggatatccaatagaattctgatattcctcccatgtgattggtctactgaatactgatagccaaagggaattttgaggagaaataatagtcagatgaggaaaggaacctatgagatcagactgatgttataaaatgtttgtaagaaaatgtcaacactttctaattttaataatgctgtataatgaagagagaacacaggacacagatccacaatctgttacatagaattccaaaacccaaaaggttatttttgaaatgttgttcacaacctaacctcactgcaatggcagaatgctgtttatagtctttatcccacttcatgtgagtattcatatgttttgctgtgaaaatatcaatgtgtttgattacaggatgatgcttcagactccactggagctgttatgtaattatgtatatatgttctgtattactgtattactttcattttttttaaaaaatatgaatttggaatcccgtctggttccaaggattttagataagtgattgttgacctacattaatttatgtgaagtgattatgtatgtacgtagcttatggtattttgaacacatcagccttgatctttatgagtaccaaagggatgagataccaagtgtgtagaagttaacacagaattagatagacgattgcctcaaaaaccaatgtgtataagttaggttgaaactatatcgtgtcatttgcttggtagaaatatgaattctaattagtttagaatttatttttagtgttctcaagcacatgcatttttcctgttgaaattcaaattttagaaaagaagtgaaggctaaagtttgaaattacaggaaagagtaatcatatagatgagcttaaggcatgtatgtttatttaggacatgcttagtcaaaagagtataggagatgatctgattgtgtcttttattctcttctgaaatataagatagttgtgattctcatgaaccaacttcttctgtagcttggtcgcaaagaaattgcattttgctcagcagttttgttttgttttgttttgtttttaaaaaagcaagtatcatcttgtaaaggcaacctaattttctctgatcacctaaaccactgtcatattatgctatttgtgcctgaaatttccctgaactttagaagaaaatattatttgacttctgcttgttaaatgcagtaactctaactcttctgagctagttttgatgttacaagatggcttatatgatagggcagttattagtgacaccaaaattattcagtaaaattttgccactataaagttaaaaatgtgtataaagctaggtattgaggtcatcattcttttcgttttagaaaatagatgtgatgggtcagtgaaagtcaagggagtctatacacgtaagagttcaaaggactgtagaactcattgcattcaaccctcttctaaattgaattccttatacagcttctttaacaaatagctattgtttgaacacgtctagtagaagtttactgtttcccaagcctatttaaatttagtgagacaaaattattagaaaattctaagtttatagaaattacactgcttataagttatatttcttgattatgactgccttccaggaccatcttaagcaagtctcttctcctgtgctacttgacgactcttttgatacatgaagacagctatcatggccctcctgagtcttgttttctctagagtaaatatcctctgttcattaactgtggcattaaatatcctctgttcattcatgtggcattacttcaactcttcaaactgtgaatttttaaaaatgttttagttcgtcaatatctgaattaagaaatcaatattctaggtatagcctgatcagtggagcagtactgccacctcccctacaatggctataatgttacttcgttaagtttaaattatgttttaactggaaatgtaagttcttcagagtagaaaaggaaaaaagctgaatatttaaaacttttttacagactcatgaagggaaaccccagatccataattataggtctttagggaagaaaccaactaaaacagttttgacaggagtttaagagggagcagaggtccataaatcaaacagctcaagccatcagaaggaaaagtgaaaggaggacaagtgtgcataattaatttaaccaaaagctgtgacgtgaactctttctctcagaaaatcagtgagactagtgttttaaaggatgaacttggttaacatatggagttttgttttttccttttatgacaaaggaagacaaagccagcactcatttacttagtttgggcacctctagttagagctagttttgtttgtttttttgttttttccttttgtgatcccagcttcttccacattgactctgccaggaaatcaattgcttctcgtgactcattcatgtttcaggtggaatttttatgactaataggcaagcaggctgtgacgtgattagttaaagctaggtcagatagatttcacactccattaatttataagcctttctcatatgactttaacttactgtttttccagaataagaaaattacaggaagagattaaaaaattagatatcagatctattgcacagaatggtgacttaataatgattgtatatttcagaactgccaagtagattttaaatgtttttactacaaaaaaaagataagtgtgtgaagtgatagatgttaattagcttgatttaatcattctacactgtaaacatgtatcaaaacattttgttgaacccagtaagtagatacaattattatttgtcaattaaaaataaaatttggctgggcacagtggctcatgcctgtagtctcagcactttgggaggccaaggtgggcagatcacttgaggtgaggagtttgagacagcctgggcaacatggtaaaaccctgtctccattaaaaatacaaaaactagccaggtatggttgcacgcgcagctgtagtcccagctactcgggaggctgagacacaagaatcacttgaacctggcagaggttgcagtgcgctgagatcgcaccactgcactccagcctgggcaacagaaggagactccgtctcaaaaacataaaataaaattttaaataattttatgtttattttattttatgtttatgtttattttatttaaaatttaaaaaattttaaataattagacattagctctaaagattgttccttggtataaaatgtaggattaaagcctacaaataatattggtatcattcaggaaattaaagtgtaaatcttttttgggaaaaattagtctttgtcttccaattaatgtttcttaaaaatctctgttggtcatagttcatacagttctcactatataagcttttatttggaaatagtattgcaagttgatacgagtctaataggacagactgatttggtcatgtaaagcctaaatgtctgacagactggtaacaattggttggcaaataaggtcagtaatggtttgacatgggaaagtcaattaactttatttttactcaacattcacaattcaattcaaacccaatctttcagttacagttgatcctgaattgagttgggcaagaacatatgcctagatccacacaaatttattctctagtggaatctgggaatgtctcctattcactcaacaaatgtttacgccatacctactgtatgtctactgtggtaggctcttgtgattcatcggttaaccaaagatcccatcctcttagaacttatattctaacaggtgagcaatagatacaataaataaattgcagctgggcgccgtggttcacgcctataatctcagcactttgggaggccgagacgggtggatcacttgaggtcaggagtttgggaccagcctggccaacgtggtgaaaccctgtctctactaaaaatacaaaaattagccaggcatggtgttgcacgcttgtaatcccacctactcaggaggctgaggcactagaatcactacaacccaggaggcagaggttgtagtgagccgagattggaccactgcactccagcctgggcaaaagagcaagactcagactcaaaaaaaaatctaaataaataaaaatgagtaaattgcatactatgttaaaaagcagtaaatgctgtggataaagtttatagagcagaataacagggaacaggagtactagggtgtgtgaagggaggttgcaattttaaacggtaaaattccagcagacttgaaggagattagagagataattaggtatgtaggtatctggggatgagcattccaagcaggtggaacaattggtgcaaagaacctaaggtgggagtatgcttggtgtgtttggggaacctcaaggaagagagtgtggcaggagtagagtataataggaaaaaaggtcagagaggaaaaatgggaggggcaccatcaggtcatgtaggatcttcatggatcaaaggactttggcttgtgttctcagtgaaatgagcagatgtgacagggttttcatgagatttcatccatatgacttaagtctttttggggtttttttttttttttttggagacagggtctcactgtgttgccgaggctggagtggagtggcatgatcatagctcactgcagcctcgacttcctgggctcaggcaaccctcccacctcaccctcccaagtagctgagactacaggtgtgtgccaccacgcctggcaaattttttaatatatttgtacgtagcaatagggttttgcctgggcctcccaaagtgctggaattgtaggtgtgagccacttatgtctttttttttttttttttttttttttgagacggagtctcgctctgttgcccaggctggagtgcagtggcacgatctcagctcactgcaagctccgactctgggttcacgccattctcctgcctcagtctcccgggagctgggactacaggcacctgccaccacacccagctaattttttgtatttttagtagagacagggtttcaccgtgttagccaggatggtctcgatctcctgaccttgtgatctgcccgtctcagcctcccaaagtgctgggattacacgtgtgagccaccgcgcccggccccaatttatctcttaataggactcttgtgactgttgttgagagtagactataagggggcctagataaaagcagtaacagaaactcaaattttgaagccttcttgtagactatggataacacatttggttaacaatgtgttattgttagggtctgactgctgagatttaaatcctgactctgttactattttagtaaatgacttctgtatcttcatttcctcatttgtaaaatgaaagtagtaatacctcacagagttgtgataattaaactcataatttaaatagtgccgggcagtgtaaacacataacaaaaattggttgttatcattgttagtgttctcatcctgtatttgtcaagcatgctaattctactaccatgatgtttaacgttctttcctttccatatgtacttaaaatattctagttcagaccgcagacagagcggcttgcctggactattatagccactaattgatttccttgcctcctgtccttctgtcccaatcttgcacaatactgttagattgtcacattatatccaagctctaaaaccttaatttctttcctcttgctttctacattatgtgcacattgagctcatggctctcgttcatgtaattccagctttcccttctccaacataagtacacagtactgcatgcctttcctcagactgtgggttctctcctgatcttgtctgcaatttgaaatacttttaatttcacctgaagtgctattgactatactttctacttcacttctcacatagtatttcccactgggtactgtaatcattcgtgtacttatctacttaggtttggaacattagatgcaagggattacatcccttagagcttcatgtttgtgttctactgtaactccatgccatgtagtaaatgttttaatactcattgaattgattttctttccattgtcattcttctctaggaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatggtaagagttggagttgtattttagttctctggttttgtaaaccagtgttcatctactagtttttatgttattcaatctagtgataagaagatagtcactattctggtatcccatggtacaactatgagtttaacttctatttgtaaagtgactgagaaggcgttttctgcccgtgttatgtatagatacgtgtcatctatatgacatgtaaatataccatattttataaatgtagtaaatagtttcttttttctttttattttaaaaatattcctatgtgtatatatccaagtgggatagaaggaaaaaggaaaggaacttaatgttaatttctacctcctgtgtaccaggtattatgctgagtgatttgcatgtattattgctatgttttaattctcgtaacaggcttgtgagataactatcagctcttttgttttatagatgaggaaagatatgtttagaaaggttaactcactcaaggtcagctattatgtagatgagtcaaaattcaaatacagatcttcttagctctgaactttcctactctccaggtcttgccacatgggtactcctgccattggagctgtctgtaactggctatttttatttgttgtaatttgtaggagttagtggtaatcaagaaatggtgttataatatgtacactttgtggcttttcagtgacatgtttctaattccagcctagtttatcatttctgctaaatgctttaaaactgtcttttcacatagtcccaaaatttgttatgtgccatgatacaagtattacttttagtattaatctaaagcaaacagtaaagactttaatttttaacctaaactatttgcaacaaggaaagcatgggggacgggggatatatatgtactactatatttgtataatacaaataaattgttgacagtaaatatgcctttaaacaaataagcagatcttattcttagatgttggaacattgacagttttcccccactttataagcgtttgtatcaccatctagtggaaaacaaaagaactgttaaaaatcctacacttaaataggagctaagttaaaatgtaaaatcatagatctaaaatgaatatccgttgaccttttagtttgctatcagacaggacatgaatcattaaagataatcactgcataatttacatcaggtttaaattcacaaataagaatatctagaaaacaattccatattaggaaagtcttttgtaaccaatataaatgcttctggtttatttcttctttgtatgaaagcagcatgtaactatttagaaatttaattcacttgctttaaccttgttctgatcattttttacttggaatctgaaatttggttttaagatgtacgataaccttgagccatacaaatgattttaaaataattttaaggccgggcacggtggctcacacctgtaatcccagcactttgggaggccaaggtgggtggatcacgaggtcaggagatcgagaccatcctggctaacatggtgaaaccctgtatgtactaaaaatataaaaaattagctgggcgtggtggcacacgcgtgcagtcccagctactcgagaggctgaagcaggagacttgcttgaaccctggaggtggaggttgcagtgagctgagatcatgccactgcactccagcctgggcaacagagcaagactccatctcaaaaataataataataataataattttaaatgctttaatgactaattagtcctgttctctaacttcccttgcttgcttattttaaggtttataatgctttttaatattactctcaagttataaatagtaaaaccatttcactttaccttgtccttattttggttttctttgaactaaatctttaaatattggagtgatttctgataaagcatgcttcagagtttccttcccgaaaatagaaactctaaaacaaagatcatggagataaatgatatagtatacattagattgattgatcatttgtttattgattgattatttgagatagggtctcactctgtcatccagggtggagtactgtggtgtgatctgtagcttactacagcctggaacttttaggctcaagagatcctcctgcctcagcctcccaaggtgctcagattacagtcatgagccactgtgcccagcccagtatacctttttaaattaacctgctgatttgtaacaaatataaaaagagaagtaacactaaaatgttactactctaggcaatttgggttagaagaagctgtctgttctagtcccctctctcccaatgtcttaacttaaacagctttgtttcttagtgaaattaaaggagcttacttcttagaatatgataattatgtcaataaaacagtacttatattggatttaaatacagataatacataaaaattttaaatatgaataaataaaaataatttgataatgcttttcatcatcattgtttattgtgtaatctcttatttttttctccccttagaaatgagaaaagtttccaagtcttcaactcatccacaacataatcctaatgaaaatgaaattctagtagctgacacttatgaccaaagtcaatctccaatggccagtaagcaagatactgagattactttacaagtttaaaattgtggttattggtgggtaacagtgacccacagtctaacttagacaatattttaaaggtattttccatataattttgtttatattactagtttactatctttttcatattggaaagtaatgttatcctattcatataaatatccctaatcatattaatataaattactaataattttaagtaaagaaggctttactgtgatttacttatttgttcaacaaatattgaagcatctgttgtataccaggcactgaataaaacaaagcccttgtcctcatggagcttatgatctagttgagggagaaataaaatttatgtcagatagaagcaagtgctctgaagaaaagtaaagcagggtaagaagggatattagaaagcctcacttgtaaagtgatgtttgcatagggactgagggagggaagtgagtcacgtggctatctgggagaagggcacccaggcagagaaattagcaagcccggaggctttgcagtgaagatgccatttggtttgtttgaggaacattaaggaaccctgtgtggctggagcagagtgagtaaaggggagattggtttggacaacaggaaaaatagagttaccatttactgagatggaagactgggagccgcaggtgtataggttggggcgggggtggttaaaattagaagtttggtttcggtaatattctgtttgaaatgcaaactcaacattcaggtagagtttggattcatgagtagatgtgagttagaatttagagaagttgaggatggagacacatatggaggtcatcagcaggtagatggcatctaagccatgaaactagatgagattaccaagcaagtgataatagatggggataagaagaagtccaagtattgagccttggggaacttcattatgtaaagtcatgattttcaacttttcttttgttgaacaacccccaccccagcatttttagacatttcccccctccccccagtcccttccctgctggaattttattactgcagatctactgtatatctgtttaggtgatacgtgtatgcatgtatgtctgtgctttatacatagtaaggttttttttgctcccccctgccccgaaccatttttcacccccttagagaaaatactgtagctgttgaggttgcgaaaatgagtaggaaccaacaaaacagagaaggagctgccaatgagataggaaaactaaaaatgatgtcctttaagccaagtggagagaggacgaagaggtgatcaactgtgtttaacaatgctaataagtcaagtaagatgaagacttcttagaattgaccatgagatttggttgcatgtagatcattgagtgttaaactagtaacatgataaaaattgttaaggtgtaatggtgaccatctgagatcggtctcatgttcaaaggaaactaaggacagagaaagtggaaagagcacacacaaacaagtactcccaagacattttgcagtaaagaggaggagagaacaggacagtggctaaagaagaacatgggtcaagggaggattttttttcaagatggaatattatagcatgatcggcatttatttatgttgataggatgatcaagtaaataggagaaaattaataattctggagaaagagggaacaattgctacatccttaaaaaggtcagaggagatgagatccagagcccagttgggagggttggtcaaggttaatcacttattcattttataatagtgtaaaagttacatactgaaagctacaaatcattttatattaacatgtgtgtctgtttgtctgtccatgagtatgtgtgcatgtgcatggaggctcagggtccagcaaagggtgctagggatacaacacagagggtggcagatccttgcttctcagctctctagaaccaattctgttctgctgctgccaggtctttgctccattatttgtcctatcttccttatacagtatctgcagcttctctgctggcttattcttaagtatatacacatatatgttatcttccatctttaaaaaataatcccccttttaataatctccacctttagctacagcttctcttcagaggtgaaaaagtattaatagtctatactcaatatctctactttactaattcccattcactccaactcactgtaatatggattctattccccaacccccacctgcaagagaggaggagagagcaagagagagggaagggggagggaaggaggaagggaggagagagaaaagtgctagaggagtggggtacaggggaaggtagggagggagacttacagggattgaagagaggagaatgcattcacaaaccctttcttactccttacactggaactgattctgactgtaaacgtcgtcagtgttgctcttctccaaaatatatggtactgtgcctgttctatttctgtctctctatttatttatttattttttgagacggggtctgtccctgtcacccaggctggagtgcagtggcacaaacacagctcactgcagcctcaacctcccaggctcaagtgatcctcccacctcagcccctcaagaagctgagactacaggcacacaccaccatgtctggctgatatttgtatttttgtagaacagtgtttcaccatgttgccaaggctggtcttgctctcctagtctcaagcaggctccacctgcttcagcctgccaaagtgttgggattacaggcgtgaaccactgtacccggcttcactttctctctcttcctggaggaatgtcacctgcagtcagtagtcttctctgactcatacactaataaatcccaaacctgtatctctgtccgacttttttcctggtttcccaaccaatgtatctacctgctgttggatacctctacagggatatccttcaacttcagcatgtctacagttgacagttaacctgtcaaaccaactcttcatccttgcatttgcaatctcagtgaatgacactatacatgcctctttgagtcatcctagatttctgcttcatctgtttttgctaaacagcctctaagtcttactgattccacctcctgcatatctgttttacatattcttctgtgcccctattatactagtttaggctactagcatctctcatcaagacaacatgttctagtaatctaattagtcctcttgcctattagtgattgcttcttgcctaatgagtgtgtcacagccactaataccttttcagcccacacattgcatttgttttatttaaaactcttagatatctcttcattgtctacaggataaatttgaaactccttagcataacctgacccctaaccaacctaactgggttcatgtcctactcccatcttctgtagtttgacttctagcagtcaaaccacgcgtagttccctgaacaagcaattttgtttcactttctagacccttaattatacctagaattctactttctgtccccagtccagttaacttgccatattcttccttctctcgagtcagcttaggcatcacttgtaactttccttgatttcccagaagagatttaggagtccttattctgtgtttaaatcaccccttttatgtacctttattataatgtttatcacattctattgcagttctctttttacctttcaactatataagctccttgagaacaagaactttttcttttcatctactgcttagcacaatacctggaacataataagtgctccataaatatttgagttaacctttataaaatactagaacataggtgatttatgaatatgtgttagcttaacctgaaacatgcagtgctgacaacctctcctacaaagtatgttttcatgaaagagagcgtaaatatagtttgatattcatgctgtaacataagtcacaataattccactgtaaatccattttaagatttttttccccagtggcaataagaaaaattatctacctattgcattcagttcatttaggaaaaacataaaatttacttgaaaaattttagcacgcatagacctgcaacttattgccatttatggtaggtattttggactttttgcacagaattttaaaatgtgtctagtgccatcttatgaagtgtgagccttttccttcatcttttgtcattttaatgtgtctagcttctacagttttgtaaaattggttttattatttattaaaatggtttattatttattcttagaagcacatggaacaagcagctatacccctgataagtcatcttttaatttagctacagttgttgctgaaacacttggacttggtgttcaagaagaatctgtaagtaattgtttagtttggcaataacatgaattaattttatgtctttttaggtcagttcttagagaattaagcaagagaattgttctatctaaagatcttgggtaaaggcctgaaacaaaacttacattgttagaaagtcctatttctgttgtccagcccagcagtctcagaaatgtagaatctagaattcttgggatatgggttgagtcaaaatttaggggagtaattatggcatagagattttgtcaactttcttcccttccccctctctcatgccccctccctgccctcatctaagagaagacctaaaccttcaggttgatttcagaattgttgttttgttttgttttgttttttagagataggatctcattgtgttgcccagggtggagtgcagtggctattcacagacacagtcatggagccctatagcttcaaactcctggcctcaagtgatcctcccatctcagcctcccaaatagctgggactacagacatataccattatgcctagctaattttttttgtagagatgggggtctcaactgtgttgcccaggctgatctcaaacacttggcctcaagagatcctcctgcttcagcctctcaaagtgttgagattacaggtgtgagtcaccacatccagctgtactcttattaagttgtcttgctgttgaatttctaaaaattgaattagtttttcattacatatagatttttttgtcctttctagttttaaattcattcttaaatgataatgggtagtttttaacctttgaactttgaatgtgttttaatagtttctaattcccccctacccataaacctggcaagtcacagcttagacaccaaatagattaagggagctgaaatctaatgacttgctgcttgacgtgtgatccatgggccaatagcatctgcatcagttttgaagtttggtagagatgcagaatctcagacctactgaacttgcattgtaacaaaatctccagttgacttgtatgcatgttaaagattgagaagcactgttctctaaaggattattttaaattcatctcctatcagtatgaatagttatctctattcccttcccctcatcttaatgttgttttttggaattggagttttatatacaaggagtagaatatacttgtgtaaaacattgaggcttttctctttaaacttaaaaagtgcttcatatttttcattgtggtgaaattaacataacataaattaattattttgaagtgtacaactcagtgatatttagtacattcataatattatgcagctatcacttctatccagttccaaagcatttttatcaccttcaaagaaaacctcatacccattaatcatgtatccccattctcctcccctcattcttccacctcccacttgcatcctctggcaacttccaatctgctttctgtccctagagatttacctattctgaatatttcatataaatggaatcatacattatgtggcctttgtctggcttcttagtatatttttgaggttcatctacatcataacatatatcagtacttcatccctttttaagaatgaacaaatcccattacatggatgtgcttcatattttactcttgaaggaaactcaaggtcccatgagcccccttggtgatgagctctaccactgtctggaaggaaatcacaagaaacagccttttgaggaatctacaagaaatactgaagatagtttaaggtaattaagggcacgttggtgaaaactgataagctattggtgagatcccattacaatgaatttcatataattaagccatttctctccttcaacatatagtttgttattgtggttatataaatgtttactttaaaaattgtctccctagtttctgaccaattgagagcttttttgcattacagtagaaaggtggatatcatttttagctactttctgtgtttctgtcaagcagtacttgttcccagtacttgtcactctgctcctttaaagagccagtcatcccttcggggtttatatttcccaaaactggatgttctacaaaatgcatctagaagcttggatgagcttccaagattgtgttgcatctcatttttactaatttcagaatacctattaactaataatacagccattccgtgatatcagtgggggattagttataggaccccctcccccatgggtaccaaaatccaaagatgctcaagtccgttacataaaatggccatcattattgcatataacctgtgcatatcctcctgtatattttatgtaatttccagattatttataatacctaatacaatgcctacatatcaatccatttgcaaagattcaacatagtacttggcacatggaaaattcaagttttgccttttggaatgttgtgaaatttggattttttacccaaattattttctagccacatggctgaatctacagatgcagaacccacagataaggagggccactgtacctgtatttatatagcattttgctttttaaaagagctttcagtttttagatatatagatatctatctatctatatatgtatatcacagtctgtcatcttagtaactgattaaagtagattttgttaccctaatttttgggtttattttacagattacaaaaatacagctccagaaaggttaaatgtcttgtttcaggccacatagctattaagtggtagagccagagatcttacccagcccacatcttcaaacttactgctctttctacgcatatttcctctgctagagacaggctgaatcttaatttatgttcaattctgtagtgtaagaattttgtttcttggagttactcatgatcaaatgtcgtaacaaaagaacttaggttctcagtggaatttattaaaatatgatttttgtttgtttgtttcttgagacagagtctcactctgtcacccaggcttagctcactgcaacctccacctcccaggttcaagtgattctcgtgccttagccaccagagtagctgggattactggcgtgtgccaccacacccggctaatttttgtatttttagtagagatggggtttcaccatgttagccaggctggcctcgaacttctggcctcaagtgatctgcccaccttggcctcccaaagtgctgggattacaggcatgagccactgcgcctggcaaaagatgattttttgtataataaagttatttaaagtacttaggaaaaatttttaaaatatgaatattatggtgttgagaaatacttcctatgtcattttcctctgcttttccccttctcttttgtcatctaaatgaagagaagccaaaagctgtaccttgtcttaaattttggttaatcatttgcttctaagaggtagataagaccttactattaattctgtattaaagaattgttatcactctttatttagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaaggtttgtgttaaatgttcaaggattttgattaaaatgattgcttgtgatttcatttagagctaacaattatttctgttttagagtgctggttctcatgagccaataaaaatacaaaccaggtcagaccatggaggatgtgaacttgcatcagttcttcagttaaatccatgtagaactggtaaaataaagtctctacaaaacaaccaaggtgtgtacaccataaacaggatctccacttttttaatgacttcagattgaatgtcattatttacttttttaaatagattgaattgttttggaaaaaaacttatttcttccttcaggtgtctgtatttataggacgattctcacattttaccggtgatttttctgttcttttttttttttttttttttttttgagacggagtctcgctctgtcgcccaggctggagtgcagtggcgcgatctcggctcactgcaagctccgcctcccgggttcacaccattctcctgcctcagcctcccgagtagctgggactataggcgcccaccatgcccggctaattttttttttttgtatttttagtagagacggggtttcaccacattagccaggatggtctagatctcctgacatcgtgatccaccagcgtcggcctcccaaagtgctgggattacaggcgtgagtcactgcgcccggccacttatatacgtttttaaactcctttaaaaacattgttggcccggtacggtggctcacacctgtaatcccagcactttgggaggccgacgctggtggatcacgatgtcaggagatcgagaccatcctggctaacgtggtgaaaccccatctctactaaaaacacaaaaaataagccaggcatggtggcaggcgcctgtagtcccagctattcgggaggctgaggcaggagaatggtgtgaacccgggaggtggagcttgcagtgagccgagatcgtgccactgcactgcactccagcctgggtgacagagcaagactccgtctcaaaaaaaaaaaagaaaaaaaaaattgtttgccttaagatatataggcatcttttcataattttgctatattttattattattattattattatttgagacagggtcctactctgtcacccagactggagtgcagtggcatgatcacggctcacttgcagccttgacctcccaggctcaggtggatcctcccatctcagccccctggatagctgggactacaagcatgcaccaccacacccagctgatttttttattttttgaagtgactgggtttcgccttgttgcccaggttggtctcgaactactggactcaagccatctgcctgccttggcctcccaaagtgctgggattacaggtgtgaaccacccacgcccagcctgctatctttaaaaaagtaattttttttttcagccaccaaacatttctgtagttcaagtgcagtattttttcttgtattcttcattggcaagttattcctttattctgggtttattttccctttttcctgaagcacagtcattagttgtttttccagtgagtgttttagtctctatatgaaaacatttttttcactatcattcatgattttttttgagctttttgtttttatttttttcatggttgctctagggattacagtatctacctacttagccttttacaatctacttggagttaatgtactatttcatgttctgtaactacactttatgtagttcctgtgtattttatctacatatattgaaaaccccatcaatgttatagtttttaattttaaaaaattttaattgaaatataaatcacataccataaaaatcacccattaaaatgttcaattcagtggtttggtatacccacagagttgtacaaccatcactgtagtctaggtttacaacattttcatcactttccttccccatataccctctgcagtcctaggcaccttaaatctactttctctctttgtagatttgcctattctgggagttttcatataaatggaatcgtttaatatatgatcttttgttacttctttcacttggcataatgttttcagttatctgtgttacagcatatatcaatattttatttctttttattggataattttttattgcataagtataccatattttaggtatttattagctgacattcaagttgtcacttttttgctattatgaacaatgctgctatgaacatttgtatacaggtttttgtgtggatgtatgttttcatttttcttggattatacctaggagtggaattgttgggccatatgccaattctacattttaccttttgaaagactgcctgttttccaaagcagctacaccatttcacattcccaccagcagtatgtgagggtcccagtatctccacctcctcactagcacttgttatagctttttgatttttgccatctcgtggttttggtttgcatttccttgactgctgatgatgttgagcatcctttcatgtttattggcaatttgtatatcttctttggagaactgtctatttagatcctttgcccatctttaattgggatatttgtctttttattatggagctgtgagagttctttatatatcttagatataagtcctttaccagacatatgatttgcaaaaattttctattctttaggtcccataatattttaaagtgatgagaatttttgaaatcagttttttaattgcatgctctttccctttacctaagatgtatcctttgaaaatatccagtggagtatagatccgggagcagacctttctcagtataaaatggatgttactgtaatagatacaaaggtaagttaaaaagtaaaaccaaaactcatttgacttttattccaatgagttgttagtcaacctcctctcgtgactcactgtatcaccttaagataatcagatacgtcttaaaacctacatgtatttatgcagaaaattaagaaataaaaatgcttattcttctaactttatggtattttttaaagggtaatactttctgactttaaaggcctttactgaaaaatattaatatagtttttaaaagaatgcagtgggcaggcgcagtggctcatgcctgtaatcccaacactctgggaggtcgaagagagagaatcacttgaagccaggaattcgagaccagcctgggcaatatagcaaggccctgtctctataggaaattttaaagttagctgggcatggcagtgcatacctgtagtcctagctacttgggaggctgaggttgggaggataccttgaacccaggaattcgaggctgcagtgaggtatgatcacaccactgcacatccagcctaggcaaccagagcaagaccctgtctcataaattaaaataatgcaaaatgctgcatatcttatataattttatcattcattaaaataattcatcatgtcttcattacctttaaaataatgtaccataaaattcattttccaagttgactatttttaaaagttaaaattcatagtggaaatagttttttgtcttgtatttagcttctgtgtagtttcagaagttctctttcacttggtagcatattaataacaaagtatttaacatacgctgagtaatatatgcctatcaagaaatttaatttaatttttgaaagtgttcttagtgtacattgatgttcattactataaggcaaattggaaaataaaggcaggaaaagttcaggggtgtttagtggtaaataattctccctttccttggcagcagtccttcttttcctaggcttgattatattgaagctaaaatgttttataagcagtaaaacctaaatccttacctgttcgtaaagtataaaagcaaatatagcttaatgcttaaaagttgtaaaatgtatgttatgtatattttaccaaaatgttttgtaaaaattaaatataagaccataaaggaataattgttaaaatttttgatttttaaaatatttatttaggatggcagtcagtcaaaattaggaggagagacagtggacatggactgtacattggttagtgaaaccgttctcttaaaaatgaagaagcaagagcagaagggagaaaaaagttcaagtaagatctgtttttgttttgttattttttttaataacgttgtgtgaagtttgtagttgtaccattgcactgattagctcaagtgacctcttcaccataaagcaggttttttcctgctctgttaactttatgttcctcttaggaaagctcagtttcagtgcgtcagaaaaaaagtctttaaccaaactaatttcatttcagaaaagattcatatggcttccagggatttgcaaatgacagccagctaccagttttgtaaataaagttctaccagagcacagccttattcatttctttatgtattgcccatcgctgtttgttccatacagctgcagagttgagtagttgatgcagagaccttatagccccacaagcctaaaatagttattttctgaccctttaagaaaaagtttgctgatccctggtgtagacaattttttataagtggtataacagtaagtcttgagtcctgtgttagaattaacgttttctaaagaaatttgataaggaaagaaaggagaaatctaccgagaagtcttagtatagttttacaggttaacattcagaatgatagtgtatatgctgagttaatctgctgtattccacctctactgataaggcaatttggccaaattagtggtctacagccctttgtagtgagaaactattaattctttacccaaagtcttgattttccggaagagatgagaacaataggaggattttggttagcagtaccttagcaacattcctaactgtagaggcacatgacatgagaacagctagactatgaacagttgtcatttatcatccttatgtattgaagagcgagggcctgccacatggggaagcagtgctaaaagcagagacattccccagtgatcatttgttagaagccgaatacattgaggctgggtgtgcattccttatcttctgctgaattttctatagtctacctgctcagagcaaaaaataaaatagtcttgccctggcttcttttgaatctacttatctactgctgccttaaatgcagtaaatcaaagaaaactttagtagtctttgccttatttgttcttcaatgacaaatagcaaaccatatgatgaagcagatggttacctgggtagagaagccaatacctattaaaagaaaaaaccttcacagtagtttattgccattttatggcttgtatgacactaaataactcttcttaagaggatactttgcttttaagattattttgttcctgatactagcctctgatcatgtttttctcatttttgtagaaaagagaaaatctaaagtatgaccactttaaatctattcagaagacaatagtttctcaaatttatttgatgcaagtatcatgtgaaagagaaattagcacttggactaatgaggggaaattatagagataattttggctaataaagtgctatggatagtattgctacataatgaatgaatcacttgaataactcagaggattcaaacaataccattttcttatcttcatagttcctgtggctcaggaattcaggaaaggcttggctggtcagttctgtttcagggtctcatgcagttgtaggcagatggtggctggaactgaaacagcagagggctgggcagctggagagtgaattggcatctcctcatttactctcagggcttattcacttaggctcatttgagcttcctcttcacatggaggataagttcccagagttggcaccccaacagaacaaagcagaagcaggtgacatttttatgacctcagaggtaacatagtgtcacaaagatctgcacaggcataaagcgaaatgaacaggccctcagtgacactcagtgggaggagtgttgacatcatgttgtaagaaccgcacatggaataggagacattagtgaggttatattaaaaaaaaaaaaaattaccccataaggtaaaacttttccagcacttagaattggtttaaaatgaaatataccaataaaaattccatattactgccagtatttcaattcagaaaattttcatgcacctactctgttagattttctaggtgctgtgacagaaagatcaacaaggatatactctctgtcttcaggtatttcgcaatcacaaatcaaacaaaaataaatcatcaatttaacattttgctttacaaacagcatacacagaatgttccgaggatgcctagcacaatgcctggtgcatagaagttgtattttatttacatatttgaccttcagcatgcagaataaatgtttaattatcaataaatatcaagcaaaaattttgtagtaggaagtattttaggaactagagataatgaataaacagaacaaaagtacttaccttatggaacgtacattctaatgagagaaataagcaattgtatatataatagatgatggtaagtccaggagaaaggtaaagcaaggtaagagtgagagagtgctgtgcgttgggagaggtggtacttatatagaataatcttaggcctcttttctgtcatatttgttagccaactggatttaaactctagtgttttttaaatgtgattatataatgggaaatgtggttagatctgtgaagatgaatttttcattttccgtgtcaaatatggcattgaattcctaatttctagtaatactaaactaccagatgctaatgaagatgaaagaaaatacttttttgctacttcattacaaaaagtaagcatgaaaggtcgagcacagtgactcgcacctgtaatcccagtattttgggaggcctaggtgggcggatcacttgaggtcaggagtttgagaccagcctggccaacacggtgaaaccccatctctactaaaaatacaaacattagccgggtatggtggcgcacacctctaattccagctacttgggaggctgaagcagaaggattgcttgaacccaggaggcgaggttgcagtgagccaatatcgcctcactgcactccagcccgggtgacagagcaagactccgtctcaaaaaaaaaaaaaaagcatgagtaaagaacatttaaagccataacataaagcctttgtaaatgtacagtaactacccagagttgggagtttattcttacctcatacacagattacaagaattaaacctcattataagaatcatgatttaagaagtgtctttaaacacttcattacatacgttacagtttgctactcactgagagtaactgaattaacactcagccttacagcttgcaactaatattcttagaatcatgttagcatgtgtccacaaacacttcactacatgcattacatctgttcaccaaaagaacactcttcacagctaggcctgcagccctcatcataataatcatgcctttaaacactttattacatacattatagtttgttactcacttatattcactgaatttaacactcttaacaagacagcttgcaagtaacattcttagaactatcttttacatacgtgtctacaagcctttcactacctatattacatctattcactgaaagaatactctgcaaagtaaggcctgtaatccacatttttttaaaacattttttaaactatcaaatttttattttaggtttgtgggtacataagaaggtttgtaacatagataaacacgtgtcatgggaatttgttgcacatattattacattacacagttactaagctcagtacccaatatataatccatattttaacaaccgtattttaagaagtgtctttaaggactgcattctgttattgtgtggtagttactacagtttcatgatggtctacatattaagcaaaagcttgcttattgccctaagccagtgctcttttacatagatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacagtaagatttttttctgtttaattatggcttctcagttgcagaattcagtaagttaagttatcaagctaattaacaaaggcttgatgacatatcaacaattgaagtttcatatttcttgtataaattttttcaggtttttaaaattttgagataattttacactgataagagttccagaaaatttttcagcattctcctgtacctttgacccaacctctccttatgttaatgtgttatatagctataaaatatttattagaactaagaaactaagattagtttggtattacaaatttctttctaaatacgcataaaattgataaaatttttgagaaatgtctattaattattaaattaattgtaatagagtagaaggagaaagttttgtacaacattcagatccagccaggcacagtggttcacacctgtaatcccagcactttggaaggccaaggcagacagattgcttgagctcaggagagttcaagaccagcctgggcaatgtgataaaacctcatttctacaaaaattagctcggcatgatggcacatacctgtagtcccagctacttgggggctggagcgagaagatcgcttgaacacccaggaggtcgtggctgcatcagtgaaccgctgactgtacttcagcctgggcgacagagtgagaccctgtctcaaaaaaataataattaattaattaaattcaaaaaaggaaaattcagatctgttttctgctgtgaatgctttatcttaccagacaaaatacctaatgtaactatgtgtattagtcttaatatctctttcattagaagcagtaactttataatgtaggatagcaatcagaaaaagaatactctaattgaaaatctaagtagataatctggattgaaaattgtaatttttgttaaatctctcatttttctccttgttttattaaattggtccgaatttttaatctagtgcaaagattgttttatgctggtttaaatgaacataccttctactgtggcacaatcttgattatgctcatgtttccatcaggtttttgaaacaacagcccttaactcaaaagtgagtgagacccaaaccaaagatagaggacagtaggcttttgcttgcttagtccatggcaaaaactccatcaagtaaattttgaaataaaaattcacagctgttcggtatcctttttccccccaagaaggaccttttgcaaataggtttcatttcaaagaaaaagactatttttcgcaaaggtgtacttattctgttccttcttttaagttacatttgacactgactatcccagaatttcttctcacttagcttttctgacgatgctgcctcgttcttttcatttgtcacagcttgtttcctagaatatccccaagactctttcttcctcacaacttttctctcacaacttttatcagccttacctctgaaaatgattccaaatctgcatctctaggtttgatttctctgatgaatcccagtcttgcatttctgagtactgtgagatacttttgcgtctcttcagcttaaacgtaatgtctaagccaatttccatttacttccaaccaaataatcttcaaacgtttttatttttcccagtcacccaggcatataatttaggatttgttacatatttattttattttctcaacccagttactaccttgtatgtgctttctcacataacccttagctgtctacctgcttaatgtttaactctctgcttgcttaatgtctattttcttcactgtaatgtaaactccatgaagacaggagacctgctctctcgttacacattgtatgtctggaacttagcacaatgctcagtaaattttgattctttgaatagatgctagcgtttagctatttgagtctagacatcttaggagtcaagtcccaagttctgagctctaggttttaatctttgtcaccaattttctgataaaatctttaatctgtttattccctagttataacttaccttaaagatgcattgtaaaaatcaacaggattggtgacaatgtaaattagtatagccattttagaaaatgatatgaagattcctcagaaaactaaaaatggccaaggcgggcggatcacgaggtcaggagatcgagaccatcctggctaacacgctgaaaccccgtctcctgaaaatacaaaaaaattaaccgggcatggtggcaggtgcctgtagtcccagctactcgggaggctcaggcaggagaatagcgtgaacccgggaggtggaacttgcagtgagccaagatcacgccactgtgctccagcctgggcaacagcgcaagaccccgtctcaaaaaaaaaaaaaaaaaaaaaaaaaaactaaaaatggaactgtcatagatccagcagtcccactactgggtgtatatccaaaggaaaggaaatcagtatgttaaagaggtatctgcactcacgtttattgcagcactgttcagaatagccaagatacggaatcagcctaagtgtctacttacagataaagaaaatgatatatagctagataggtgtatatatatatatacacacacacacacatatacatagacacacaaaaatactatttaaccactaaaaagaacaaaattctgtcatttgtgcaaacatcgatgagcttggagaacatcatattaagtgaaataagccaggcacagaaagataaataccacatgttcttattcatatgtggaatctaaaaaagttgatctcatagaagtagagagtagaatagcagttactagaggtggggaaggctgggatagccaaaggtgggttaattggtataaaaatatagctagccaagcaaggtggcaggcacccatagtcccagctacccaagaggctgaggcaggaggatagcttgagccttggagttcttggagtagtgctgtattggagttctgaggtatgatccatattaagtttggcatcaatatggtgacctcttagaagcaggagaccactaagttgctcaaggagcagtgaactggcccacttcaaaaatggagcaggtcaaaacttgcatgctgatcagtagtggtgcggtgcctatgaattgcccctgccctccagcctgggcaacatagcaacacctgatctctaagaaaaataaataagggagccgggcacagtggcttacgcctgtaatcccaacactttgggaggccgaggcaggcggatcacaaagtcaggagatcgagaccatcctggctaacacagtgaaaccccgtctctactaaagatacaaaacattagccgggtgtggtggcgtgcgcctagtagtcccagctacttgggaggctgaggcaagagaatctcttgaacctgggaggcagaagttgcagtgagcctagatcatgccactgcactccaacctaggcaacagagcaagactccatctcaagaaaacaaagaaaaataaaaagctaaatagaaggaataaattgtagtgttcaatagcactatatggtgactataattaacaacaatatatgttctcagatagctaaaagcacagattttgaatgttcccaacacaaagaaatgacaaatgtttgaggtgacagatatgctaattaccctaatttggtctttacacattgtgtacatatatcagagtatcacactgtataaagatgtatacttatgtgtaaattttttttatttttttgagacggagtcttgctctgttgccaggctggagtgcagtggcacaatctcagctcactgcaacctccaactccctggttcaagagattctcctgcctcagcctcccgagtagctgggattacaggcatgtgccaccatgcccagctaatttttgtattttgagtagagacagggtttcaccatgttggccaggctgatctcaaactcctgacctcaggtgatccacccacctcggcctcccaaagtgctgagattacaggtgtgagccaccacacccggccaaaattaatattgaaagctgtcttttgttgttctttcttgtcaaatgataatagtgggcatctgagtatttcttttatactctaaaatacttcctgagataatgacttttagctgtctagtaattttgagttgaatgaaacagcaccctcctcattatgcagatgcaaaagaaagaaaaaagtagttgcagaggcagggtgcagtggctcacgcctgtaatcccagcactttgggaggccgaggcgggcggatcatgaggtcaggagattgagaccatcctggctaacatggtgaaaccctgtctctactaaaaatacaaaagattagcccggcatggtggtgggcgcctgtagtcccaactactcaggaggctgaggcaagaggatggcgtgaacccgggaggtggagcttgcagtgagcagagattgtgccactgcactccagcctaagcaacagagcaagacaccggctcagaaaaaaaaaaaaatagttacaaagttgcagaaaatttaaatgagttgctcagaggcctggagcatgaaacccaataaaaatggaagtttgagtgcgtgtcattttcttccaagctagttaattatttctcattaagttctacatttagtttgtaatgtgcatgttttatttatagctcatggtgataaacaagacaaagtcaagcagaaagcgtttgtggagccgtattttaaaggtgatgaaaggtaagttggtttttatttataccagcaatgtgactggaagtacaatagagctgtcttttatttctctctcttttttctttttttttaaagacagagtcttgctctgtcacccaggctagagtgcaatggcgtaaactcagctcactgcaacctctgcctcctaggctcaagcaatactcccacctcagcctcctgagtatctgggactacaggcacatactaccacacctggctaacttttttattttttgtagagacagggtttcaccacgttgccaaggctaatcttgaactcctgggctcaagccatccatctgcctcggcctctcaaagtgctgggattacaggcttgagccaccacacctggccagtcgagctgtctttgtcagagtatctctaaactgttaaattgctactttggttaaattaaaattatttactttatggtcataaaaaagagactcaagcataaaaacgacaaattttacaaataaggaaatttttggcaccatcacctttttttggcagtggtaatagttattttctctgcttttgtgtgtgtgcgtgtgcatgtgtgtgtgtgtatttcttttttttttttttttggagacagagtttcactctgttgccccggctggagtacagtggcgcaatctcggctcactgcaacctctgtctcctgggttcaagttattctcctgcccccgcctcccgagtagctgggattacaggtgcccaccaccaggcctggataatttgtgtatttttattagagatgggatttcaccatgttggccaggctggtctcgaactcctgacctcaggtgatccacccgcctcagcctcccaaactgctgggattacaggcatgagccaccacacccagcctgtctgttttattattttttttaaatgtctttttattctatcttttcaacttggggcatttattaaattgtataagttttatgtagtataagactttaggtaggccaggcatggtggctcacgcttgtaatcccagcactttgggaggcccaggcggggggatcaaaaggtcaggaaattgagaccatcctggataacatggtgaaaccccgtctctactaaaaatacaaaaaattagccaggtgtggtggcaggcacctgtagtcaccgctactcaggaggcaggagaatggcgtgaactcgggaggtggagcttgcagtgtgccgagatcgcgccactgcactccagcctgggcaacagagcgagactccgtctcagaaaaaaaaaaaaaaaagactttaggtagtaagacttaggtttattatgcttcagaattattttataaggatttttgaatctttaaaaacaaaacctttaagcatgttttgtttttttggtttttttttttgaaatggagtttcgctctggttgcccaggctggagtgcaatggcatgatcttggctcactgcaacctctgcctcctgggttcaagcaattctccttcatcagcctcgcgagtagctgggattacaggtgcccaccacaacacctggctaattttttgtatttttagtagagacagggtttcaccatgttagccaatatggtctcgatctcctgacctcgtgatccacccgcctcggcctcccaaagtgctgggattacaggcgtgaaccaccacgcctggcgctaagcatcttgatttaaccataatgcgaccttctgcctttcacaaggactgcaaattctgttacttatagtcacctactatttgttcttaaagcaaattgaagacatagtaattcattcaaaaaaaattgttatttttttctttaagatgttggtaaattgagttactcagtaaagttactccttttatttttatttctgttgagaattttagaaatctaacaggccaagattttttttattcctctgaaactcttaaagagctgtcattttgtttaatgcttaattcttcttttttagttaccagttttccaaacaaatggtactctagcattccaaatgtgactaggttgttttttgtttaggtgtcattatatactcatcaatttaagtatatttgatgtgttgtaatccattgcagtcattatccttagagatacccagattgtcccatctttgcctaaaggaaaaggaagcttctttcataggtttcttgcttctgttatctggaatctgccatttttcttggagccctagttccttttagtgagaaatggtgtttaggccacagtctggctgctagggttgcactttagtcattgtttctcagccttttaggtggacagagttaggaaaaagattttttgtatgactttgattttttttttttttttttttttgagacagagtctcactctgtcacccaggctggagtgcagtggcacaatctcggctcactgcaagctctgcctcctgggttcacgccattctcctgcctcagcctcctgagtagctgggactacaggcgcccaccaccacacctggctaattttttgtatttttagtagagacagggtttcaccgtgttagccaggatggtctcgatctcctgacctcgtgatccacccgcttcggcctcccaaagtgctgggattacaggcgtgagccacctcacccggccatatcactttgattttttaaggtaaactatacttcatactgatcgctctaactcaaattcaggaccacaggatatttatgtaaactcctctatcttacatctttatttactttcccacctactgaaaatcccacttctcagtgccaccaacataattccttaatttattttattccacaatacacataaagcagtttcagaataataccaccaataatataattaatgaaaattgtttgaaaactttttgtatgctcttttgtccttaaaatatattctattagaaatgtacagtaaaatcactgcgttttttttttaaagtcatttgggataattattttttgcagttatgccaccaactcagtaccttattttgcttttgattttttaggaattgggtttttttcttttcatatttaattcttttaaaagtacataaagtataatgtattttatatatatatatataaaatgtatataatggacacaaagtatgtacattgtaccagactacaagtatattcagataaatctcacgtctattcttggcctctatatcttatagctccctatccctataggtaatcatttgtttaaaatttatgatttttcttctatcctaaaaaatagaagcaaatacatgtatatagtcatgctatccatgactcatatagaatattatatatactttgctctactttgcttttttagacggagtcttgctctgtcaccaggctagggtgcaggggcgccatctcagctcactgcaacctccacctcctgggttcaagcgattctcctgcctcagcctcccgagtagctaggactacaggcatgcgccaccacgcgcagctaatttttgtatttttagtggagatggggtttcaccatgttggccaggatggtctcgatctcttgaccttgtgatctgcctgccttggcctcccaaagtgctgggattacaggcatgagccactgcacctggcctgctttttttatttaactatagatcctggaaatcactcaagttgtatatagcgatattcctcatttctttttagctccatagtacttcattatgtgaccctactgtagtttataccctagcagtggacacttgggttgttgacagttatgcctagtgcacacagtgctgcagtgaataaccttgcacattctcttttcatatttttgcctgtagatcattgagatagattcctagaagtaggactgcagagtaacaactgtcattttccaggtggctcatgcctgtaatcccagcacttcaagaggctttggcggaagaatcgcttgagcccaggagtttgagaccagcctgggcaacacagtgagacctcgtctctacaaaaattaaaaattagctaggtgtgatggtgtgtgcctatagtcccaactactcaggaagctttgagaagatcgcttgagcccaggaagtcaaggctgcagtaagctatgatcacaccactgcactccagcctgggccaacagagtgagaccctgtctccaaaaaaaaaaagaactgtcattttaaatgtttcatgttaaaggttcactagttttttagaaaatatgtatgagtagttttatttattctgaagcaattagatagctggagaacaagaggtgaatggaagtgtggggatggaggcatggagatgctagaattctcagagttacattgttgctttttccactgagaatactaagactgcaaacctgggaagatggattgtgtagtatcagggacaagaagcttgtttaagtgatgctttgaggtctactacagatgctgttctgctaggagattccctacgtcacgataagacactatagaagtggagtagttaatattcagaagaaaggatatggccaaaatgtgatctgcataatcttaggagtccataaactctttgaaagaaaatatagttgtggcaatattttttgtgtgtacttttctggtttcccttttctaattcacagatcacaccagagctgagggttcttgagttgaaacaaaaaaggacttatacttagagtgactaaaacttttctttttgagggaaagtgcttgccaactagaggggcatgtatgtgatctttttattacacttctatttaaggtatactttctgtttcatggtgctttattgcactttgcagatactgttttttacaaattgaaggtatgtggcaaccctgtttgaacaaatctgtcagcggcatttttccaacaacatgtgcttacttcatgtttctgtgtcacattttagtaattctcacaatatttcaaactttttcattattatatctgttacagtgttctgtgatcagtgatctttgatgctatttttttttttttttcgagacagagtctcgctctgtcgccaggctggagtgcagtggtgccatcttgtctcactgcaagctctgcctcccgggttcatgccattctcctgcctcagcctcctgtgtagctgggactacaagtgcccgccaccacgcctggctaatttttttgtgtttttttagtagagatggggtttcaccatgttagccaggatggtctcgatctcctgacctcatgatccgcctgcctaggtctcccaaagtgctgggatcacaggcgtgagccaccgtgcccggcctgatgctgttattataagtgttttgggtcatcatgaacgatgcccgtgtaagacagcgaactcaatcaatgaatgtcgtgtgtgttctggctgctccaccaaccgaccattttcccatctctcctcctcttcttgggcctccctattccctgagacacaacaacattgaaattaggccagttaagaaccctgcaatggaagcaggcatggtggctcatgcctgtaattccagaactttgggaggctgtgatgagcaaatcgagaccagcctgggcaacatggaagaactccatctctacaaaaaatacaaaaaaaattagctgagcgtggtggcacacgcctgtagttccaactgttatactgcgggaggctgaggtgggaggattgcttgagcccaggaggtcgagactagtgagctgtgatcgcgccactgcactccagcctgggagacaaagtgagatgctgtctccaaaaaaaaaaaaaaaaaaaaaaaccaactatgatgccctttaagtatacaagtgaaaggaagagttgcacatctcttacttttaaatcaaatgctagaaatgattaagcttaatgaggaagatatttcaaaagccaagatgggtaaaaagctaggccttttacaccagtcagccaagttgcaaatgcaaaggaaagttcttgaagaaaatcacaagtgctactccagtgaacacatcaatggtaagaaagtgaaacagactcactgctgacatggaggaaatttcagtggtctagattgaagatcaaaccagccaccgcattcctttaagccagtgcctaatccagagcaagcctctaactctatttagtttgaggaagctgcagaagaaaagtttgaaactagcagaggttggttcatgaggtttaaggaaagaagccatgtccataatataaaagtgcaaagcaaatggcaagtactgatatagaagctgtagcagcaaatgatctagaatatctggctgagatcagtgatgaaggtggctgaactaaacaatagattttcagtgcagatgaaacagccttctattggaagaagatgccatctatgactttgataactagagaggagaaaccagtgcctggcttcagagcttcaaaggacaggttgactcttgtttgggttaatgcgctggtgacttcaagttgaagccagtgctcatttaccattctgaaaatcctaggaccctgaagaattatgctcaatctgctgtgcctgtgctttagaaatagaacaacaaagcctggatgacagcacatctgtttatggcatggtttactaaatattttaagcctattgatcagaaaaaaaaaaaagatatcctttcaaaatattgtaatcatccaacagttgttttttctttttttcccaccatacaaatagagctgattcactgagacagtgatattatagtagagaaagagtgtaataattgcagagttagtcaagtgggaggactggagttattatttaaatcaccttcccctaaaatgtggaagctatggttttttaaggatagtttggcagagagggagctgggaacggggaatggagattggttgggttggggatgaaattataggggtcaaaggtgtctttttgcagagtcggtttttgggtgggatcacaagatcaattgaaccagttttttggtatgagttaccagcgcaggtgagcccacctggtccgtcagaatgtagggtctgaaaaatacctcacaccccaaggttttataatagtaatatcatttgtatgtaggagcaattgaggttagaaatcccatgacctctgtctgcatgactccactactgagctataattttaacctcttgactgatttgctggttttacatagatggtttaagtctctgagcaagaaggaggagttagttttgggaaggagctgataatcatctttgttttaaaataacctcgtggctaatttgttagttttacaaaggtggtttcagtccctgagcaaggacagggctgatttccagaaggagctgttgtcatctttgttttaaagttaaactaaatttttctcatagttaatttggcctatgcccaaaaataaagacagcttaaaggttaaaagcaagataaagtcagctaggtcagattttttccactgtcataatttttgcaaaggtgacctcaatactactgttcattgacaaagcacgttgtcacccaagagctctgatggagatgtacaaggagatgaattttttatttatttatttatttagagacagagtctcactctgtcacccaggctggagtgaatggcgcgatcttggctcattgcaacctccgcctcccgagttcaagtgattctcgtgcctcagcctcccaagtagctgggattacaggcatgtgccaccacgcctggctaattttttttttttgtatttttagtagagacagtgtttcaccatgttggccaggctggatgaatgttgttttcatgcccgctaacacgtatcgttctgcagactggatcaagtagtagtttgactttcaagttctcttatttaagaaatacagtttgtaaggctatccctgccattgattcctgtgatgggcaaagtaaactgaaaaccttctggaaaggattcaccattccagatgacattgaaaacattcatgaggccaggacttcaagaccaacctgggcaacatagtaagacctcatctgtactaaaaagcaaaaattagctgggtcttgtggcttgcacctgtagtcctagctaactcaggaggctgaggcagggggattacttgagcccaggagttcaggctgcagtaagctatgctcatgccacttcactccagcctgggcaacaaagcaagaacctgtcttaaaacaaactaactaaataataatgaataaaataaaatgttgtgcttcttgattgctttttcttcccaacgtactccatagcatattaatccatacctagtggctttgaccctcctaggtttccgtgattcacagtaggatcttattcatttaaaaataacaacaaatgatagttatgcctaatattttgaagaattcatggtaggtggaagcagcataaggtaatttttctttttcttttttctggtttttttttgttttgttttgttttgagacaggatctcactttgttacctaggctgaagtgcaatggcacaatcattattcactgcagcctcaaactcctgggctcaggcagtcctctcacctcagcctcctgagtacctgggactataggtgtgtgccaccacagccagctaattttttatttttattttttgtagagacaggtggtttgatatgttgcccaggctggtctcaaacccctggtgttggtctcaagcaacccttttgccccagtctccctaagtgctgggattataggcatgagccaccacacctggccagtaatgtttctcataaataggatggcaaatggcatacaaacagatgaatctgttctctgggcagaagaagttagtcctgaaatctgggttcttagtactggaaaacaggcagtatttttttttaatgttatacaatgccaatttatgagtttcataatacagtattcatttttaaataggttattatattttacctcctaacctaattgttattttcagccagtgaaaggcagaaataagaagtaatagtaattgcctttcagtataatcccacttgtatatttttgcttttattgtctgttattttgaggtcttattcataaaatcttttcccagaccattgtcctgaaacatttcccgtattttttttttctagtagttttatagttttgggtcttacatttagttctttgactcattttgagttgatttttatattgagtgagaaataggggcctattttcattcttctgcagtggatatccagttttaccagcaccgtttattaaatagactatcctttccccaatgaaggtgcgtggctcctatgtaaaaaaaatcagttgactatagaggcattcattaatttctggtactctgttccattgctctatgtgtctgtttttatgccagtaccatgctgttttggtaactgtagcttcgtatattttcaagtctgatagtatgttgccgccagcttgtttttgtttttgtttttttgctttttttctttttttgagacagagtctcacccaggctagagtgcagtggcatagtctcagctcgctgcaacatttgcctcccgggttcaagcggttcttgtgcctcagcctcctgagtagctgggattacaggcctgtgccaccacacccaactaatttttgtatttttaacacagacatggttttgtcacgttggccaggctggtctcgaactcctgacctcaagtgagccactgcgcccatccagctttgttcttttttgctcaggattgctttggctattggtatgactttactggtttcagactaattttaggattttttttttatatttctgtgaaagcctgggcacagtggctcacgcctgtaatcctagcactttgggaggctgaggcgggcagatcacctgaggttaggagttcaagactagcctggccaacatggtgaaaccccatctctactaaaaataaaaaattagccaggcgtggtggtacaggcctgtaatcccagctacgcagaaggctgaggcacaagagtcgcttgaacctgggaggtggaggttgcagtgagccaagatcatgtcatgcactcaagcctggccaacagagcaagactctgtctctaaataaataaatatttctgtgaaggacattattggtattttgatggggattacactgaatttgcaggtcactttggatagtaaatagttttaatttttttagttagaaaaaaatacccataaaaatacttggtgtatatatagtaagcacttaataagtatttgacgaagcaatatttttctaacatactgaataaacatttcaaataaaaatgaatgaatgttttggggattatttctcctctgaactctaagctttgttaatttaattcatttttcccccagagagactagcttgcaaaattttcctcatattgaggtggttcggaaaaaagaggagagaagaaaactgcttgggcacacgtgtaaggaatgtgaaattgtaagtactaatgtagatactaatttttttttaagtacggctttatagataataaatgcatgattttaaaatcacgtatacaaaccatattggttatagaaacctcttatttgagccaggcgtaacagcaggaataaggagtattctgggtcgggtgcggtggctcatgcctctaatctcagcattttgggaggccaaggagggcggatcacttgaggccagaagatcgagactggcctggccaacatggcgaaaccccatctctactaaaaatacaaaagtaagctgggtgtggtggtgcacacctgtaattctagctactcagaaggctgaggcaggagaatcgcttgaacccgggaggtggaggttgcagtgagccgagattgtgccattgcgctccagcctgggcaacaagagtgaaacttggtctcaaaaaaaaaaaaaaaatgccaggtgcagtggctcacacctgtaatcccagcactttgggaggccaaggcgggcggatcacgaggtaaggagatctagaccatcctggctaacatggtgaaaccccgtctctactaaaaacacattaaaaaaagccaggcatggtggcgggcgcctgtagtcccagctactcgggaagctgaggcaggagaatggcgtgaacccgggaggcagagcttgtagtgagccgagattgcaccactgcactccagcctgggcgagagagcgagactccgtctcaaaaaaaaaaaaattatttttaccaacattctcaggaaattaggtatactcataattttttaaaaataattggtaccaatataagttctttttttttttttttttttttttgagacggagtcttgccctgttgcccaggctggaatgtagtggcgtgatcttggctcactgcaatctccacctcccaggttcaagcaattttcctgcctcagcttcccgggtagctgggattacaggcacctaccaccatgcatgactaatttttgtatttttagtagagacagggtttcactatttggccaggctggtctcgaactcctgacctcaattattccgcctgccttggcctcccaaagttctgggattacagacatgaaccaccatgctggccaagttcttttttgtttgtttgtttgacacagagttttgctcttgttgcctaggctggagcacaatagtgcaatctcagctcaccacaacctccatttcccgggttcagacgattctcctgcctctccctctgcctcccgagtagctgggattacaggcatgcgccaccatgcccggctaattttgtatttttagtagagacagggtttcaccatgttggtcaggctggcctcgaactcccgacctcaggtgatctgcccaccttggcctcccaaagtactgggattactggggtgagccactgcaccaaacatttttcttcctaaacaagatataatgaataaatacttaaacacttatatttttccttttatacattggctgtcttggatgttgaagtagatggtacagacattgctttgtatctgtgggaaactggcttcaggacctactgtggataccaaaatcacggatgctcaagtctctgatataaaatggcatagtacttgcctataacctatgcatattctttcatatgctttaaattacctctaattacttataatccctattacaatgtaaatgctttgtaaatagttgttatactgtattgtatagggaatgacaagaaaaatagtctgtacatgttaatacagatgaaggtttttttcctgaatatttttgatccacggctggttgaatccatgaatgtagaacccaaggatatgaagggccaactgtattgattgtccttttactgaatagtcccaggcaggttctgttttgacctggaacatgctgtttttatttcttcccttgttgtccattagctctcagatgcctgccctcagcaatttacttccccttttaaatttcatttttaacatacgggctagaaaatttaataaccaagcacattaaaattatatgtgaaagtatgactagattgtaatacaggtaagcattgggtaaaaatatgctcttatgtactaacaatgggaatataaattgggatcactattttgaaaagcagtttggcaatacaagcaaaagcctataatgtgagttcgtgagttttcattacacaaattgaatatatcacgatgtcttaaagaatatggtccacattgagtaaatctctggttttttagttataaccataattctatgatctagaattaatcctactagttagaaaaaagctattttgctagaaacactgttaagttacattcattctcaataatcatttcccgtgctttctgttatccaatctctgaaaaccattattgtatacattttagtttttctagttaatttacctaggaaggtaaatctgttctgttactccatcatgaccagaagtggaagtgccagtcccatgtacttaaatactaaccatatgcttacagttcttaaatttatcccattgcctattctgcaagtggagtgtgcaatactcatgtggatctgagatagtgatctcaaatttcacacatccaaaaacaaacatacaatatctgccctcaattcccaaacctcactgctgagtctcctatatgtcctgagatcttatagttattcactacttttttctttcacatctcaataacttttatatcaacaaaccccattgattcttccttcaaaatatatcccatatccatccacttactatcaccaccactaatgccctggaccaaggcaacattttataattttttttttttttttttgagttggagtctcactctgttgcccaggctgaagcacagtggcgcgatttcggctcactgcaagctccgcctcctgggttcacaccattctcccgcctcagcctcctgagtagctgggactacaggcgcctgccaccacgcctggctaatttttttgtattttcagtagagacggggtttcactgtgttagccaggatggtctcgatctcctgacctcgtgatccgcccgcttcagcctcccaaagtgctgggattacaggtgtgagccactgcacccggccaacattttataattgtaatagcttctaagtgctctcctggtcatttttttttttttttactctaaaacttgtattttggccaggcacagtagctcatgcctctaattccagcactttgggaggccgaggcgggtggatcacctgaggtcaggagttcaaggccagcctggccaacatggtaaaaccctgtccctactaataatacaaatattagctgagcgtggtggtgcatgcctgttatcccagctactctggaggctgaggcaggaaaatcacttgaacccaggaggcagaggttgcagtgagccgagattgctccattgcactccagcctgggtgacaagagcgaaactccatctcaataaataaataaataaataaataaaactttattttttagagcagttataggttcacagcaaagttgtacagaaagtacatacagttcccatgtacctctgtccccattctcttttacttttcattcttgtctcttaacaatgtactttcagctcagcaatgaatggcctttttttttttaaataatctttttagaataaaagttaaatcatgtcattcccagaatccttcattgtcttcccatcccactaagaaaaagaatctaaagtccttatcaaggacaacaaactctggctctgcacttcctctctgatttctgttcaaccactcacccatttgcttgctgtgttacaactgcactcaccgactactgtttctcaaatatgttttaattcagtggcagtgttttttccaataagccctgattctctaaggtcatctcatctcatcccaaagcccagactaaggtaacaaaggcttatacttagggcagtgagaatgatgaaaaagatacctgaatgaagttgtttcacagcttctttaaagcctttaatctgtgtaaaatagaaatgtattaaaagcttttacttcaaacttaaattctagttttaagtctgtcactttcaataggtgatatctttggcaaattaccactttcattttcagtttctcaagtgtaaagtgaaggaatcggctggattaaatatgtgattctgggtggctcacacctgtaatcccagcactttgggagtctgagacaggtggatcacttgaggtcaggaattcgagaccagcctggccaacatatagtaaaaccccgtccgtgtctactaaaaatacaaaattagctgagtgtggtggtgcatgcctatagtcccagctacttgggaagctgaggcaagagaatcacttgaacacaggagtgggaggttgcagtgagccaagatcgtgccactgcaccccagcctgggtgacagagcaggactctgtctctcaaaaaaaaagtgattctgtcatctatgttctattaaaccttaaactactgctttgttttcactaagtctaggccttaaaaacctgtacaatttttacgtataattttatccttgtgtgcatgaagttcaagttctttgttttcacagttgccaaaaaatagtaggcttttgatcctaactgaaatcttaaagggagaagtcatggagccttcaacattcagatctaaattattttttaaagccgtagagataagaaaattactttgaaacacacgttatattcaaataataattaagaaacatgtagacctctgaattttttttactggcctaataaggataaagactttgtaccagtgtataaatcagctgtatcactaagcacactgtcaagatcagctggctttttttttttttaattgcaacactttactgataaaggaagcactttattggtttacattgtgatacaagctccttttctcatcagtgaagcaggcacttcacagaccaacatcagcactgattactgttagtaattaatactgtctgtaagaattaattactaatagtatcatcaatgaggattaagtttccttagactgctgaatatcttagtaaatggcttttttagcttctagtttgtaatcaataagcataacactccatttattattctttagtgaaaaaacttaccagtttttattattagtattatgcagatatgccagcagaagaaagagaaaagaaattggcttcctgctcaagacaccgattccgctacattccacccaacacaccagagaatttttgggaagttggttttccttccactcagacttgtatggaaagaggtgagagtatagattgtaacattttataattattttttttaaatacttggccgggcacagtggctcacgcctataatcccaacactttgagaggccaaggtgggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaataaaatacaatataaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgatttttttttttatagggcttcactctgtcacccaggctggagtgtagtggcatgcataatcatggctcactgatgcctccgacttatgggctcaaactctacctcagccttccaagtagctaggactacagccttgtgccgccatacccagcacttttttttttttccccctagagacagggtctcactatgttgctcaggctggtcgtgaactcctggcctcaagtggtcctcctgccttgacctcccaaaacactgggattacagccatgagccactgcacccagccaaaatgactttaaataaaataaataacctaacaaaaattaccaggaaagttatatttaaaaagagagaatcttaaaatctactgctatgaattttggattttaaaacctcacttacccagaatgctggatgtttataagtggtatctgaataaataaaaaagatgtttatttgttaggttgttgacatgcaactagcttgtttagatatgacacttacatttaatataatttgagaatatattcagcttttaggctgttaataaaaggtcatgagtagtaatttttctatgttaccagcagcataatgctaaaaagtatagatccacatttttctggttttatattttctaccaaaattaagttagttgggtatgtgatctgaagtcttcatgtcatttaactgtctttggggtagcatactcccatttctgtgctcaagctaggactatcaatctggacattaccactattccaggcatatagtaattcatagtcactaaggtctaaactttattgtaatcattggtttaaatgaaatgaaatgctcgagtccttagccttaaaagagctatttaattaagcagggtccatttcacagaccctttgttgtgaaagtataattccagaggagctcataagagcatttaatagctagtttttatgaaggggcctttttttttttttttttttttgagatggagtctcactgtgaggcccaggctggagtgcaaatggcacaatctcggctcactgcaacctccacctcccaggttcaagcgattttcctgccccagcttcttgaatagctgggactacaggcacatgccaccatacccagcctattttttttttttttttttttttctagtagagacggggtttcaccatactggccaggctggtctcaaactcctgatctcaagtgatccacccgcctcagcctcccaaagtgctgggattacaggctcgagccaccacgcccggcctgaaggggcctctttaactgaagattttattctctacattattgtattcttagactttttttgtatgtggcacatatagttcaaaactcatttgttattaaatgaatgttggtacagacattcaatcaaacattcttttaataagacaacatactcttagttttatgaagaattttaattcaaaatcatcctaaaacatgagctaaatactgacattacatgtgtacagtttattacataccaagtgtacttgaatgaagctgttcagaaaaaaagccataagagaggaagaatattagctaagcagggacttttctgacctctttattattttttgctattttctccatggtccaaagaccatccagttacagactaagtcttaccttgtggtttaaaatactgagttttagctggtccagaggcaattagttatctcagttgatcattcaattacagattgaactgcttcttttactctttcccttcattctcactactgtacctgattcgtcttaagaaaaaaatactgagttttatgaaaacaagatatgttttctggtatgtgattgaaaagtatagtagtgtttagaatatttatgatttgactttttaattaattagtagccttcaggctttaggcctgtatttgtcagttacagataaatgtttaaaatttttacccacaagacgataaaatagcattaaataaatgtcaaatgataaaattataccacctagaatttcagttcagccttgccatcttatagaaactattctcagctgggcacagtatctcacacctataatcccagcactttgggaggccaagatgggaggatccattgagcccaggagttcgagaccagcctgggcaacagagtgagaccctggctctagacgaaataaataataaaattagccaggtatggtggtgcatgcctgtggtcccagcagtaactcaggaggctgagatgggaggattgcttgagccctggaggtggaggctgcagtgagccgttattgcaccactgcactccagcctgggcaacagagcaagaccctgtttcaaaaaaacaattaatttaatttaattttgaaaagaaactgttctcaatgaagagctctgatgatttagctgcacaacaaggagggagagaccttcttcacttttggagacgctccagatgtttaactgtaagatagtttttccaaaagatgcaaagtctctgacagctttcactgtatttctgctttccccattaataagccagattgagtcaactttgatgtgatatctcactgcctggtcaccagatagaatcagtctggatagagcctgtgattgcaccccatgcgtatggcagagcaaatacttcccctgaagattacatgcttagagacaccttaggagatctaatagtctgaagggtatagagggattgtcatctattgaaatagctactgtaaaaagtatttttgataagtacctgaaatttataatagtagagttcatgtttagcactttgtccccctttgcaactacctatgggaggcagaataggaaagtgtttaagagttctggttctggaataagaaagagcttgggccaggtcccagctcctctactttttagctttgtgaacttgaacaagtaatttaacttccttgggtctctattacctcatctgtcaaacaggtatagtagaaactacttcaaaggaatgtgagttatatgagatgatatatgtaaccatttggtaaatatttgctgtcattattataaatgaggaaactgatgctaaatagtgagatcaatcatcagcatcacacagctaataatcagaagaatcatgtaaacttacaaagcatcaaataagagaaatgtttactagatataagctgaaagaaatgcatgttgcacatacagtcttctaagtttatgatttgtttttaaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 108 - DNA, 6200 bp, Homo Sapiens
cttttcaagaccagtctccatctccagcctccttcaagcttgaggctgaagctgacaatcttaagagaccttagagccgccaagctcaggttagtccgttaagcgccgcccagccagtcctccccgtcacagggggcgctgtccgccttcctctcgcctacacaaagaccccgctctcgaatctggggtgacaggaaggagccggtccaggctccgggggctgggaaagggcgcgtctcaaaggctggctggagtggagccaagggaaaagatcgttagagacagcgcccctgaccaaccacttagagcagcgcaggggtgggagggcggccgcaggctctcctctcgttagtgccccctgtgtttggggccccgtgatctcaacggtcctgccctcggtctccctcttcccccgccccgccctgggccaggtgttcgaatcccgactccagaactggcggcgtcccagtcccgcgggcgtggagcgccggaggacccgccctcgggctcatggcggccccggtccgcctgggccggaagcgcccgctgcctgcctgtcccaacccgctcttcgttcgctggctgaccgagtggcgggacgaggcgacccgcagcaggcgccgcacgcgcttcgtatttcagaaggtgggtcctggcgtggcccgatgggaaaagctgctggccaggtcaggcctgccctgaccaggtaccctacccctgcccggccaggcgctgcgttccctccgacggtacccactgccgctgcgcagcgggaaggaagctaagatcctacagcacttcggagacgggctctgccggatgctggacgagcggctgcagcggcaccgaacatcgggcggtgagcgcctcggaaaggggtcggtgatcccccacctcccccaggtggagcctccgtactctcctgggagcccttggcttttaagctccccactcctgtcccagttgccgttcggcctagggctagtggctggcgctccctgagcctccctcaccggtctcacgtaaccatctgagtaggttgcatcccagatcctcgcagctgccggattcgtggagtgtggagttaactcttttctctcccgcaggtgaccatgccccggactcaccatctggagagaacagtccagccccgcaggggcgacttgcggaagtccaggactcttccatgccagtgaggaaggggcaaggggagtggaaggcaaagtgggagtgcgggagtatgattttctggcttgggggatttggcaagcctgagtccaaatctcaccagtgatgcctggccttgagcaaatgacttatcctcttttcgacttagtattttaacctgtgaatagaaatattggtaacagccaatgagagaattccatgatcaagctacttaaggatcccagctcagttagttacggggtcaccattattgagttttcctgtctaattacacctgtcctgcagcgcatggtagaagtgaggccaggctgggcagacacccccacccactgccccgaaactgcctgctgttttatcccagatttgcagcggatcatcccatcacctggcccattttacagagaaggaaactgagagacaactgagtgacttacccagggccacaaagcctgctggggacttattcaaagatgactggctggctttcatgttcagaactcctctgtacctttcaggttcctgcccagcccaaagcgggaggctctggcagctactggccagctcggcactcaggagcccgagtgatactgctggtgctctaccgggagcacctggtgagcactgggctacaccgggaggcggaaccatggcagtggggtgggaggttccccgaggggcctggcccaggcagggcaggcaaagattatcccagccacctgagcgggatgaggaggggccctggcactgagcctaccctgtcttttctaccttggtttcagaatcctaatggtcaccacttcttaaccaaggaggagctgctgcagaggtgtgctcagaagtcccccagggtgagcacagggatcagggaggacaggcccaagtggctctggggcccaccaaagactgccttttcttgcagtgggcccatgtgtggcccatggctggggacacagggaacatggacttgtggtggtaccaggtgctctctgagggtctcttttctgatccacaggtagcccctgggagtgctcgaccctggccagccctccgctccctccttcacaggaacctggtcctcaggacacaccagccagccaggtggggccaactgcaggagatacaggagagcatgagtgaacttcttagtagggccttagagtcacccaacaactcccagagctgatgctgttgagattggggggggtgggcctttcctcaggagcccccactgttggaatacctggagggtgtgaaaccgcagcagcgggggtgggagggtgcggtggttattggaggaggagaaagccttttcagaggagatagcatttgacacgttttaggatttggcgggtagagatgcaggataagtattccgaggaggaggaaacagcattagtgaagacaggaggaaggaaattgtctgagacacacttcttgcagacctgagaatggcgctgagcaggcccaaggaactgctctaagagccaagaagaccaggaggagcaggagccactggggtcatttgtgcagggcgccaagggggtggtgaggccagcccagctgggggcaggcaggaaagcctgccaggaatgagtgaagaaggtagagctgtgttgtcccctctgcctcccaggtactcattgaccccagagggcctggagctggcccagaagttggccgagtcagaaggcctgagcttgctgaatgtgggcatcgggcccaaggagccccctggggaggagacagcagtgccaggagcagcttcagcagagctgtgaggaggagggcagaggagtggggaaaacagggaggaggggatgggaaatgaggccaaagccccgccccaacccatcacctgcagctgaactgtggctgcctccctactgtgggtgggtggtgggtgtcgggtggcatgggtgtggggcaactgccctggcacaaggggttctggcctcacataccaacaccccccacttagtgccagtgaagcaggggtccagcagcagccactggagctgaggcctggagagtacagggtgctgttgtgtgtggacattggcgagacccgggggtgagtgaggtggggagaaacgagggagatgatcagaggaggctggggggtaggcactgccctgctctgatctaggcttccctccttgccactccaggggcgggcacaggccggagctgctccgagagctacagcggctgcacgtgacccacacggtgcgcaagctgcacgttggagattttgtgtgggtggcccaggagaccaatcctagagacccaggtgaagggccgtggacaggctggcaccaggggcagggcctggtgggtaggggatcgcaagctaacggctggcttgtcagcagcaaaccctggggagttggtactggatcacattgtggagcgcaagcgactggatgacctttgcagcagcatcatcgacggccgcttccgggagcagaaggtaattttgctggctttgccaggcttccctgcctgctccgaagccccgttttcagcccagagcaatccaggggcacttctggcagcctccttgaggcagagccctttggaatccagccacacccaccctgtggctgctccaggatcagacccccacaggcccatccaggcgcacagtaggaagccaggtacctgcattcttgggctgaggtcaggagcattttaaagacctcttgggtacccagcccctgcagtcttggataaacaaggcataaacctccaggagtggaaatacagaggctgtaccttggtacttgctgctgggtggacccctagtcacagaggccatgtgccggcccaggggaggcttgaaggatgggcagtgttgagagatggagaaaaggctttctagacaagagtgtcagcatgagcaaagctgcggaggcccctgtgaggcaggtggagaggctagggaggatgcagaggctaactggtgggaacagggtcccggcaccattttgagtgtgacatcatggatgcccaggcatgtggtcatccagcctgaccctccctgtccactctgtacacttccctagttccggctgaagcgctgtggtctggagcgccgggtatacctggtggaagagcatggttccgtccacaacctcagccttcctgagagcacactgctgcaggctgtcaccaacactcaggtgagctgggagggcagggccaggcaggcaggcaggggcccctgtggtccatggttcatggtctaggccaggagccaccttccctctcttgggtcctcttccccaggtcattgatggcttttttgtgaagcgcacagcagacattaaggagtcagccgcctacctggccctcttgacgcggggcctgcagagactctaccaggtgagcagaggcccctttcccagtgtcgggacagagcccacaaggaattcaccttgcctgggccctgtgcatccccaaaagaagcaaggtgggtgagatccccatttctcaggctggccccccaaggctgaggactgggcaggggctggctggagttgttccttcgagctccagcctggcctcagtcccttcttccctcagggccacaccctacgcagccgcccctggggaacccctgggaaccctgaatcaggggccatgacctctccaaaccctctctgctcactcctcaccttcagtgacttcaacgcaggagccatcaagaataaggtactgtctctgcctagcttctcagacatggcctggcccagacccccactgatccagccctttcccgaacccaggcccagtcggtgcgagaagtgtttgcccggcagctgatgcaggtgcgcggagtgagtggggagaaggcagcagccctggtggatcgatacagcacccctgccaggtaggccctaaagggcccttaggtgtcctcagcccctgccctccatgcatggaattcaccttaatccatgcttcgtggagggggcctggccttgtgtgggctctgcagaccagagatagacagatcccagggtgctcgtggaggtcaagtggggaggaagccagcaggcccacatagtgtcccaggtagtggaggccacaggagggagggagacgtcccacctggtggagaagaggcttcctggagaaggggttgggccattaaggggagtgagggtgaaggtttggagcctttgctggttttgccccagagttcccacagggagggaggacagcccggctggcatggggccttgagtgccaagctcaggaagtggggcagtgtcccaactcttccatcccatgctgacccctctgcctggcccctcatggtgctggcccagagtgggccactgtcagcctcagaaactcaaacccctgccccccagcctcctggccgcctatgatgcctgtgccacccccaaggaacaagagacactgctgagcaccattaagtgtgggcgtctacagaggtgagggcaagagacggaacctggagggagtggcagggactggggctgccctaggcccagggcgtgaccctcgctgcctctcttcctgcaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcctaaaagaaaagattgaaaaccactaa

SEQ ID NO: 109 - DNA, 8260 bp, Homo Sapiens
aggagatctacttccgggccctgcgtggcagttgaaagagtggcgggagaagttgcaggtgagcgtccccggtcgcaggcctgcggattgggcagggcttccctcctgaacaccgctctgcagaatcttggtggctaaggtgtccaggagcctctgcagcggaccgccagcctgagaggcgcagagcttgtcgggcaggggcccgcttgtcccactcccctgatttgcagatgtcaacggaggcccagcgaagggtcagagatgaggccccctccctagtcattcaacttactctacttagccagctgtgtgccagatgctgtactaagcgcggtggatgcattattttatttaattctcactaccttataaaatgggtgctgttaccatccctgttttactaaggaagaaactgaggcctaggcaggttacatgtctccttctgggtcatacctacagtgttagtaaatgttcaagaaatgattagctttgcatatgacccagcaattctactcctaggtatatacacgaaagggatttgaaaacatacccccacaaaaacttgtatgtcagtgttcatagcagcattattcataacaggcaaaaaaaggaaacaaattaaatgtccaagtgatgaatggataaacaaaatgtagcatatccatacagtggaatattattcagtcatgaaaagcaattaactactgatacaggctacatcatagataaaccttgaaaacaagctgagtgaaaaaagtcaatcacaaaaggccacatagtgtatgattctatttatatgaaatatccagaataggcaaatgcatagagacagatttatggttgccaggagctggggagggagggaaaggacagtgacggcttaatggctgcaggaattctttttgaggtgataaaatagtgatgatggttgcacaacattgtgaatatactaaaatctactgaatgtacacttttaaaaggatattatgctgtgcaaattatatctctatttttatttttattttatttttcttttgaagcagggtctcactctgtcacccgggctggagtgcagtcgtacaatcacagctcactgcagccttgacctcccaggctcaagcaatcctcccacctcagcctcctgagtatctgggactacaggtgtgagccaccatacccagctaatttttgtatttttttgtagagacgagttctcactatgttgcccaggctgttctcgaactcctgggctcaagtgatccttctgctttggcctcccaaagtgctgggattatacgcatgagctaccatgcccagcctatatctcaatttttaaaaagaacagtttttggccaggtgcagtggttcacacctgtaatctcagcactttgggaggccaaggcgggcggatcacttgaggtcaggagttcaagactagcctggcgaacatgatgaaaacgcatctctactaaaaatacaaaaattagccaggtgtggtggtggggcgcctgtaatcccagctaggctgaggcaggagaatcacttgaacctgggagtgaggttgcagtgagccaagattgtgccactgcactccaacgtgggtgccagagtgagactccatctcaaaaaaaaaaaagaagaacttttgacatctccatttcaaacgtgaagataaacaaggggttggaggtgttaaatcttgttaccacctccccccattaaaattttgtaatggtaactctactttgtttatacttcagcttgacctggaaagaatttgaggaggattcctgttagattaccaggagttagagttccagattgaatgtgttggggccatgtcatatttctctgtttctgtattctctatatcttatatttatgtcataaagcctggctatggaacacagctagtggactgaattgaatgctccagtctgtgtcatatgtctcttttccttttagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccaggtcctcacatgtgtctttgtcctgtgctgagttatctgcgttctggaccccccactgacagtcccttttccatctgttgcagtgctcttacagatggaaggtgggggccagctcctaggagcactgcagaccatggagtgccgctgtgtgattgaggcgcaggctgtgccttgcagtgtcacttggaggagaagggctgggccgtctgaggtaggagttttctggctgacatttcctccctctcctccccttacaattacaggataaatatgcttttattttaaaggatacttatcagggccccagcaggaagacagatggcacattcaactcagggtaattaaaagaagattgaataaagggactgtttgccaaggcatgggcagggtatgaggaaactaccagtgacagcatggtacctcacagtaataacagcacaacttaggtttttcgacctcagtattgttgacattttagattggagaattctttgttttgggtgctgtcctatgatgtgcacaatgtttagcagcattcctggccactatctactaatgtacccctctcagtcatgacaataaaaaatgtctgcagacactgccagatgtcatttgtggggaaaaatcacccccggttgagaaccattggcatagctgttaccatccctatgcctgaagggatgaggggaaggagtggttaacagaattcaggagagagaaatggagagaggaccaccttgagcgaagctatgagctgccacagagggggacagcaaaccctaggtgaccccactgggagggagccaggggaaaaataccctgacttcacttttctccttcccactagtcctctcctcgggtccctgctggtgacacccagctgggagccagaagacatgtgggccctgtgttttttgtagagattgcagagtgtagcttgtatttttggtagagacggggttttgccatgttgcccaggctggtcttcaactcctgagctcaagcaatccacctgcctcagcctctcaaaatgctgcgattacaggtgtgaggcaccttgcctagcactaagattcttttttatctcaccagaagcatcttgtataaaataagaaaaaagatttttttttcctctctttgatttcttttttggatctgataactttctcagtaacacaggacagttccccacactttttactctgggggtattagcaagcctttatattcatagagcagcttaccctctcaaggcactcccacattctctcttgtgtttccatcagtcatcctatggggtaggacttctccccacatcacaggtggggaaactggggctcagaaaagttaaaagccttgttgaggatcacaacgggaatgagaacccagagctccccaaacctacactttgctgtaatataggtcttgctttgcttatagggacccaatcagaaaactttctatcaaagtcctgttccccaattactccataatactgtactgctggaggattgttggccttgaggcatccttgactttgattatgccctacctgtgataaacaggaggtactctcatagactgaagtttcccttgtgattcttgtctttgtcacaaaaaaacctatctgtttgtaaggaccactcggctcacagcatctgccttcaaagccagagtcatttacttgtactaacctttggaagagtttcccttccctccattcccgtattcaaaatggccccagcccctttcaacttgctatgttccttttttctctctttttttttttttgagacagagtttcaccctgctgcccaggctagaatgcaatggcatggtctcggctcactgcagcttctgccttctgggttcaagtgattcttctgcctcagcctcccaagtagctgggattacaggcgtgtaccaccacgcccagctaatatttttgtatttttagtagagacggggtttcaccatgttggccaggctggtctcgaactcctgacctcaggtgatccgcccgcctaggcctcccaaagtgctgggattgggattacaggtgtgagccaccgtgcctggcctgctatgttcctttttttttttttgatggagtctagccccgttgccaggttggggtgcagtgttatgatctcggctcactgcaacctccacctcccagtttcaagcaattctcctgcctcagtctcccgagtagctgggattacaggcacgtaccgccacacccagctaatttttgtatttttaatagagatggggttttaccgtgttggccaggatgggcttgatctccgacctcgtgatctgcccacctcggcctcccaaagtgctgggattacaggcgtgagtcaccgcgcccggctgctatgttcctttcttattcactgtctctgagatgcagggcaccaagactgaatcattgagggctgggagggacagcgacactgtttcttgccacagtgacttcattccagaaaggataatgcataaggggtgggagttagttcattcacccagaagacctgggccactctcacaggtgctcaatacctgctgacctccctccctgtgctgtgttctgggtactttggcaggacagagaggactgggtggaggagccaacagtactggtgttgctccgggcagaggcatttgtgtccatgatcgacaatggaaagcaggtgggcagagccagagggtgggaggacacggaacagagggctgactcttactaggaagcaagtattaatgcagtttctgccccttcatgcagggaagcctggacagcactatgaaagggaaggaaacgcttcagggctttgtaactgacatcacagcaaagacagcagggaaagctctgtcactggtgattgtggatcaggagaaatgcttcaggtttggatttgccctggtgatttcatgttaaaaggggcagctcttgggccaaggggggtgagtttagtttattcattgcagatgtaggtcactctgcaaggtagtccatctctaacaagtccagggggatgctctggtccagtcttcttctgtatcttctgcctgacttcagcctggagctgctgttctttgatttcctcccctgcaccagtgctcagaatcctccaagaagagggaaacagggagcaaataaacagaccaagaagcagcagcagagacaaccagaggccagcatagggtccatggtatccagggtagacgctgaagaggtaagaacgtcctgttgcctgaatcgggctgggtactcactggtcacctgagacttgctattgatagagaataaaatgcctgctgcgtactgttttctgccttggcactgactaagagaaggtaccaaacaggaagccaaggggctggggtgtggctttagtggacagtgacttggcagctagtctcttcctacccttccagtccatcgttgcttttgggtttctaggcattggtggatctgcagctacacacagaagcccaggctcaaattgtgcagagctggaaagagctggccgacttcacatgcgcattcacaaaggctgtggctgaggcgcccttcaagtgagtaaccccagcaagtccagcctccatgctgggcctgtcctttaccatggctcttgcagtcaaagcaaatgtccctttcccctcatctctgcagtcagcccattgtctctcaagcttgaggcagaaggagctgacctcacactggggattcttgggaagagtcctcaagcctagcgccttttcaaatattctcctttcgcctatatgtaagtatgtgttctgcaggctgatatcataggccaggttaccataggccaagttaccaggattaattacaggtcagatcacaatgtaataagcactaggaaagcaaatttttggcctactcagttcaagaagtgttcactgtcagaatttaaaataagtaaatgacctcagagacaatccagtccaagtcccttattttatacttgaggggactgaggcctgaagagattgacttgtctaagctcctagcagttagaagaaccagaaatagattgcagattgccagatatccaaagaatctggtatcttttcttctactataatggactagatgtagtttttaaatgaatcagcaactggccctatacctggcaacaaagtgagcactcaaattgtcaaaggcacaaaaaggccagatgtaacatggcgcccacctcttccaaggtcagtgggggggttttcagttgccacttgaggggaacaggtgtagaagagtaatgagcaacttacagctctccaaccacgctgttgcaggaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggtatgctgctccagggctcaggggtcactgcccattgcctgcgggctcagtgggcccccagatttccatggacaactgttgagggcccacaaaggcctcacaggtcagcagtgcaggtctactaagatcagtgttgctaatgctgacccagggagggaggacaggttctcatgccccaagccaagcgtagcaccctccatgctcatggagaagggatcaccatggatggtaccatattaagaggtcatctaccacttccaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggagcttggaggaagac

SEQ ID NO: 110 - DNA, 3493 bp, Homo Sapiens
ccggccatggcgcgggttggacccgggagggcgggggtctcttgccagggccggggccggggacggggcgggagcggtcagcggcgacctccaacctgggagatctcagactccgacgctgaggactccgccggctcggaggccgccgcgagagcccgggacccagcgggtgagcgcagggcggctgccgaggcgttgcggctgctgcggccggagcaggtcctgaagcgcctcgcggtgtgcgtggacacaggtgcggcggagggcacgggcgatactcggggtaggaaaggcctttctccgccaggcggcgccctctgtccgactgggcggggcgcgcgtgccgaggggcctggggccgggcccgcctcccagtcgggggtttgtgccgaatggagactccccggtccggccacccgcccaggtagggcgctcgcgagggtggaaggaagcagtgaccgcgctcctctcccccggtcccagccatcctggaagacgccggtgccgacgtcctgatggaggccctggaggccctgggctgcgagtgccgcatcgagccccagcgcccggcccgcagcctgcggtggacccgagcgagtcccgacccctgcccccgcagcgtgagtggtcgcgggttcccgagggccagccgcgagttggctgttttgcttccatgatttcagccctggagctgtccctgaggcagctgccctgggccgtgcgcgtctcgcggatgggtaaagcaaggatggagaacgggaagtggaggtgcccaagccgttctgctggtatagagccgagctggctggagaaggttccgtctcgattcaggctgtggtctggattcctgccagccacagagacctggcctgagcttggccttggcaggaaagggaacactgggcttctgtagagcaggcctgtcagggcctgggcttggctggggccacgaaccgctttgctgctggactgcccaggcagggcccctggggcacccggggttgagacaggcagcagcgcgtccccatgtccccacagctgcctcctgaagtgtgggctgcaggtgaacaggaattgctgctgctgctggagcccgaggagtttctgcagggcgtcgccacactgacccaggtgctcgggtggtggcagtagtccctctctaatcaggaggggtgggttcccagccgggaggcgcctgctccgccggtccctgcccctgtagacggggctggagggggcatggggcaggccaggactcctctctgatccaaagccgtagaggtttctagggtgagatggagaaagctcctgggcacctgcggaggctacagctgctcctagaggatcctgagaagtgtcaggaggccggggtccgggcagtaggctgcaggcttcgtcctctgacagcagacagcctggcccctgcctgcggggagcagtgctcaggtgctgtggtgccaggtagcgtggggttaggctagaccccctgccaggtccctgtgtcccaggatcagtgtctctcaagctgctgctttgtgctaggtcaaagctaggctggagtacagaggtggaccaggatgaggggctcaatggaactgacatgtgcccgagcagccactccagggtctccttagcctctttggcctcgtgggaggcacagagctggttttctcagaaggggtaacggaacagaggctcctctcggcaccactggctctttttcaggcttgctgttctgcaaaccagctgtggcctggtggcccatggccataggccgcagcctcctgtgaacaactgtgccacacgttctcatcttcagatctctggcccaacccactgggtgccctggatctcccccgagaccaccgcccggccccacctggctgtcatcgggctggatgcctacctgtggtaccgctcactctcatgcccacagcagggctggctgggacgggggttcaggggaggtgggcacacttctggggttgctgtggcacagctgatcccacttctccaggtgggctctggcagaggccaagctcgggcagggcaggccccatggggagcggggaggaatggtcacctctgctcaggtctcgccagcacgtttcccgggggacacagcagccagagagcccgaaggtggccggtgccgaggtggccgtcagctggccggaggtggaagaggtgagggcctgtctgagctgggtgagtcaggtggcctgggtcccagtgattgggctgctggctgggtttggttcccagcgtggtacatggggcagctatcagctgtgtgtcccgggtagccttcctctggctcgtgcccatcagcttgcctcctccccaggccctggtactcctgcagctctgggcaaacctggacgtgctactggtggcctcttggcaggagctgagtcggcacgtgtgcgccgttaccaaggctctcgcccagtatcccctcaagtgcgtgatgccaaggctgaaggggggcaggatcacctcaaggtagtggtgcctccccggccttttgggagctgctcacatgaggttctaaaaggcttctctctgtccccaggcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggtgggcccctgcctcctccaagccctccaggtgcagaagccccgtccccaggcgccctctcatgcctttgcctgctcctaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacccccagccacatgtggaccctcagcctgggtgggttctctggctgagcaggtctgacctcaggggaagggtgggtggttgcaggggaagttttaggtagctgggagaagaggggcttctggctggcagatggctggcggttcctgtgctgagtcctgaacacgtaggccccaggggaggcctcagcagcagggctgtgcccccccaacacacacacacactcggcagggaccagaaggcagctccagggccccactgccacctggaggcttggggtgtggcaccctcagccagaagcagtaggggactcccaaggatgtggaggggcagtgaggcctgggagaaggcccaggctgctcgcaagcccggcctctgcacggatacgtttcagctcacgccatgtgg

SEQ ID NO: 111 - DNA, 3724 bp, Homo Sapiens
gctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcaccgttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggtgaggtccccccgaggaatggatggctctagagtccagacgacttcggatccagctctttcttgagggaaacccactgacacgctttggccaccctatccccatctctaagatgctgatgctataggacttacggccattcctgagcaaagcaggccctgctcagggccttcaccatttccccttcaaagaaaaggttcttccctaggccatcagtactccgctgcactccagtgtggtcgacagagcatgaccctcttttttttttttttttttttgagatggagtctagctctgtcgcccaggctagagtgcagtggcgcgatctctgctcactgcaagctccgcctcctgggttcacgccattctcctgcctcagcctcccgagtagctgggactacaggcgcccgccaccacgcctggttaattttttgtatttttagtagagacggggtttcaccgtgttagccaggatggtctcgatgtcctagcctcgtgatccgcccgcctcagcctcccaaagtgctgggattacaggcatgagccaccgcgcccggccctttttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttggtgagtgcagtcccctggccccagcctggtccacctctgggaagagggtgcccagttgtgcaatccaggcccaggcagctgagccctcatctcagcatgcagggcggatactggagggggcttgtggcatctgactctgtatctcctacctgcccctctccttggtagctgtgagaagtcactgctttggggagacctgatctggctgtgccagatggacactgagaaagaagtagaagactcagaattagaagaggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaagggtg

SEQ ID NO: 112 - DNA, 3724 bp, Homo Sapiens
gctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcacggttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggtgaggtccccccgaggaatggatggctctagagtccagacgacttcggatccagctctttcttgagggaaacccactgacacgctttggccaccctatccccatctctaagatgctgatgctataggacttacggccattcctgagcaaagcaggccctgctcagggccttcaccatttccccttcaaagaaaaggttcttccctaggccatcagtactccgctgcactccagtgtggtcgacagagcatgaccctcttttttttttttttttttttgagatggagtctagctctgtcgcccaggctagagtgcagtggcgcgatctctgctcactgcaagctccgcctcctgggttcacgccattctcctgcctcagcctcccgagtagctgggactacaggcgcccgccaccacgcctggttaattttttgtatttttagtagagacggggtttcaccgtgttagccaggatggtctcgatgtcctagcctcgtgatccgcccgcctcagcctcccaaagtgctgggattacaggcatgagccaccgcgcccggccctttttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttggtgagtgcagtcccctggccccagcctggtccacctctgggaagagggtgcccagttgtgcaatccaggcccaggcagctgagccctcatctcagcatccagggcggatactggagggggcttgtggcatctgactctgtatctcctacctgcccctctccttggtagctgtgagaagtcactgctttggggagacctgatctggctgtgccagatggacactgagaaagaagtagaagactcagaattagaagaggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaagggtg

SEQ ID NO: 113 - DNA, 79108 bp, Homo Sapiens
aaggaaatagctttctgaggtttctttaaaaaccatcctgaaatgcacacagctgatgaagccacgtgacagtgtataaagcagtttaaagatcttaataaacgaggccctcataggccccttgcttgggcccactgcatggtgaaccatgtgcagaaatgtcttcccagctgtgatggtttcacattgtcatcgtcgtccccccgggaggttggagcatcaggggcctggactcactggactctcccctctcagaggtgcggaactatatctgtgacgaatgtggacaaaccttcaagcagcggaagcaccttctcgtccaccaaatgcgacattcgggagccaagcctttgcagtaagtgtgagtcaggaccccctcccagggctgtggccctcgcaccttcttatctgcctctgtcccccaggtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctggtgtgcagtggcaggtcccgtcagaagagatgaggctcctgggacaggtcagcgtcaggggcagcctgctgtctgctctggagggcggcgctcacctctgggtcgcagtccccacgatcagccagcagctgtgagagaggagcaggtcctcagcccatgccgcccactaggcctcagaccacaggggaggggctctggcagaaatagtcgagttgtattgccagccaggcaggcacatggcccaggcagctgtcaattctcatgtcccccacatggcccaaggtgggcatcttgacgttacctctgccacgtgtgagaagctctttttcgggcaccgaggtattaactgcagcagaaaaagacgagcttttgttatcagttccacggggttgccctagagagaaaacaggcaaactcacaggttagaagacatacagaaacagggctggtgtgtcccccatagtctgcatgctgtgccggaacattctttggcagaaggagcctccggctggggggagctcccctggaggtgggactggcccttgcacctgcctgacccttgagctccaggctcctgccagctggaggtgaaactgtgcttgtatccccagccacgaagagctggaccagcttcaagtacatgtccacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggcacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaagtggctcaggcaactctggacatctctgcctattatcagtgctggggacacccctgggggtcgggacgtgtaccctgggaggcctggctgtggggatagtgtggggcgaacagcctgagctgaggatacccaggtacctgtcagcagctgggagaggatgggggggtcgacctcttgcaggagggtgggtgtggtgcagagagaggcagtccccatgataggcccattggtcctggggttgaccagtgagccagtaaattatcttattgctttaaacaagtttgtgcttaatctgtcccaactaaaatggagcttataaacttacttagcaaggaacctcaaggagggctcgttcttaaccatttgcaagatgcctctgaaaagagcggccctccgcatttgtgcctcagcagcgtgtttcttaccactctctgtcaactgaaagagtgccagccaggatatcttcctcttctctaaacactcgaggattgctgcacaaacgtggaaagcctttggcaggtctgtggtgctctgtaaaccgcaggagaccaaccctgagaatggccgacctggtgctcccatgggtaggagggtacagccctcagcacagaagagggcatttcctctttgcttattgtaagtcttaaaactggtgacagttttacctatagaaggtaatactgggcctctggacagaagaggctcaggtaggaggccagggacttcgagcacccacaccaaggctgctgcaccacgtcctcaaataagacattaaaagaaaggcccacaggccggatgcagtggctcatgcctgtaatcccaacactttgggaggccgaggtcggcggatcactgaggccagttcaagaccagcctggcaatatggtgaaaccccgtctctactaaaaatacaaaaattagccgggtgtgacagactcacgcctgtaatcccagctactcgggaggctgatgcaggagaattgcttgaacccaggaggctgaggttgcagtgagctgagatcacaccactgcactccagcctgggtgacagagtgagacccccatctcaaaaaaaaaaaaaaaaaacccacggcctgggagttctcactcacacttccgcaaacacaaggagctcctgagctagtctggaaaccctgacttggaagctggctgcctggtgcccctgcctggcccacagtgggagaggacaccttggctggtaaggtctgacttacatttgaggtcagatgtgacgacagcaggcccatcaaggagaagaagaaaaggaaaaccaatagctgtaaataaaaacgtgcacttattattacattaaaattacctgtgctgtcattctaaataaggctgacacattcctctttaattgaaattttttacatctaggccataaatcctttaagtggatcttagaaaactttccaatcacttctagagagacagcttaattgagaattaattactactggctgggtcatttcacacttgcctttaaacaaagctagaaacagtttgaaaaagtgacaagagccagaaagagaagactgctgcggtctccttggctgtgcgcagtcccaactcagcatcatctccctgcaaggcctcctgtcagaagtgtttgtaaaatccttgaagataagcccacaggctccagcctaaagtagggcctgactgggcagggtctctgtggacactcctcgctgcacactagggtcctaaggccctggagccactaaaatcccttctaacaaaactacacaagaaacctgaagacgtactcagaagaacccctgcagggtggttataatcaccaaaaccctgggcgctgctgtcgatccagctttgagctggtgtaagttgtgtgctgacatggcacctatgcgttgcggatctcgggctgggcacagagggctgctgcctccagctctcttgtgggatgcttgtttctgttcctgttctgcacacaccacccttggctccctgcacagagagctgtgtgggtgtcactggtcttgtgggggcagtcaggctttccagggtgcagcaaccaggtgggcagtgggtctgagtcgaacatggtccctggcctggaattcaagagcagcctctcccactcctttccctatgcctatggctgcagacggtcccatccttgctgcctcttgtccccagcaccccaggtctgagctgtctcactgcaagcttatctggggctgtccctcagcacatgaatcaaggctactgcagcatgaacacagaaggcaccacttgaaggctgacagcatttacgctgggctgtgatgaggataaaaataagctgaagaaacgcacttcaagcctgggcaacacagtgagacccccatctcttttaatttttactttaaacaaattttttttttttgagacaagtctcgctctgtcacccagactgcagggcagtggcgtgatcttggctcactgcagcctctgccccctgggttcaagtgatcctcctgcctcagcctcctgagtagctttacaggctatgggattgtaggtgcgcaccaccacacccgactaatttttgtgtttttagtagagacagggtttcaccatgttgcccaagctggtctcaaactcctgacaccaagtgatccgcctgcctcggcctccctaagtgttgggattacaggcatgagccaccatgcctggactacagacccccatctcagaaaaaattacaaaattagccgggcatggtggcacacacctgtagtctgagctactccagaggctgaggtaagaggatggcttgagcccagaagaggctgcagtgagctgactgcaccactgcactccagcctgggcgacagtgagaccctgtctcaactacatacaaccatttaaaaaactgaaattattatttttactagtaaacttgatagtcaaagtcttactccaagccagctgggcgtggtggctcacgcctgtaatcccagcactttgggaggccaaggcgggaggatcacggggtcaggagatcgagaccatcctggctaacacagtgaaaccccgtctctactaaaaatacaaaaaaaaaaaaaaaaaaaaaaagtcttgctccaagccacatatttgtctttagaaaaacagttcatcagacaagcccagagaaatagcactgattgaaaccaagcttgcgagaaaataaatcagtaaaagaatttcctatcttgcctcctctctctcgcagtccagcttctttagctgcttcctgatgttttcttccctgacttgttgaatcgcaaagtgcagtgcagcagctgagagccagtccgggttgggtgctggggaggcagcctcaggggagaggaaactgggacagagagaacggggtcattgcagggccttacaaccatacaaccacgccatagaaaccaagtccttattcccacctgtcacctttggggcctgcctttccatcagaggacagagaagggtttcaggaccatcagaaactaggtctgcatcccccaggtccacgtgagagtgtgggcaggtgctggtgctgcccccacagcatcctggcgttctgagagctgctgactgagcaggcagctggcctggtcctgtctaccttgccctgtgctcttgggccccagctgcctacattttggaagaagaggcctcattttcctcagttgcccatgcctggccctgtggatcaggcattccctcctacaacagagaacaaaggactgcctggctctggccccagtgtggtgtctgagttttctggctggttaaaaaattggtaggaaattaatgaaacaatgctgtggtttaagagactttaaataagctgggcatgacggttcacatctgcaatcatagcacttcaggaggatcgcttaagcccagcagtttgagatctgcctgggcaacacagtgagactcaatctcaaataaacaaaaacgaggcagggcgtggtggttcacgcctgtaatcccagcactttgggaggctgaggcaggcagatcacctgaggtcgggagttcgagaccagcctgaccaacgtggagaaaccctgtctctactaaaaatacaaaattagccaggcatggtggctcacgcctgtaatcccagctactcaggagactgaggcaggaggatcgcttgaacctgggaggcggaggtcatggtgagccgagatcgtgccatctcactctagggtgggtgacaagagtgaaactctgtctcaaacaaaacaaaacaaaaaacaaaacttcagacaatctgatctgtgtttgtagaattagaactggaggtgtgacctgctttctccttttttgagatggagtttctctctcattgcccatgctggactacaatggcatgatctcggctcactgcaacctccacctcctgggttcaagcaattctcctgcctcagcctcctgagtagctgggactacaggcgcacactatcacacccagctcatttctgtattttcagtagagattgtttcacatgttggccaggctggtctcaaactcctgacctcaggtgatccacctgccttggcctcccaaagtgctgggattacaggtgtgcgccaccgcgccggggccctcttctcttctttcagcagacggcgagcagccaaaccctgaggggacccggtgtggcatcagtgattcaaaactagtcacaaagtaaggtgttctccaaggaggcaggatgggtactagcagtgccctctgacgaccccttaagaacacggcacccacattcagcaggtggagtggctgtcagctctgtggtcctcagaagggtgtgtgagcctggattgcgccaggagcttgatggtttgcaaggacccgtgaatatctgactggggtcgacaggtcagggtaggctgagaatctgcatccctgaggtccccatgacactgaccctaccagcacgcggtgcactctaggagcccacattagatttaagaggaaggggagcaggtgcaaaggaatcactcgagctcctcactcagacgggagcctgggagaggccgttcctcactcagacgagacactggcagaggctgtttttttttttgttttttttctggacagagtcttgctctattggccgttggagtgatctcggctcactggaaactccacctcctgggttcaactgattctcctgcctcggcctccccagtagttgggattacaggcgcccaccaccacgagaactcggttcttttctccctgctcacacgagaggctgcccacaccgcttctctcaagcaagccagggtgtttaggagatgaccttgagcaggtcccgaagtgcatctgggcgggcacaccccatctcaccacccacacgtactcgctggcaaactgccggccttcttgtagcttctgcagttcccggggcagcgggctctggcagtgtctcctccaccggcagagcagcacaggctccaggctcggccaccacacctatggagagagcaccagcacacagatgagggtggctgagatggacacacctccgctgccccagccatgacaagcccccagtgctcctacaggccactacaggcccacactcgccctgcgctctggaactccaaagccagtattttttacgtcaattaaggctcaaagcagttccatgaggcatttattacccacactcatggaagacgtggaatttggagaaggaagagcctggcctaacgcaacagtgaagggaccacactcccctgagctgggaacgaaacagtgaagggaccacagtcccctgagctgggaatgaaacagtgaagggaccacactcctctgagctgggaacaaaacagtgaagggaccacactcctctgagctgggaacaaaacagtgaagggaccacactcctctgagctgggaacgaaacagtgaagggaccacactgccctgagctgggaacgaaacagtgaagggaccacactcctctgagctgggaacaaaacagtgaagggaccacactgccctgagctgggaacgaaacagtgaagggaccacactcctctgagctgggaacaaaacagtgaagggaccacactgccctgagctgggaacaaaacagtgaagggaccacactcctctgagctgggaacaaaacagtgaagggaccacactgccctgagctgggaacgaaacagtgaagggaccacactcctctgagctgggaacgaaacagtgaagagaccacactgccctgagctgggaatgcctggtccttggatgccctcagctgagaggtggcgttctaaacaccgaagagttcatttctcacgaattccaccaactgagctacaactcggtgcaaatgcagcctgcttggggagctccctggggaacatgccgtgctgcggagaaaaaggccctcctgtccctgatgaccgagaaggaagggcgacagctgtggtcttcaggactaagtgagccgccagggaagtgagggaaatgctgccctcctcccactctcgggaccctgggctgctaggggagcctgctgagctctggcgggagctgaggtgaagtctctgctccgaagtcccaagaaagcatagtcaggcgcaagtgggccacagtcatgctctcgtgacggggcacaggcagccaccgtacagcctccagccagtgcacaacccaagaccgtgaacaaacaagccctgcacccctgtggacatgaaggtgcccgtggggtctgagtggggtccacaggggagaagtcctgcgggtgccatggtgacggcggtgggggcagggacggttctgggaactcaggatgtgcggccctcatctgctatgagctggcatctttaactgtggcttccatgtctcctgatgcattttccctgagatggtaacacccgtgatggagacgtgctgcagagatgccagaggcagctgtggagtctcccactcatccccaaaacaaaacaccaaacaagacagctgacccaccagagcagaggtcaaaattaaggggcatttcgtctggcacttggccagtatgaagtcgaccatcagggaggggtctctgctccgcagacaggcgttcaggaggccctgcaggagagaacgcagcaggaggtcagcggtttgtgaggacccacaactagtagagtgaaggaactcacaggaagctgacaggaggatccacccacggcgttctgagaaggccacgagaggggctgagggagcatctcaccctgaagaagtgggcagtgatgtcctgtgtcagggcacctccgtgggagcagaagtttctctgcaaaagagttcaaggcaggtaagaaaagcccacaggaagagaggcgagaccaacatgcagagtggctgctgtggattcagttttgagaaaaacactcgctaaggcttggcgtggccaccatggatggtgctcctgggctgaccgggcctggcgccctggctgtgctgtcctgaaacttaacggcttccctgggcggccagatcctgcagcccaccagctctggcccaaacagtcttgtaggctccaggaagaagccagggaggcacaagcagccgcagggaaggggacgcacccggagcgtagaactgtggtgaggacgacactaataccaagggccaaccatcctctggtcccttcactaaccaagtgctgtctatggtgttttcctgtctgtcggctgtcacgtgccaactgagagctttctgaaaaacagccattcataagaattcaaaggagaccatagtgattttctgaaagcttttgctagtctcacgtcctctgctttccttgtcacattttgaagtgctgcacaaggccgggctcacacctgtaatcccagcactttgggaggccaaggcgggtggatcacgaggtcaggagttcaagaccagactgaccaacatggtaaaacgtcatctctactaaaaatacaaaacttagccggtcatggcggcaggcacctgtagtcccagctactcaggaggctgaggcaggagaatcgcttgaacctgggaggcggaggttgcagggtgagccaagatttcactgctgcactccagcctgggcgacagagcaagactctgtctcaaaaaataaataaataaataaataaataaaaatataaaatgctgcacagctggcatggaacctgaattccatctctcacatttgtgcatcttcaaaaacaagaaaaaggccttcgggagcagaagctgctctctgtagagtgggaggggctggtatccgtctccccagctctgaccaactgggtccctacgctgcccgtccccacagcgagtgtcacttctttttatttgagacaagagtttcgctctgtcacccaggctggagtgtagtggtgggatcttggctcagtgcaactctgcctcctgggctcaattactcctcctgacccagcctctcaagtaggtgggagtacaggcgtgcaccaccatacccagctaatttttctattttttgtagaaacagggttttgtcatgttgcccaggctggtctcgaactcctgggctcaagtgatcccccacctttccagagtgctgggattacgggcgtgagccaccgcacccagcctgctggttaagatcaccctgcaactcacgctgggcagtgtctaaaatggaagataactgggctgcctggcaggcaacagcggtagtcagatcaccacaaggctttttttacacatgaagcatgttgagattagaaataaatgaaccgaggtgcgtggcacacaaaatggtctgtacgattccatgtgtcaaaatcattaaaacttgagggaaactaaaggaactcaaacttgggagaaggcaacctacagctggtttggtgatgtgctggtcgccgtcctggctgtgggtggggtcctccctcacatggcattccagacactgttccctatttgactttgaaccctttcctcagtaattcacacggtcagtacacgcatggaggctgcaagagctgctgttagcgccacaggcactgacagatcggacggacacgtgcacacggggcacctaccatctcagagttgaccaagtggaagaactgctcgcatctggcagtgatgggctgttctgcctggaagctgctgccgcagaggacagacgaaggcaggcggaggaggatcctggaaagaaggggctgtattggtggcgacagcacagcgtacactctgctccttcccaagggctcagactctcagagcagcaaccaccaccctgaaacccagggccactgttggaaccagagccttggcctgtgtccctctgtcccatccaaagcctgcactctgagcccacctcccctatactgtgtttggcccactgcattcaaaatgtgttaccaaacaaacaacttttaacagttacataataaccaacaacttctgacagttacacgataaccaagtggatgacgcaccagtctgtctagtgaagcaattccctatgactgtaaaattaaatgactccacgctgcttcttataaatgcagccgccgtgggcatttctgaacacttttccctactttcacaagagctccttctgcgacgtccctccacgtctgagcaggaaggttttgttgttgttgttgagacagagtctcgctctgttgcccaggctggtgtgcaatggcgtgatctcggctcactgaaacctctgcctcccaggttcacaccactctcctgcctcagtctcccgagtagctgggattacaggtgcccgccaccacacctagctaaatttttttgtattttttttgtatttttagtagacatggcgtttcgccatgttggtcaggctggtctcaaactcctgacctcaggtgatccactcacctcagcctcccaaaatgctaggattacaggcatgaaccacctcgcttggctggaaggttttaatcaaaagtactttcaaccctccagatcctcttctccgtggcatgtgccacagaaatggacaggcttggggtggggacacacagacaagtaagtaacgggaaacaaactcactacaaagaacctctaggaccgtcatgagatgctgccctgcccaggtggtgctgccctgcccaggtggtagtaggtgttaccgtttgtacattagcagctccctctgtctctgaaggctggcagccacgctccacccgcttgtcagagcctggagccgtctgcggaaaatctcaaagaggaagtgctcctgggaaggggtgtggccgagaggcactatgaggtcttgctgcagctccaggtcagctaccatctcctgaaaaagagcagtatgctggcacaggaaggcctcggggctcactgcccagccagtcggggacccagacgtcaggggtcagggagaggtctccacagtggacagggcaagaaggaacaagtggggcaagctatttcaattggaaatcactttgaaattgcaaatatagaacagtgcaggccgggtgctgtggctcacgtctgtaatgccagcactttgggaggccgaggcaggcagattccttgagcccaggagttacagtactacttatcaactacttatcaattaagaaaaaacagctgggcgtggtggctcatgcctgtaatcccagcactttgggaggccaaggcaggaggatcacgaggtcaggagatggagaccatcctggctaacatggtgaaaccctgtcgctactaaaaaatacaaaaaaattagctgggcatggtggcgggtgcctgtagtcccagcgactcaggcggctgaggcaggagaatggcgtgaacccgggaggtggagcttgcagtgagcccagatcgcaccactgcacttcagactgggcaacagagtgagactccgtctcaaaaaaaaacaaacaaaaaaaaacagccaggtatggtggctcacgcctgtaatcccagaactttgggaggccaagacagatggattacctgaggtcaggagtccaagaccagcctggccaacaaaattagccatacaaaaattagctgggtgtggtggcaggcgcctgtaatcccagctaatcaggaggcagaggcaggagaatagtttgaacccgggaggtagaggctgcagtgagccaagatcccgccactgcactccagagcaagactctgtctcaaaaacaaacagacaaaacaaaacaaaacaacaacaaaaaaaaacagcaggaggacactcatgtgcccttcacccagattaacctctggctaacattttaccccacacatcatttttgcctcacaagtcttttgttgttgttgttgttgttaggacagtctcagtccggttgcccaggctggagtgcggcagtgcagtcttggcttatggcagccttgactctcgagctcagctgattctcctaagtcagcttcctgagtagctgggactataggtacacaccaccatgcttgactagtgttttgtatttttagtagagatggggtttcaccatgttggccaaactggtcttgagcccctgacctcaagtgatctagccacctcagcctcccaaagtgctgggattacaggcataagccaccgtgcctggccggctgtattttttaaagaagaataaagatcaggtgcagtggctcacgcctgtaatccaacaattttggagaccgagatgggtggttcacttgggcccaggagttcgagacaagcctgggcaacatggcaaaactccgtctctacaaaaaatcagctgggtgtggtggcgcacacaggtgcacgctgtcaggattgcttgagcccaggaagtcaaggctgcagagagatatgatcgcaccactgtactctagcctgggtgacagagcaagaccctgtcccaataataataataattatgattacaattaagaggaaaaagcagatggtctcactgagaaggagccaggtgggtctagggaaagcatctggctaaggagttgggaggccccagagctggcggagggagagacaggggcctggcacagaagacgcacgggtggccagcaccagtaaatgcctgttgactgacagtgaacccacacaggtacatgctgcctacctgtatagacttcaggtgatccaccagcctcggactcccaaagtactgggattacaagcctgagccaacaataaatatcttttttttttttttgagacggagtctcactctgtcgcccgcccaggctggagtgcagtggcacaatctcggctcactgcaagctccgcctcctgggttcatgccattctcctgcctcagcctcccgagtaggtggggctacaggtgcccgccaccacgcccggctaaatttttgtatttttagtagagacggggtctcatcgtgttagccagcatggtctcgatctcctgactgtgtgatccgcctgcctcggcctcccaaagttctgggattacaggcgtgagccaccgcgcctggcaataaatatcttaatagcacgcggcttaaatgaagtgaatgcactgagttgtggcaccctcaaactcacctgcaatctggaaataatatcctcatttcctgtgcggccaccaaagaccaaatcagaattttctgagtggtcataactccttgagctgaaatgaaaatacaataaaatcctcctcagtatcgcctaatagtgctgaagttcccagttctcctcctgcctccggagctgagtgatggctgtgcttctctgacagtgtgaccctcacattagtcaacaataaacaacaaaaactgccacaaaatactaccaaccccaacctaggaaatacaaaaattatgtaccatgaccaaggaggcttatcccaagaatgcaaggatgtgggtggcaagccacccaggcaccaaggcaagagacagaggacacgagctgttccagtataataaaatataaaacaagaatagttataccagatatagatcttagatatgattacatatgaatatcattaatcattagttggtagcaattactttttattccaatattatgataatcctcactcaataatcatagcctaggaaaaaccaggccatacagagataggagctgaggggatatactgaggtgtgaccagaagacaagagtgcgagccttctgttgtgcccggacagggccaccagagggctccttggtctagcggtgatgccagcgtctgggaagacgcccgtcaccaagcggatcgtggtccagcggtagcaaaaggtgtcaaggaacaacacccactacttagcagaccgggaaagggagtctccctttcccccggggagtttagagaagactctgctcctccacctcttgtggagggcctgacatcagtcagactcgcccgcagttatccggaggcctcaccgtctccctgtgatgctgtgcttcagtggtcatgctcctagtccaccttcatgttccatcctgtacacctggctctgccttccagatagcagtagcaaattagtgaaaatactaatagtccctgatatgcagaaataatggcgtaagctgtctttctctctgtctcctctccctctctgcctcagctgccaggcagggacgggccccctgtccagtggacatgtgacccacgtgaccttacctatcattggaggtgactcacattgtttaccctgccccttctgccttgtatccaataagtaacagcgcagcccgacactcggggccactaccggtctccgcgcattggtggtagtggtcccccgggcccagctgccttttctcttatctctgtcttgtgtctttatttctacactctctcatcgccgcacacagggagagacccaccgaccctccggggctggtccctacacaaggatagcttaagatccccaaaccaatataacgcagttatcaataaaataaaaagcaaaaaccgtaagattatctcaatagatgtagaaaaagcacttgacgaaatgtgacatccttttgtgataaaaacactcaatcaaccaggaacaaaggaaatcttctcaatctagtgcctggcatggatgaaaacccacagcaaacgtcagatttaatgaggaaagactgaaagctgttctcctaagatcaggggcaacaaggatgtcctctctacactcagaacagtgtcgctgcctctactcaacactgcactggggacagacacggtggctcacgcctgtaatcccagcactttgggaggccgaggcaggcagatcatctgaggtcaggagatcgagaccatcctggccaatgtggcgaaaccctatctctactaaaaatacaaaaattagacgggcgtgttagcggacgccagtaatcccacctattgggaggctgaggcagcagaattgcctgaacctggaaggcggaggttgcagacagctgagatagtgccactgtactccagcctgggacacacagcgacactctgtctcaaaaacaaacaaacaaaaattagctgggcatggtggcgggtgcctgtaatcccagctactcgggaggctgaggcaggagaatcgcttgaacctgagaggcgaaggtttcggtaagccgagattgcaccactgcactccagcctgggtgacagagcgagactccgtctcagaaaaaaaaaaacaaaacaaaacaacaacaaaaaaaacaacactgcccggggagttcaagccggggcaattcaacaagaaaaagaaaaagcatccagataggaaaggaaaaagtgaaactatctctcttcacatattatatgatctttcttttgtttttttgttttgagactgagtttcactcttgtcgcccaggctggagttgcagtggcatgatctcaactcactgcaacctctgcctcctgagttcaagtgattcttctgcctcagcctcccaagtaacggattacaggagcccaccacgatgcccggctaatttttgtatttttagtagagatggggtttcaccatgttggccaggctggtctccaactcctgacctcatgatccgcccacttcaccctcccaaagtgctgggattacaggcatgagccaccatgcctggccagacacgatcttatatatacaaagccctaaggaatcgatacaaaaacactcttagaactaataaatgactagagccaatgaatatacaagaatcactggtgtttctatacgttagcaacaaatgattcaaaaggaaagaagactcgctatcactgagatggcaatactgccccacatgcagtccgtatcagggtcccagctacttttgtcgaaactgacaagctcatcccaaaattaagacacaactacaaagcacctagaaaagccaaaccatcctgaaaaagaagaaccaagttggaggcctcacacttcccaattttaaaacctactacaaagcttcatcccaatgacgcagtgcatatggacatacagaccaagggaacacaatgagagccagaaacaaaccctcacacgagcagccatctaacttttgacaagggtgccaagaccattcagtggggaaagaagtgttttcaacaaatggtgctgggacaactgcatggccacaagcaacagaataaagctggatgacctcacacaacaattttttttttttttttgagacagtctctcactctgtcgcccaggctggagtgcagtggcacaatctgggctcattgcaacctccgcctcccaggttcaagcaagtctcctgccgcctcagcctcccgagtagctgggattacaggcgcctgccaccatgcctggctagtttttgtatttttttagtttcgccatgttggccaggctggtctcgaactcctgacatcaagtgatctgcccgcctcagcctcccaaagtgctgggattacaggcgtgagccaccgtggctggcccaaaatgttttctgatccatcaaaatgaatcaaaatcctaaagagctaaactaaaaataaatgatctggactttataaaaatttaaaacctttgtgcattaaacgatactatcaagagagtgaaaaaagaattaacagaatgggaaaaaatatttacaaatcatatatttgataagaactttatctaaaatatataaagaactcatacaactcagtaagacaaatacagtcatgaactgctcaatgacaaggatccattctgagaaacacatctttaggtggtttcatcacgtgaacatccaagagcacagacacagaccagagccccccgcacacctaggccacacggcacggcccaccgcacagacacagaccggagccgcccgcacacctaggccacacggcacggcccaccgcgcagaaacagaccagagcccccgcacacctaggccacatggcacggcccaccgctcccaggctataaaccggcatagcatgtaactgtattgcatgccgcaactgtaacacaacagtatttgtgtatctaaacatagaaaaggtacggtaaaaacacagtttaaaaaaaaggtacaaaaaattatggctatgtgggattactgtcatatatgtggctcgttgttaaccagaacattcttatgcagtacatgaatgtgacccagttttcaaatgggctaaggatgtgaacagatttctccaaaaaaaatctaaaatggccaataagaaaatggaaagatgttcaaaatcactacccattagggaagtgcaaatcgaaaccactatcaaatagcacttaatacccactaggatggctaccatcaagtcaggcctggcagaggttcacgcctgtaatcccagcactttgggaggccgaggcgggcagatcacctgaggtcagaagttcaagaccagtctggccaacatggtgaaaccccatctctactacaactacaaaaatttgccaggtatggtggtgcctgtggtcccagctacttgaggggctgaagcaggaggatcacttgagcccaggaggtcgaggctgcagtgggctgcagtcactgtaccccagcctgggtgacaaagaaagacccagtttcaaaataaatataaataagacaaagtaagactatctcaaaaaacaaacaaacaaagtgaatggataaacaaaatatggctgatctttctgttccgcagtgagcagctctgtgcaaacctacccataaaggctggggaagctggaaggctgaagagaggctgaataatccagtttctcagacagaaacgtttaaggacttacagacagaaaccatgtctcaggcagcctagagagacgatgcatccctgcactgttacccccaggcagggcttctataccacagggaaggactattgaagtcaacccctcagggaaaggcaagaatgctctgtgaatctaaccgctggatttatggtggaagatttgcttttttgttttgagatggagtctcactctgtcacacaggctggaatgtagtggtgttttcacagctcattgcaacctctgcctccccggctcatgcaatcccacctcagcctcacgagtagctgggaccataggcacacactaccatgcctggctaatttttttttttgtctagacggtttcaccaggctggtctcgagctcctgagctcagatgatccgcctgccttggcctcccagtgctgagattccaggcatgagccactgcgcccagcctcaaggttgttttgacctaagagtgggatttaaggtaacagcagataaatgggaaatctcaggaggcattcttggagtagggttaacaagaagtcacccacgatggaggtgcgtcagcctccataccttctgtgagcatcagtcagccataagaaggaagggtatgctgatatgtgctacaacacagatgagcctcagaaacattctgctcagccaaagaagccagacacaaagggccacatactacatgattctgttgatattaaacatcccaaacaggcaaatccatgaacataaaatggattcgtggttgccgcaggcaggagacatggggggaagctgcatacacacttgccatctgtactgaatgctgcagctgtaacacaacagtgtgaagctgcaaacaagagcccctggggacaaagcctggacagccccaggtacactccgtccatccttctggcccacatgcaacacctcaggaactgctctgtcctgagaatccctctcagatggagagaggctgtgatgcccaggatctactaggccatttgtgccgtgcttcacacatgctcaccttgaataccaggtgacagaacagaaaaacaacgttgttgctatttttatcttttttttgagacagagtcttgctctgtcgcccagtcggctcactgcaacctctgcctcccaggttcaagcaatcctcctgcctcagcctcccaagtagctgggattacaggcacccgccaccacactcagctaatttttgtatttttagtagagagggaggtttcaccatgtaggccaggctggtctctaactcctgacctgaggtaatccacccacctcagcctcccgaagtgctgggattacaggtgtgagccaccacgcccagcccgaagttgtcgcttctgacaagtctatacacataaagaaacaaccgatgcaggaagcttggctttattttgtattgacatagatttgctatgtgataggctcaagtgtactttgcataccaaaattggactgagagaaaaatgcattcttagaactaccatgattaaaagtaaggcctcatcggtgtgtgatggttaatactgagtgtcaacgtgactggactgaaggatgcaaagcattgatcctgagtgtgtctgtgagggtgttgccaaaggagactgacatttgggtataggctgggaaaggcagacccaccctaagctaattagatgggcaccagcatggccagaaactcccctttatatatatcctattagtcctgtccctccagagaaccctaatacagtgtgtgctgctaacctttggtggaaatccatcagtgcgttgacaagaatggtacacgcagcctgcaggtctccgtcacagccccctgaagccgaggactcagggagaaagtgctcatggatcgcccactggtggaagtcctgcctagaacagcaaacactgctatcaattctgagaaatgcttcgtggccagcggttccccataaccagggaataggcccatagtaagggacacacagcactagtgagagctgggttgagactggcggctcgggaccttggagtagggatgagacctcactgtctgcagggtgggatgcctggggatgtgggaaaggcctggtctcaggagtgacctttgtgaccccaccttccacggatcaaaggccactcaggatgacatcccacggggtaactgctggccacacagcacatgagcttggtgaacagaataggcaagcacaaaaatgtaggctggggcaggtgcagtggctcatgcctgtaatcccagcactttgggaggctcaggcgggcggatcacgaggttaggagatcgagaccatcctgggtaacacggtgaaacctcgtctctactcaaaatacaaaaaattagccgggcgtggtggtgggcgcctgtagtcccagctactcaggaggctgaggcaggagaatggtatgaacctgggaggtggagcttgcagtgagctgagatcatgccactgcactcctgcttgggcaacagagcgagactccgtctaaaaaaaaaaaaaaaaaaaaaaaaaaaaaaagtagcctggaaagtcacctgagggcacctgagctactcacaggcccaccagaaggggatggtgaagcaacctgcatccagactgtggactctgtggatacggatgggaaggggctcaaggagacactgactcaaaactgcagtggctacacctgtaatcccagcactgtgggaggccaaggtgggaggatcacttgagcccaggagtctgacatcagcctgagcaacaaagggagaccccattcctacaaaaaataaaaaaattagctgggcatagtagtgcccacctgtggtcccagctactcaggaggctgaggcaggaggatcactcgagctctggagagggaagctgccgtgagccgtgagtgcatcactgtactccatcctggccaacagagtgagaccctgtctcaaacaaacaaacaaatccgcagtgcacagaaccatcaataccgcaatccatttatgcagaaagagccacaaccaggaaaacgctccacacgaccctgcaaatgtgagtgctagggagtgtgtgctctcctcacactgtccgggactggggtgctccacccacgctgtgcgggacctgggtgctccacccacgctgtgcgggaccggggtgctccacccacgctgtccgggaccggggtgctccacccacgctgtccggaactggggtgctccacccacactgtctggaactggcacagaatgtatctaagtatcacttaagtaattcagaaaagaaagaaaatcccgcaacacatctcaacacaacttccacgcagcggtgacctgatgcagcatgacctcatgcagcagacaagcccctccctctgacctcctccttagactccaccccagagagcagccgggaggagaaacgggggtgagtgaaggaagcgcctgcagagcgggcttggcacgacctgaaccatcagcacgtgttttgccgcaggcagcagcgagttttctttttgtggcccctatgttttccttttcctattacttccattggtttcatccagaatctgataccaggatccaggtgcaggcgacagtgctgcatgtgcctggaaggcccctgatggccggaaggacgaggagcacagggtggctgttgccaaccctctcctgagtctaggtgtggcaggcaccctgaggcccatatacccaccaggatactccatatctgcagtgaccacattcccctctccctgacctccaccctaaactccacacccttaaacccaacggtcctctgggctccctactcctatgcccagaacagcacatctggcctctcaaatagtctcaaatggtctcagtcatcagccctgggactcatgggggttcactgcttcatttacccacttcttggtgcccccaagtcaaggctggcatcactcctcaaagtctgcaccacctgctccacaccagcctctgctcctgcctggtcatttcctctcacacggccctgtctgttatctccagggctcattcctacctttaatccacttctgtatctacctgtgtgttgccagggcctggacacaggtgtacagctcccggacagcagccatagcccagccagggtagggtgaagtctaagtgggtgccttatacgtgccacatctgccctcattgatacaaaggtgccatatgggcaggcttgtttattcccctctatactccctgcttctagaacactctagaattgtctgccacatggtaggagctcagtaaatgtttcttaaataaaggaataacaaccgaaattgggcaacctggccaggcgcggtggctcacgcctgtaatgccagcactttgggaggccaaggcaagtggatcacgaggtcaggagattgagaccaccctggttaacacggtgaaaccccgtctctaccaaaaatacaaaaaattagctgggtatggtggcgggcgcctgtagtcccagctactcgggaggctgagccaggagaatggcgtgaacccgggaggtggaggttgcagtgagccgagatcgcgccactgcattccagcctgggtgacagagcaagactctgtctcagaaaaaaaaaaaaaaaaagaaaaacagaaattgccaccgcgtggaagctttactttcgcttttgctttaataaatcttgccaccgaaaaaaaaaaaattgaaattgtgctcaaagattaacaggtaaaccaaacattaaattgaggataaaatgacgaaacataggctttaaggcaatgtggaaaaccgtgtaacattttaaagggaagctcctttttcttttgagatagggtctcactccgttgcacaggctaaagtgcagtggtgtgatctcagctcgctgcagcctctacctcccaggctcaagcaatgctcctgctcagcttcccaagtggctgtgatgactggaacgtgccgcatgtccggctaatttcttttctattttttgtagaaatggagtttccccatgttgcccaggctgacctcaaactcctggattcaagagatctcctgcctcagcctcccaaagtgctgggattataggtgtgagccatcatgcctggccagggtagctcttttcaacacttaccgttcagtatctgaaagagcatcagcttcaggttgaatttccagctccaggtgtaaccagtcttggtaagttaactgagaaagagagcaagcaattcaatacaatgaggacagaacacacaatccaccgacaggtttataaaccagtttgtcatttcatctcatacgcagtcctccatgtccctgtgttataatgaaattgcagctgagagttccacaggaaagaaaccttagttttatcaagaatgatttcttacaggatttccctagcacaaagatgttagtactgtaatccttctttctaagtataaaacggctattttagtctgggcaacatagtaagacctcatctcatttaaaaattacctgggcacggtggctcatgcctgtaatcccagcactttgggaggctgaggccagcagattgcttgagcctaggagtttgacaccagcctaggcaacatggtgacaccccgtctctacaaaagatttaaaaatcagccaggtgtggtggcacatgtgtgtggtcccagcctcttgggaggctgaggcaggaggatctcttgagcccaggaggtcaaggctgcagtgagtaacagagtgagaactatctataaaaaggaaaaaaaaaaaaaagaaaaaagaaactaacaaaacaacaacattctacagctattcacagtagcataccttcatttatttttggaaacaggttctgttgcccaggctggagtgtgtgcagtggtgcaatcgtagctcgctgcagactctgcctcctgaactccagaattctccccctcagcctctcagatggctgggactgcaggtgcacatcaccatgaccagctaagttttttaaaaacatttttaggaggccgagcacggtggctcatgcctgtaatcccagcactttgggaggccgaggcaggcagatcacgaggtcagcagattgagaccatcctagctaacacggtgaaaccctgtttctactaaaaatacgaaaaaaaaaaaaaaaaagggttgggcgtggtggctcacacctgtaatcccagcactttgggaggccgaggcgggaggatgatgaggtcaggagattgagaccatcctggctaacacagtgaaaccccatctctactaaaaatacaaaaagttagctgggcgcggtggcgtgcacctgtggtcccagctacttgggaggccgagtcaggagaatcccttgaacccagaaggctgaggttgcagtgacccaagattgtgccactgcactccagcctgggcaacagaggaagattccatctccaaaaaaaaaaataataatttaaaaataataaaataatttcacaaaaggcttggcacagtggctcacacttgcaatctcaacatattggcaggccaaagcagaaggatcactttttcctatttttagtagagatggggcttcatcgtgttacccaggatggtctcaatctcctgacatctcagcctcccaaagtgctgggattataggcatgagccactgtgcccagccaccttgaaattcttttctaaagaccaaaacaaccaggcaaacatcctcagaaataaatcagtaccaaggcacactggtgagagcaatgccagctccagtaaccaggcacacatgggtgagcccagagaccctgagtgaccaccacacagcctggcagacatgtttaaaacaagttcccaggggccgagcgcagtggctcacacctgtaatcccagcactttgggaggccaaggcgggcagatcacgaggtcaggaggtcgagaccagcctaacatggtgaaaccccatctctactaaaaatacaaaacttagccaggcgtggtggtgcgcgcctgtagtcccagctacttgggaggctgaggcaggagaatcacttgaaccagagaggcagaggctgcagtgagccaagattgcgccactgtgccccagagtaagactccaccagaaaaaaaaaacaaaacaacaacaacaacaaaaaacaagttctcgggcgcaatggctcacgcctgtaattccagcattttgggaggccaaggcgtgtgggtaatttgaggccaggagtttaagaccagcctggacaacatggtgaaaccccgtctgtactaaagataccaaaattagtcgggcgtggtggcaggcgcctgtagtcccagctactggagaggctgaggcatgagaattgcttgaacccaggaggcagaggctgcagtgagccaagactgcaccactgagcacagcgagacgttgtctcaaaaaatatatcagtaaaaataaaaaaagaagttcgtgttgggagaaactgagaaagtatagcagggtttctctgtatttattaatatatttttttgagacagggtcttgctgtgtcatcctggctggaatagagtggcgtgatcttggctcactgcaacctccacctcctgggctcaagtgatttctcttgcctcagcctcccaagtagctggaaccaaaggtgcacacaactgtgcccagctaatttttgcattctttgtagagatggggtttcactatgttgcccgggctggtcttgaactcctgagttcaggtgatcaacccgccttggcctcccacagtgctgggatcacaggtgtgagcaccgtgcccagtatctgtataatttcttaagagctgcacatgaggccacaacgattttagtcaagattccaatcaaaccatctaagtgctgctgttcttgcctctgaggagacagtcggcacacgcaccctagactcgagacgaggagacagtcggcacacacacaccctagactcgggacgtggcatgatgcaggggaaggaacggtcacctacgtgctgctgttcttgcccgaggagcacacacaaaccctagactcaggacgtggcatgatgcaggagaaggaacggtcacctacgtgaacatcttcctctttcaacacctctcggaaggttctgtgtgtccagagagagagggcagctctctgccagtctgcagaaggaaggtgcaagggtctccaggaaaggctggctacgtcctcctcagaaagaggctgtcgggcctctgagaacaatctgaacatgaggaactgaaactgaaacagagagtgacccggccgtttcttcattgcgcaagtttcactgtgagtggctgagcaaatgctcaggtggaaacagaccatcaacagcccacacacacaaccccacattcagaggacctcagtccagcccctgggagggcgcaatacacgaccccacgttcaggggacctcagtccagcccctgggagggcacaacacacaaccccacgtttaggggacctcagtccagcccttgggagggcacaacacacaaccccacgttcaggggacctcagtccagcccctgggagggcacaacacacaaccccacgttcaggggacctcagtccagcccctggaagggtgcagagcccctcagcgatcatggctgtgcacagtgctccagggaagagcctatgtgcagaccttcctgccatctgactgcttccttgagctaaatgtctggaagcagaattgcaggaacaaaactgcctcccaggggtagggctggtttggtcccgggcagtgaaacagcccatctctaggcctctgccaggaatggcgttcccaccaaaaatgcacaccaactggacaagccagacacactattggtgctgcgtgaccgtgtccatctctgcccccgaggagatgagagcctcccatgtttataaccagcctgctccaaggactgtcgtccctgctcagcatgctgggtgggaaccacgctgccctctcctaagctcaaactccatgttttctttaaaaacttggcaccagggacaaagttcctcagaggaaataactggaaatacgtgcaccctggatcctcaggggctgctcccagattctgacttaatttatctggaaaggggccaggaatctatagtttcaaaagcttctcagttgattctaatgtgaagcctgaagttgaaaaccattatttatttatttttttttttttttgaggtggagtctcgctctgttgcccaggctggagtgcagtggtgcagtctcggctcactgcaacctttgcctccctggttcaagcgattctcctgcctcagcctcccaagtagctgggattacaggcgtgcgccaccacgcctggctaatttttgtatttttagtagagaccaggtttcaccatgttggccaggctggtctcgatctcttgacctcatgatctgcccgcctcggcctcccaaagtgttgggattacaggcatgagccaccacgcccagcctgaaaaccactattttatacacgagacgttcattaaaatcctataaaaggacaacactggtttgcagtgccatttcacctttacttttgacattcagggtttccaatgctcatctttaaattcctttgtctgggccgggcaccagcggctcacgcctgtaatcccagcactttgggaggccaaggcgggtggatcacttgaggtcaggagttcgaaaacagcctggccaacatggtgaaaccctatctctactaaaaaacatacaaaacaattagccgggtatggtggcacgtgcctgtaatcccagcaacttgggaagctaaggcaggagaactgcctgaacccgggaggtggaggttgcagtgggccgagatcgcaccactgcactccagcctgggcgacagagcaagactccatctcaaaaaaaaaaaaaaattcctttgtctgaacaatgtaaggaacatttactagatgagaggaataagaattcttctttccagggaaagatacttattatgaatactgatcttttaattcatctatcctataaatgccaacatctatttcattacaattacagacttgtagttgtcttcatacaacttcactttacactcagagaacacaaggaaaggcagcactcagcagtcaggctgcctaagcagacagcagaggtggccatgacagccagcctgactcaggagctgccccatgacagccagcctgacccaggagctgcccctgagatgggcacaaagcggcagcagacctcggccttccggtccgaaagctgcgtaaacctgaaacgtatggcagaatggaaaaataggaaaagagtgaacctacctttttaataaggcctggagataagcagctgcacaaagtatctcgtgactgggaagaaaacttgcagagagagtaagaaattgctgctgtacaaaatctgaaaacagaaattataacatataaatgtaatccatacaaaataagggatgaaggaaaaagttactttgaatttcataaaactgaatttagtgcattccgaactggatggcctgagcattggtccttcgttttttggttcgtttgttgtgagacagtcttgctctgccgcccaggctggagtgcagtggcaccacctgggctcactgcaatctctgcctcccgggttcaagcgagtctcctgcctcagcctcccaggtagctgggattacaggcatctcccaccatgcccagctgattctgttgtagttgttgttagtgctttttttttgagagggagtcttgctctgttgccaagccggagtagagtggtgcgatttcggctcactgcaccctccacctcccaggttcaagcaattctcctgcctcagtctcccgagtagctgggactacaggtgccagcctccatgcccagctaattttttgtatttttagtagagatggggtttcaccgtgttagcgaggatggtctcgatctcctgacttcgtgctccgcccacctcagcctcccaaaatgctgggcttacaggcatgagtcactgcaaccagtcgagtttttaattttttttagtagagacggggtttccccatgttggacaggctggtctcgaactgctgacctcaagtgatctgcccacctcagccactcaaagtgctgggattacagcgttagccaccgtgcctggcccagccctcggtttattttttgttttatacagggccttactctgatgcccaggctggagtgcagtcgcacaatcacagctcaggggatcacttaaacccagaagttcaagaccagcttgggcaacacagtgagaccccatctctcactagctgggtgtgtgggtgtgcacctgtggtctcagctactgggaggctgaggtgggaagatcacttcagcctgggggacacagtgagacctgtgtcatttactcaacatacatacctacagcaatacccatgtgaaaaattctcacttgtaaccaaggaagctcagaatgagattccatgaggcaatggagatgtcaaagcactgtcatggtgttcttacagttctaatacttctgttttactaatacatatttgagctgggcgtggaggctcacacctgtaatcctaactgaagtgggcagatcacttgaggtcaggagttcaagaccagcctggccaacatggcaaaaccccatctctactaaaaatacataaattagctgggcatggtggtgcacacctgtagtctcagctactcaggaagctgaggcacaagaactgcttgaacccgggaggcggaggttacagtgagccaagatcacgctactgcactccagcctggacgatagagtgagactctgtctcaaaacaaaaaccaaaaaccaaaaaacaaaaaaaaaaacaaaacacacaccaaatatatatttcattctccctttcttatgcaaaaagtagcatctgagaccgagttcagtattttgctttcttcacctggatatatatcctgaggcatctctgtgtttctaagagaggatggccctgtctcccccaagccacctggatgcctccctcctcaccagctcccaacttctccattggctgtgtgcctctcatgccaacacccagtactcagtgtttggggcctggggtgagtggggactgtctggtgtggccaagcgcctaggagggactctgtatccccggagtaccgagtgcctgctccccgaggcccatgtctgaggtgtgggatccgcacagctgccatctgactccctctccttgctccacgtacatttcttgcgcctcttctaagttctctgttattcagaccctgtcataatgtcagatctcccctttcccgcacagggtctccggcaccgcaacagggctctgtcccgacctgggctacctctgcccaagagaccagaagctacaagccaagccccagccagcaactcccaccagagtctcccagccctctgtcctggcttccgcctctgagtggcagctgaagggattctgtcctggcttctgcctgtgcgtggcagctgcagggagcccttgaggcactgagcagaccattcttaaccacagggtccttcctcacctcagcacatggccccatctgctgagccctagagaaacagcccgaggtgtacacactgggaagctactcaccatggggtgccgaagaacctgaccagagggagctggtccaaccaagggccagacaagggaccaagacaaaacaaagcagctctcaccaggacatcaaagaatgcttaacgatatagacagttactatctactattaatttcagcagtttagtataatatgatctcatttttatgaacaaagaaacaaacgcacgcatattataaacaaatgacagataaaattctggaaggatatataccaaaatgctaaaaagtggttatctttgggtggtatgtctgcatgtctgtctcttctaattttatcaaacgagcatgtgtcacttttcgagagagaggagagaagacgcgactgtggaagaagagctcacttcaggcagaagaacaaggaatccctcgtcctacaggtcaggaggctgtcaaagagcgcagggacaggaaggccagcaccaggtgcaggaggacccacatccacctctgggagcgcagacctggactcacccaggtgcacggccagggcagccaaccccagcacatgtggggcactcaggctcgggccctgcaacgagaatgagggtggcagagcagactgccctcttccaagctggaattttccagggcactgaagacgaattgagaagtagcagcctggccctcagagtgggcccccaagggtggcccccatgaaggagagcctcacctggtgacggagcagctggcagagccgggtgagcactgcagggagcacacgtccacacatggtcctcacgaagagggcagcccagggaccctgcctgcagagacagccgtgaaaccatcagtactagccattcagtcctgcacatccctccaacagctaatccaaccaccagcggccgaagaaagagccaagctgttccccaaaacagtggtctttctggaagacaacccatcttctgcagtgcttcccaacttctgctgcgtcctatttgatgaaactcagcatcgccgcatgctcctgcggagacgagctcatgagtccctggtctgcagacttggcccagcaagaggtggcacccagaggagccccaccactcagggagctgcccgcgccttcacctctccgggggagcgacactggaggcagccatcaggttctgacagaaagacgtcagcaggaggtccacagcctgcagagacacagttctcatgagcgtggtgtcctggggacgggagcagcaggaaggaagccggccagcgctcccgccacagacatcgcaattctgctttgcaaaaagacctccaaaacaggcttgtttggagggcatgttacaatgcaaactggtgcccagggcccccattccccaatcttgggaatagcagccctcaagtaatcgccaatcacaaaattctacagcagcaggcgggactggcaaaccttgtgtgtaaggggccagaaaaatattttaggttttggggccagaaacagcctctgtcgcatattctaaagaggcagtcgagcccaacctggtcaacatgatgaaaccctgtctttactaaaaatacaaaaattagctgggcgtagtggtgtgcacctgtaatcccagctacccaggaagctgaggcaagagaactgcttgaacccaggaggtggaggctgcagtgagccaagatcgtccactccagcctgggcaacagagaagactcagtcaaaaaaaaaaaaaaaaaaagaggccaagtgccgtggcttatgcctataatcccaacactttgggaggctgaggcagacagatcacttgacctcaggacttctagaccagtcgaggcaacacagagaaaccccaactgtacaaaaaatgcagaaattagccgggtgtggtgatgcacgcctgtagtcccagctactcgggaggctgagacaagaggatcacttgagcccaggatgtcaaagctgtagtgagccatgattgcaccactgcactccagcctgggcaacaaagcaagaccctgtctccaaaattaaataaataaataaaatgtaaaaggagctcttcatacacaaacagactgtggcagctgaccctggtacaccgctgcctggccctggaacatctgatacgacactaactgagcaagtcaaacagaaattgagagaaggctccatgcgtctaatgcctctgcctaatggaaaatggtgaagaccccctgctttgttctgagcccctacacctaccatgtgttcccgtggctccagtctcggcgtgttgatgctgagctgaatctttgatatctcaacgctgctgtcatcctcattgtggcccaggacagccctcagtctttcagaaatcactgccacctgtgccgatataactgcgaaggaagaaactagttagggatgacaagaaccccgaaaggagggatacagctgcggcctagagagctccgcctcccgtcaagtacgattccacggatcctgctgactgcacacatcccccagccaggtgctgaacaccagtgtttgttcgccccgcaggatttgcagccttgtggtgcagcatgtgtcatggcaaatggggccagacgccatccactaccttttcctgattggctgagagggggacatgttcattcaccaacatgaacctccccatctgaaatcccatgccagccctccagacaccacatctgcctaagcgcatgccagaggttccatgttggcccagggaaatgggccacacatagcccaactacatcatttaaaggtgaaaaccgctttgcttttagaaacaggactcacctgacatgtatcaacctcttgcttaagcactggaacttttcctccatgtcccccatgtaccacattctgcacaagccatcattgaatcaccggaaggctgcactcaggaactggcgcacttggtctgagtgaagaccgccaaggcgctgcagccccagctagcgctaaccaagctgtgttaacattgcctccatgcggagcttgcagtgagctgagatcacgccactgcactccagcctgggtgacagagcaagactccgtctcaaaaaaatatatatatatcacctccatgtaggccaggcacggtggctcacactgaaatcccagcactttgggaggccaacacaggtggatcacctgaggtcaggatttcaaaaccagcctggccaacatggtgaaaccccatctctactaaaaaatacaaaaaattagccagacatggaggcagtcacctgtaatcctagcaacttgggaggctgaggcgggagaattgcttgaacccaggaggcggaggttgcagtgagccgagatggcgccactgcactccagcctgggggacagagtgagactctgtctcaaaaaaaaaaaagaaaaaagaaactgcatgttctcaatccacagatgaacatttcttactctggattttacagaaaaccatcacatggaagcaggatcacagggcagagaccctgtgtgtctgatgtgacatcgactccggcaggcaggatgagcgggaaaacaggcatcctagtcacgcgttttcttctctatcatcattcgtcctactcagatgcaactagccgaatattcaccttctgccaagggtctgtgacagcttcagtaggactagccttccaccttgtctcaaaaaaggttccacacccgccagcccggggtcaatctttaaactactggactactaggaagacacaccagcctgatgtcactatggggaaaatggcccagccacagagctccaaccacaggctgcacacatgagacacagcatgagctcccatccatcctcaccatcacgctggctggggtctgtcatggaggctctcagctctcccagtgcagctgtgagctgtcccaggggctcctcagcagagttgggttctgccctcactcccagggctgcatctgtgagaagaaggaagaaaccagatggaaagacactcaacaggactcttcactgcaaaaatagaaacttcacacagtcaaatacagagctgtgaacttccaagctgctgtgtgtggcagacggagggactgggagtctctgaggaggtaaatgaggtgtcttccctgatgctggatgccacatcgaaaattacaattataaacgagtttcataaaaaattacatttataaacaagtttaagaaaaaaagcggttctgtgtgcaccatcaataccactccaccaccgtgagaagcatacacacggaagaaaacaaggaggatcgagggctggcgagggtggggacaggatcacggataggtgaccatttagtcccctggttcctcaaacttttttttttttttttttgagatggactcttgctctgtcaccacgctggagtgcagtggtgcgatctcggctcactgtaacctccgcctcccgggttcaaatcatcctgcctcagcctcccgagtagctgggactacaggcacgcaccaccacatccagctaattttttgtatttttagtagagacgggatttcaccacgttggccaagatggtctcgatctcctgacctcatgatttgcccgccttggcctctcaaagtgctgggattacgggcatgagccactgcgcccagccaccactttcaatataaaaaggaagatacgctgcatatgtttttaaagtaaaaaaccttcaagttctggggttgctggagaagacacaagcatgaaaatgcactgctatgcacagccacagccaaaatgaaaccagaaatcacaggctctagaaatcataggctctaggagtctgtgcataagcctcatcagacaaatgattagaaaccattctggaagccaccaaaagctacgaacaagtggaccccaggggaaggaggatcctgggggaaggaggacacctctcaagagaagcaaacgcctcacaccgcagggtacacagccctgaggcccctgtggcatccccagcacaactgagaggtcatgctctcagggtgggtcggccgggcatgggggctcccacctgtaatcccagcactgtgggaggccgaggcgggtggatcacgaggtcaggagattgagaccattctggctaacacggtgaaaccctgtctctactaaaaacacaaaaaattagccgggtgtggtggcgggcgcctgtagtcccagccactcgggaggctgaggcaggagaatggcatgaacctgggaggcggagcttacagcgagctgagattgcgccactgcactccagcctgggcaacagagcgagactctgtctcaaaaaaaaaaaaaaaaaaaaaaaaatctcaacgagcctccctggccctgcaggtggaaggggatctagaagagcacacaaggggctgggtacggttgctcatgcctgtaatcccagcactttgaaaggccgaggcaggcggatcagttgaggtcaggagttcgagaccagcttgtccaacatggcgaaaccccatctctactaaaaatacaaaaactagcaaggcgtagtagtgcgtgcctataatcccagctattacagaggctgaggcaggagaactgcttgaacccagggggcagaggtttcagcgagccaaaatcgcgccactgcagtccacagccacagagcgagactctgtctcaaaaaaaaaaagcccacagggaagcagcagcctcagatctatgtcttcagctcatagcggctcccacagggagatgctggcttctactggagataaagccacacacttcaagaaaaaccagcctcatgatggcatctcccactgctgcctgagtgcagcctttcacggattcccaatgagggcgtaggtctgaccgacagctgcaccactgctccccacaggccaaaagagcctgacttctactcctacctgcactgtgcaacagaaaagtgctgcatgacactccctacgacaggctcgagccagcgctgtgggccccaaggtggccgctgagagagcacccgagtctgaagcctgtacaaacacctcagtgcggcccacaggaagatgacgagtgacaaagtggggctgtgcactgcacacactcctttccggaaggtgctaagtgattcttcaggacccccaggtaagagtctgtgccacagctggcactgggcgtcagcatggtgggcggaccctgtacccaaagcaccggcttgagctggcacagccacccccgagctcactcgggtggtgtagcacaacagacactcaaggttaggaaaatggaaaagcacaagtcccagagtggacaagcggcccaggaacttaccttctggcttctcttcagcagcagagcaggcctggcagtaggtggagtacagagatggggggattttatctgctctggatcacaggaaaacaatacaattaagtcagctatggcttaaattaattcaagattacaatccccaaatctattataaaataaaaacatattaaatttaaataaattataaatactgtgtacagtatgagcctgtttttacaaaaaaatattaaaaaatatatatagatttaaaaagcactgtttcaaaatatatcatattaatcatatattaatatctaaggagctagaccacaaaataccaccagtgattatccctgggcagtgaaattataaattatttctatttctctcatacaatttttggtaatttccaaattcaaaacacgaatctttgtttttcttttttttttttttttttttttttttgagacagagtctcccactatcacccacactggagtgcagtggtgcgatctcggctcactgcaacctccgcctcccaggttcaagcaattctcctgcctcaccctcccgagtaggtgggattacaggcgcctgccaccaggcccagctaattttttgtatttttagtagagacggagtttcaccatgttcaccaggctggcctcgaactcgtgaccttgtgattcacctgcctcagcctcccaaagtgctgggattacaggcgtgagccaccacgcccagcaaaacatgaatctttgttaattttaatgattaatactaagaaaaacgtttagttcgtgtcattaaaaatatgcaaaattgggccaggcgcggtggatcccgcctgtaatcccagcactttgggaggccgaggcaggcagatcaggaggtcaggagattgagaccatcctggctaacacagtgaaaccctgtgtctactaaaaatacaaaaacaaaattagccgggcgtggtggcgggcgcctgcagtctcagctacttggtaggctgaggtgggagaatggcatgaacccagaaggtggagcttgcagtgagccgagattgcgccactgcactgcagactggctgacaaaccgagactccgactcaaaaaataaattaaagaaaaaaaaataaaacgcattagttcatgctaaaaatccttagcaaattagtaagagggaactttcttaacatgataaagggtaagccaggtacagtggctcatatttgtaatcccagcactttgggaagttgaagcaggaggattatttgaggccaagagagagagaagcctgggcaacacagcgaaaatccgtgtcctcaaagcatttacaaaatggctgggtgtggtggagcgcgcctctagacccagctacttgggaggcagagggggaaggattgttgaaacccaggaggtcaaggctggccaggtgtggtggatcgcgcctctagaccctgctacttgggaggcggagggggaaggattgttgaagcccaggagatcaaggctggctgggtgtggtggagcacgcctctagacccagctacttgggaggcggagagggaaggactgttgaagcccaggaggtcaaggctgtagtaagccatgactgcaccgctgcattccagcctgggtgacagagtgggaccctgtctcaaaacaaatgaaagtaaggatcccagagaataaacttattttaagatttaaaaaattatttttgcagagcatggtggctcacgcttgtaatcccagcactttgggaggccgaggtgggtggatcacaagatcaggagtttgagaccagtctggccaacatagtgaaaccctgtctctactaaaaatacaaaaaaagaaaaaaaaaaggctctttgtgtttatcttcttacaggtcccagaactttataaattttgctggaatataggacttatactttcctatttcttccaaagttggttgataccaaccaactttcttactagaaacctgcaatgtaagtgatccaaggataccttattattctaaacaataacttccaggtctactctcaagttctgcagcatgaggctttcccagagctctttcattttccttcagttctcctctctgcacaatcattatgtactgaaacattttctttcactgaagaatgatgcagccgggtgcggtagctcacgcctataatcccagcactttgggaggccgaggtgggcagatcgcttgagcccaggagttcaagaccagcctgactaacatggtgaaaccccgtctctactaaaaatacaaaaattagccgggcgtggtggtgcgcgcctgtaatcccagctactcaggaggctgaggcaggagaattccttgaacccaggaggtggagggtgcagtgagccaagatcgcaccactgcactccagcctgggcaacagagtgagacttcatctcaaaaaaaaaaaaaaaaaaaggccaggagcggtggctcacatctgtaatcccagcactctgtgaggatgaggtgggtagatcatcttctgagctcaggagtttgagaaccgcctggccaatatggcaaaaccctgtctgtactaaaaatacaaaaattagcagggcgtggtggtgcatacctataatcccagctactcaggaggctgaggcaggacaattgctccaacccaggaggcagagcttgcagtgagccaagattgtgcaattgcactccagcctgggcaacagagcgagactccatctaaaaaaaaaaaaaaaaaaaaacttagccaggcacaggcttgtaatcccagctactcaggaggctgaagcaagagaatcgcttgaacctaagatgtggaggttgcagtgagccaagatctcgcctctgcactccaagcctgggtgacagagtgagactccaactaaaaaaaaaaaaaaaaaaaaaaaaaaaaaagtaaccaaccaattttggagccaatattttaccaataaaacacaatagtggtctaacaaatttctctacagaagatccacaattcttcgcattgtcagaagaaacctggaagtagtcatccccttctaaccgttgctgcatacctcttcagagactctataaacgccacacgggagtcagggactttggggagctgtgggaagagaagagacctgtgagagactgacaaggaaagtccttgctttctacacaactggtcacaaactcatggagacgcatactgaccactcgaggtgtgagcagggcggggaggaagtgggacacgtagtaaggcctcctgaatatgctgcaacacagagaagcagacagtgcatcagtcagagcagcgagaaggcaattcccacagacggtgaccggtgtttcagagagtggactgcgagggctcactccaaagccacgatgcattatgaagtcttcttgtgcacagttccgggacaaggcatgtgtagggcaggccgtgctagcccagccctgagtccgtgggaatcaggaccacattcggcctgctccctgggcttgaacgtggagcctggatcaatctgaggccacgaggaccatgtaaggtccatttggggcaatttccttggagctaaatttcaaaaccctgggagctgcaatcagctcatccacatgtgtaaccaccagaattcaagatgttttgagatcataccaaattcaataaagctgtgctattcagctctctgttactgactccatattggtcacaaagaaggcattgataaaaaaaaaaacatcatggccccactgccttccctcccagtgcaagctccccaatcagcagttcctgttggctgcttcagcacgggaggggcatcacctgcttttacagaggaaaaaatgtttcacagcaaatgcacagctcttgacctcaccccgtatcccttaacggcaggatcctcgattcacagccctgactcctgtctctctctgaatagacagtggccaacctgccccatgtggctctgggcagaaatgggacacactccaaagagccccagacgctggcaggcatcagagcggagtctgcacaccctgcaggcatcagagcagagtctgcacatactgcaggcatcagagcgcggtctgcacacactgcagctgctagaggccttttcggcagcccagcctacctggcctccatgacggtgactgggatgttccccgtatgctcaaacaccatgatggccttttcaacatcctgaagagcttggctgtggggctggttcccatacagggaggaaaggaaaaagaacagaggactttaaagaaaagactgagcagtgaaggccacactcaacctgtgcttccttgttgaaaggctctgtacacattaaaggtaaaggcccacatgctgtgcgcacagcaggggccctggagcactccaaaatgtcccaaaataccagcacgacaggggaggatgacactgccacctccacacacacaaggttcagaccccgtgatgtgcggccctcctcgagagctcagctctgctgagagcctgccgtgagcctctttcctgcctccaggaaagagttgaaagtaaagatttctaggtgggaaggagtagagacttaatttttgagattaaaagaaattacgagggctgggtgccatgactcatgtctataaacgcagtgctttgagaggctaagcggggcagactgcttaagcccaaggagttcaagcccggcctgggcaacatgatgacatctcatctctaaaaaaatacaaaaacattagccaggtgtagaggcatgagccagtggtcccagctactcaggacgtggaggtggaaggattgcctgtgcccaggaaatcatggctccagtaagccatcatcatgctaccctactgcagcctgggcaacaggggaagtccctgcatcaaaaaaaaaaaaaaacattctgaggccaggcgcggcagctcacatctgtaatcccagcattttggggggccaaggcggaaggatcacttgagcccaggagtttaagaccagtctcggccacacagggagaccctatgtctgcaaaaaattttagaaaccagccaggcatggtggcgcacacttgtactcccagttactcaggaggtcaaggtgagaagatcgtttcaacctaggagtttgaggctgcactgaactgtgatcacggtactatacttcagcctggtcaacagaacaacatcccacctcaaaaaaaaaaaaaaagtaatttataaacagcaataaattataaatggaaaattatattaaatattttcacctaacactttaatgtcacctataagtgttcttcagtaactcgtaactttaaaataaaaaggtcttaaaaagtaaagaatggagggccaggcgcagtggctcacgcctgtaatcccagcactttgagagaccgaggcagacggatcacgaggtcaggagaccgagaccatcctggctaacacggtgaaaccccatctctactaaaaacacacaaaattagcctgacgtggtggcgggtgcctgtagtcccagctactcgggaggctgaggcaggagaatggcatgaacccggaaggcggagcttgcagtgagctgagactgcgccactgcactccagcctgggcaatagaacgagactccattccaaaaaaaaaaaaaaaaaaaaaaacaatacgctgggcacagtggctcatgcctgtaatcccaggactttgggaggccaaggcgggcagatcacgaggtcaggagattgagaccatcctggataacatggtgaaaccccatctctactaaaaaaatacaaaaaaattagctgggtgtggtggcaggtgcctgtagtctgagctactggagaggctgaggcaggagaatggtgtgaacccgggaggcggagcttgcagtaagctgagatcgcaccactgcactccagccagggcgacagagcgagactccgtctcaaaaaaaaaaaaaaaagtaaaaagtaaagaatgttttcattaggccggccatggtggctcacgcctgtaatcccagcactttgagaggccgagacgggcggatcacgaggtcaggagatcgagaccatactggctaacgtggtgaaacctcatctctactaaaaatatacaaaaaattagccaggcgtggtggcaggcatctgtaggcccactataggctactcgggaggctgaggcaggagaatggcgtgaacccaggaggcagagcttgcagtgagccgagactgcgccactgcactccagcctgggcgacagagcgagactccatctcaaaaaaaaaaaagaatgttttcattagtgacccacacatatcacatgaccatctgacatttggctgctataaaaacagttaacacttggccaggagcagtggctcacacctataatcccagcactttgggaggccaaggcgggcagatcacgaggtcaagagatcgagatcatcctggctaacacggtgaaacctcgtctctactaaaaaaaattaaaaaattagccaggcgtggtggcgggcgcctgtaatcccagcactttgagaggccaaggcgggcggatcacaaggtcaggagattgagaccattctggctaacatggcgaaaccctgactctattaaaaatacaaaaaaattagccaggcgtggtggcggctcctgtagtcccagctactctggaggctgaggcaggagaatggcgtgaacccaggaggcagaggttgcagtgagccgagattgcgccactgcactcaagcctggtgacagaccaagactgcatctccaaaaaaaaaaaaaaagttaacacttttctgtgattcagagaaaaacatgacgaaccacctctccattcaaccccacaggaaccaagatctcccaaaaggacaaatgtcctgcagcctgaggcacttcactctgccacacagtaaccctttccctgccaatgctggggacacacaaggtgggacacagcaacacagaggcccgcagagcctcgcccccagctgcgcccgaggcaagaccagacatgagactgggaaggctgaaaaactcaactcaagagtcaaaagaaactggacctttgcatggtgggcgtgactggctgagaccctgcagggctcaagcaacattacctcagtaatgtccccagctgatgacaaatcctcgtagagtcccatgttttctatagaaaccttcagggaagacacagaatgagaacaagaaaacaaagcagtttctgctgggacaggtgtgaggagtgggcatggagggacagcttgccttgaggtcggccagccgtgtcttggccaatgagatgtagtctgtgaggagggagcggtacttgccgggaaccaggggtgggtggagaatgtgcacctgaggatagatagcagagcgcagcaccgttagtctgggaactgcctgggactccagggaggccacaattcacttccaacatccacagtgctgagtagagaaacacagccctttacagtcagacttatgagtatgcaaagcaaaccattagtaaaattaaaacacaagccgggcgcagcggcttacacctgtaatcccagcactttgggaggctgaggcgggcagatcacgaggtcaggagatggagaccatcctggctaacatggtgaaaccctgtctctactaaaaatacaaaaaaattagccgggcgcggtggtgggcaccagtagtcccagctactcgggagactgaggcaggagaatggcgggaacccaggaggcggaccttgcagtgagccgagatcgcgccactgcactccagcctgggtgacacagtgagacttcatttccaaaaaaaaaaacaacaaaaaaaaaacacaatagaaggctgcttccccaggtgaaaaatcaagaaaccctaatgtagctggtcctgcaagtccagggcggctcactgggggaaccagggatgtgcaatcctagcagcggcagcaggaaccggccccggccgcctgcagctccatgcctttgacttcctggtcaaaggggacagaggggacacagcgtgtttttttcttttgagagggagttttgctcttattgcccaggctggagtgcaatggtgcagtctcggctcactgcaacctccgcctcccgggttcaagcaactctcctgcctcagcctcctgagtagctaggactacgcgcgcgctaccacgcccggctaattttgtattttcagtagacagggggtttctccacattggtcaggctggtctcgaactcctgacctcaagtgatctgccctcctcagcctccaaaagtgctgggttacaggtgtgagccaccacgcccggccaattttcttaaaagatgagggtcaggctgggcacagtggctcacacctgtaatcccagaactttgggaggccaaggcggaaggatcacttgagctcagttcaaggccagcctgggcaacacagcaagaccccatctgtactaaaaaaaagaaaaaaagaaaaaacagccaggtttgctggcatgcgcctgtagtcccaactactcaggacgctgaggtgggagaactgcttgacctgggaggtctaggctacagtgagctatgatggcaacactgcactctagcctaggcaacagagtgagactgtctcaaaaaaaaaaacccaaaaaaacaaaaaaacaaaaaaaaaacccacatgaaattaaaaaaaaaaaaaaaaaagcaaacatgagatcctaaaaccctcactgcagtacaactcgctcttcctgcgtaactgggtgctgagaacgtctctccacgtcaccactcagacctgctcactgttttgagggagactgaacagtgacataatatatctacccacctccttggcctaggtgagaaaagggtttcttagcagttgccttgactggcacacacgcactcactgtgtgtccacgtggacacctccagttgcaatgtttgtgttgtttcaccataaacggcttggggaaggggaaggggaaggggaagggcctggctgagaggctcagagcagatctgcaggaggctcttggggaggccaaggcagtcctcagatgcagcaggtgagcgaagcaccagaaatcatggatgtggcagccagcttctcacctgcaggtaccggggagactcaaaaggcacgagttctgacaagaacgtaaacaggaagaccagggccttcttgctgcagccatggtagcctcgtgtgctcccaaaggaggcctgtgtggagagaagagcgtgaagcccaggacagccaggcgcggctgcaccacctaggcagtgtcctgtgtggagagaagagcgtgaagcccaggacagccaggcgcagctgcaccacctaggcagtgtcctgtgtggagagaagagtgtgaagcccacctaggcagtgtccgggcggctgctgtagtcggcctcctaaacaaaaaggaaaaaagagaaacaccaaaaagtcatgtggttcatacatttacagatgtcacgactgcgctttgactgaagagatatctaaaagttattcgaagaaaaacagttaaaaatcattagctataacaaacactaactatgggatccttttgggatccttaggggtacaatttgctaaatgccctaagaagtgtttgtgcacagcaaacaaattgattttgtgggatgaagccacttctgaacacactttaacttctaacctcatccaccagtggacagatcactgcaagagaggtgggtaaggaacacaggccaaggagggccacccctcagacaatgaagctgcaagaccctagcagagcaagcgaggaacatgagcaaaccctcccaggaacgaagggggctgcagcaaagtcctgggggctgcagtgagtcagggaaggaaggagattttaaatgggcatggccctgaacgcatcatagtgaacctgcagacagaatgtgggcctctgtgaacactgaaccgcttacctgcaaaaccagacgagctcctgccaccctagccccacttgagaccacaggacatcctggtgaaacctcagcaagttaccatctatcaggaaacctgaactccaacgtgaactgaaggctcaccttggtctttctgaaagcgtgcaaaattgtgttttgtttttttttttttggagacagagtcttgctctgtcacccaggctggagtgcagtggtgccatcttggctcactgcaacgtccgcccacccaggtttgaacaattctcctgcctccctagtagctgagattacaggcatttgctaccactcccagctatttttttttttttttttttgagagagagagtctcactctgtcatccaggctggagtgcaacggtgcaatcagggctcactgcaacctctgcctcccgggttcaagtgattctcccacctctgcctcccaagtagctgggactacaagcacgtgccaccaagcccggttttttttttccttttttctgagacaaagcctcactctgtcacccaggctggagcgcagtggcgtaatctcggcttaccgtaacctccgcctcccaggttcaaacgattctcctgcctcagcctcctgagtagctgggattacaggtgtgcaccaccatgcctggctaattttgtgtttttagtagagacagggtttcatcgtgttggccaggctactcttgaactcctgacctcaggtgataccttggcctcccaaagtgctgggattacagacatgagccaccacgtctgacctagctaatttttgtctttttagtagagatgaggttttgccatgttggccaggctggtctcaaactcctgacctcaagtgatccacctgcctcggccttccaaagtgctgggattacaggcatgaactatcacacctgaccatgtgtagattcttttgaatgttatcatcatgcagacagacccaaaaagccattagataaaaagcggaaaatgctgataacgcttgtcaaatgtctctgagagggacagagtcacggaaaaacaaagctcagagacatgaactgtctgtgccaaataccaggaaagcagctcaatacttgtcagttaaaaatttaaataaaacctgagaccactcaagggttcccttctcaaaacatcagcacccagtttcaacctgaaattctcccgccaagcacaccatgtcttatcaccctccattcagccatccacaacacaactgctcctgtctcttggcaacgttcactcaattaacagtgagccagatgatcactggccgcagcaggaacagtccagacccgtcgccaaaggcatttctgtaaagcatctaagtgacacgcgcaagccagacctggggtcacagcagccattgttagagttgctgagataaaaggcagttctgtttgctatttttgaaaaaattacacttaatggctgggtgcagtggctcaatccggtaattccaacactttgggaggttgaggcaggaagatcacttcagcccaggaggtcaagaccagccaggacggccgggcgcggtggctagcgcctgtgatcccaacactttgggaggctgaggcgggcagatcacgagttcaggagatcgagaccatcctggctaacccggtgaaaccctgtctctactaaaaatacaaaaaattagccgtgtgtggtggcaggcgcctgtagtcccagctactcaggaggctgtggcaggagaatggcgtgaacccgggaggtggttaccgtgagccaaggtcgcaccactgcactccagcctgggcaacaagagcgaactccatcttaaaaaaacaaaaagaccagccagggcaacatagtgagacactatgtccacaaaaaattttttaataattagccaggtgtggtgacatacacctgcggactcagctgctcgggaagttgaggtgggaggatcatttgagcctggaaggttgagactgcagtgagccatgatcacaccaccacatcccagcctgggagacagaacagagaccttgcctcaaaaaaacaaacaaaaaaaccccacaaattacatttaactacataatgtgatatgctgagaattatattaattaccccaaagggctcaaattcacgatcatttggtctacttatattaacatttcctaaaagtaaaaaaaaaaaattttttttttgagacggggtcttgctccattgcccaggctggagtgcagtggtctgatcttggctcactgcaacctgcgcgttccgggttcaaggaattctcctgcctcggccttctgagtagctgggattacaggcacctgccaccataccagctaaattttgtatttttggtagagatagggttttgccacgttgcccagggtggtcttgaactactgggctcaagcaatcggcccacctcgtcctcccacagtgctggtatttgccctcaaaagtaaaaattaaaacagatgttcaggccaagtgcgttggctcatgcctgtaatcccagcactttgggaggctaagtggggcggatgacaaactcaagagatcgagaccatcctggccaacatggtgagaccccatctctaccaaaattacaaaaattagccaggtgtggtggcaggcacctgtagtcccagctactcaggaggctgaaacaggagaatcgcttgaacccaggaggtgggagttgcactccagcctggtgacagacggggactccatctcaaaaacaaaacaaaacataacaaaaacagatgttcaaacactgaatatgcatatatacatttatcaaaactcatctaactatctggacatggtggctcatgcctgtaattccagtacttcgggggttaaggtgcggggatcgcatgaggccaggaatctgagaccagcctgagcaacacggtatgacattgtatttacaaaaaaattttttttaattagctgggtgtggtggcacacacctatagtcccagttactctggaagcggaggcaggaggactgcttgaccccaggaggtaaaggctgcagtgagctatgatcatgccactgcactccagcctgggcaacactcagtctcttaaaagaaaacacaaacagaaaaaaacaaaaaacctcatttaatggtacacttaaattggatacctttcattatttcatttaaactatattttgataaagttgatttgaaaaggtaaaagaaaagcaaacaaaaccaaaacaccaccaccaacacagcacttcagagtattcctctcccaactgtcgcctctggaaccgaagaaaaagcagcccagggagacacctgagccgcggctcggggagacccatcaactcctgacccaagagcaccaggtggattctggcacaaatctctcagcgcctcactaaaaggacagaacaaacacctctcctcttagtttagtggaagccccaggctaactgggcagagctggggagagcctgagggcaggtgagaaggaactttaaggaatagaagtgagttgacactgacactgcaccagtcaccaccttctcccaacacaagcagatgcggctcagcctcctgtgcagcctcagctcctcagaaggcctggggggggagcaggcaccgcagccacgatggcgatgcaggcaccgcagcccttgaaaatttcagggagctgagactcctacaaagaggcaactacttcaccgaggtggtgatggcaggaaaactcaatacttttttttttttttttttttttgagacagagtcttgctctgtctcccaggctggagcgtagtaatgcaatcccagctcaatgcagcctcaacctcctcggcttaagtaatcatcctgcctcagccggtaagtagccaggaccacaggtgcttaccaccacacccagctaattgttacattctgtagagaccggggtctcactgtgctgcccaggctgatcttgaacccctgggctcaagcaatcctcctgcctaggcctcccaaactgctgagattacaggcatgagccactgtacctggcccgaacccaaaacttctacaaaaattagctcttcaaatggaaactttactcacaagcactaaaagagaaaccatggcggtccttcaaagctgatatctcaaatacacccaactccccacatgaactgggggttttcacaggggttgcccagggatccctgaggtctcaggagctcagactcagtagtctcaaatgggccctggatctttatttccaaagccccctccaggcgagtctaatgcccacttaggttcaggaacagctgcataaacttctgtcagagagcacactgtgtgtgttccaaagaaaaaggaagaatatgtgatacggctgaagaaatgaagtacttgtttcaggacttacgtgaaaattagagacgcaaggctgggcacggtggctcatgcctgtaatccctgcactttgggaggccgagggaggcggaccacttaaggtcaggattttgagaccagcctgaccaacatgatgaaaccctgtctctactaaaaattagccaggtgtggtggcgaacgcctgtaaccccagctactcgggaggcggaggcaggagaattgcttgaacccaggaggaggaggttgcagtgagccgaggtcgcaccagtgcactccagtatgagtgatagaatgagactccacctcaaaaaaataaataagtaaataaataaaataaataaataaataaataaaaaggaaaggccaggtgcgctggctcatgcctgtaatcccagcactttgggaggacaagacgggcggatcatgaggtcaggagttagagaccagcctgaccaacatggtgaaaccccgtctctactaaaaatacaaaaatgaactgggtatggtagtgcacacctgtaatcccagctactcaggaggctgaggcaggagaatagcttgaaacggggcagcggagtttgcagtgagccgagaaggtgagctttctgtaccactgcactctagcctgggcgacagaggaagactccatctcaaaaaaaaaaaaagggaaaataagagacattgtatactctgcaaaaagcagcatccacttctgtgtcccctctttcctgatttcactcattttcttttttttctttttgggatggagtctccttctgtcacccaggctggcgtacagtggtgcaatcacagctcactgcagccttgatctcccaggctcaagtaatccttgcgtctcagcctcccgagtaacgaggactacaggtgtctgccaccacacctgcgtagtttttgttttgtgtgtgtgtgtgtgtgtttttttttttttttttttttttttggtggagatgaggtttcactatggtgtccaggcttgatttcgctaattttcttataaaagacagcaggaggctccgtcaactaagtgagacagaaaccaggggaaggagctgaggccccgacagggagaacccaggctcctcggaacatgcagaggaagatccgctgaggccccgacagggagaacccaggctcctcggcacacgcagaggaagatctgccaaggccactcggcaaagctgacagcaaggttgctcactcacatgacagagaatcaggtggggacagcatggtccccactcccaggccttctgggaagatcaggtattaggtagccgattggcaggtcacttaccttgaaccagtctgcatatgacaggaacgcagaggggccctccagtgctgcctggcgcacaaccaggaacgcagtgaccatgctgtccagctggcagctctcgaatgcctgggccatcaaacgcgccacccagtctagttaagaaccatgacatagtcacagcaaggcaagggcagccagcaggaacatgacgtgagttatgctgggtgatcaagtattccagaaggagactgtgcacacccaaacaccaagttttaaaagactacacagcaattacagcatgtcaagtgcaaaccactagagacctgaatgaagcagcagtggacactctggcctctcagagcagcagtcagtgcttatggaagcgtctgacaaagaatgttccatcgacaggaggcactgcaggttccgggcaggtagggaagggcttcactgagaggctcacccacagtcagctgggactctgctgacacccccctacacacactcttgaccagcaccaccgggctcgcgtaaaagctcaccttcaagcagctgctgcgcttctggaaagcagacaaccagggcagacacaaaggagagcactctctgccagtgaacctcctgcgtttccagaacttcttgcaaatggccaaccaactcctctgcactcagcatcacaaagagctgaaataaaagcatccgctcccttcaatatccaagcaaaccaatgtgcgacagatgacccctcaccttcctcccagccggtggccaccgcagccccctcacttcccactgcaaaggtaacacatggagctgtgacagctcacaccgtggcgtctctcccctcacagtggccagcacctgcttggagagaattctccctatctcaaggaggaggggctcggcccaagggacaagttcagtctcctgacctgagtggtggccttgatgaggacagccacatctcaccagacatccctgaacctctcgatgtgccgtccacggcaggcagcatgacaagtactaggcagatcttaatccccccgccacgagctcagaagcaggtataataccacatccactcaccctgcggtacagtgaggtgagcagagggtgtgtccgcgcaaagctccactctctctgcatctgaacagcatcagatgctgcagggggagaaacagacaaaaacttcaagtcagagatcaaaaagttgtgggtttttgttaaggaccagccccacagggtcggtgggtctctccccgtgtgcggcgacgagagagtgtagaaagaaagatacaagacaaagagataaaagacaagacagctgggcccgggggaccactaccatcaatgcgcggagaccggtagtggccctgaatgtctggttgtgctgttatttattggatacaaagcaaaaggggcagggtaaagagtgtgagtcatctccaatgataggtaaggtcacgtgtccactggatagggggcccttccctgcctggaagccgaggcagagagggagaggagatagagacaaagacagcttatgccattatttctgcatatcagagacttttagtactttcactaatttactactgctatctagaaggcagagccaggtgtacaggatggaacatgaaggtggactaggagcgtgaccactgaagcacagcatcacagggagacggttaggcctccggataactgtgggtgagcctgactgatgtcaggccctccacaagaggtggaggagcagagtcttctctaaactcccggggggaaagggagagtccctttcccggtctaagtagtgagtggtgttccttgacaccttttgctaccgctggaccacgatccgcttggtgacgggcgtcttcccagacgctgccgtcaccgctagaccaaggagccctctggtggccctgtccgggcataacagaaggctcacactcttgtcttatggtcacttctcaccatgtcccctcagctcctgtctctgtatggcctggcttttcctaggttatgattatagagcgaggattattataatattgcaataaacagtaattactaccaactaatgattaatgatattcatatgtaatcatatctaagatctatatctggtataactattcttgttttatattttattatactagaacagctcgtgtcctcggtctcttgccttggtgcctgggtggcttgccgcccacaggttttgtttttggacagggtctcactatcacccaggctggagtgcagtgctcaccacagcctcgacctccctggctcaagcaatccacctgcctcagtctcccaagtagctgcgaccacaggcgtgtgccaccatacccagatactttttgtatttttatttttttgatgctgagtctcactctgtcacccaggctggagtgcagtggtacaatctcggctcactgcaagctctgcctctcgggttcaagcgattctcctgcctcagcctcccgagtagctgggactacaggcgcccaccaccacgcccggctaatttttgtattttttagtagagatggggtttcactcttttggccaggctggtctcgaacttctgacctcgtgacctgcccgtctcagcctcccaaaatgctgggattacaggcgtgagccactgctcctggccaaaaagttgtgtttcaaagcttcagtgtgaagacagatcttaatatgtactttttcagttattaaagttcaccatctccctgtttgttgcctatttgctatatcatcaattctgtttctcaggcccggttacttacttgtaatgctttgtcatattcacaataaatattttccaatgtaccaactgcatttcaattttcctgcttttaaactgtcagtaaggtcaggctaggtggctcacgcctgtaatcccaccactttgggaggccgaagtgggtggatcacaaggtcaggagttctagaccagcctggccaagatggtgaaaccctgtctctactcaaaatacaaaaagtagctgggcatggtggcaggcgcctgtaattcaagcttggcagggaatagcttgaacccaggcggcagaggttgcagtgagctgagatcgcaccaccacactccagcctgggcaacagagtaagactctgtctcaaaaaaataaataaatacataaaataagataaactgggaataaaccaatcatggtggggatgctgttcaaaggaagctcagctcagtcaagtgatgataaactcctgagcacctcacagcacctgttgggagccatctgtgtatccctcatctcccaccagtttcctgcctgagcatctaccctggggatatgctagatacagaaaaagctcaaagtgttcatcgtggccttattcgtaagactgatatcttgggtacagtctgtcatacatgggtaacaggacacccactgggcagacgatgcctgggccatcaaacacgccaccgagtctagctgagaaccatgacacagtcacagcaaggcaagggtagccagcagaaagataacgtgagttgtgctgggtgatcaggtattccagaaggagaatgtgcatgctcaaacaccaagttttaaaagactagacagcggctgggcacagcggcacacgcctgtaatcccagtattttgggaggccgagacgggcggattacctgagattaggagttcgagaccagcctggccaacatggtgaaagcccgtctctactaaaaatacaaaaattagccgggcatggtggcacatgcccgtaatcccagctactgtggaggctgaggcaggagaatggtttgaacccgggaggtggaggttgcagtgagcccaaatcacgccactgtactccaacctggcaacagagcaagactccatctccaataaataaataaataaataaataaataaataaataaataaaataaagatatttctattttacgctgggtgcggtggctcacacctgtaatcccaacacttcgacactctgggaagccaaggcaggtggagcaccgaaggtcaggagttcgaggccagcctggccaacatggtgaaacccagtctctactaaaaatacaaaaaattaaccgggtgtggtggttggcgcctgtagtcccagctacttgagaggctgagacacgagaattgcttgaacctgggaggcagaggttgcagtgagctgagatcacgccactgcactccagcatgggcaagtgagtgagactctgactcaaacaaacaaacaaaaaagatatttctattttaatgacaattattttgtccactcataattctgaattttcttataaaaatctgttgctttcaggtaaaaggatatttagtaacaatctcaggcatctgaggacccagtctctggttcaagacagacgtaaaagaggtcctagaattcctggcatctccagtcagcgttaccaaggcaacaaggcaacagcaatccccaaaatgggtagcaactgagcagcctccacactgggcctacctttcagcacagggctgtgagtgagtatctgagtcagggtatgactgaagaacctcttcagaggatctgtggaaattacactgccaagcgtgtgtccactgaacactccgaacctgccaatgcagcagaaagaggggtcaggaaagggagggtgccttgcacgccacccaccaatcccagcacaaactgtggctcaggctcatcccttctttaagcaaggaaggggctttcttggccaggccactataaccacagacttgaaactgaatccaaggaggtggcagttcaacgagaaagggggcaaggcaacggcgaaacccacggagcagagaagcgaaggagcagaaggaaacaggtggggaagggcaggccgcgccacacccgggagtggagcagaaggaaacaggttgggaagggcaggccgcgccgcacccgggagtggagccccgggagccaacccgacggggcctcagcggcaccctctgtgacacggaactcccccagagggtcgtgccaagcctgagagaagagcccagcacaccagggcctcaaacagtcacaacagggactgaggccagctctgtccatgaagatgaggaaggaatggaagggactaaggtttcctgggccatctgtgtgagagaacacgatgttctgggggtgaatggggtcacagagccaggtggcaagagcacttgaggtctgttagcctgccacatcccagcaggcctatacagaccaccaaaccaaacccagaccctctcgtgaggcttacaacctgcaaccagcaagcggcactttatgccgattccccaggtaagaaaatcaagggtccagccgggcacggtggctcatgcctgtaatcccagcactctgggaggctgaggcgggcagatcacaaggtcaggagatcaagactaccctggctaacatggtgaaaccccatctacactaaaaataccaaaatattaggccaggcgcattggctcacacctgtaatcccagcactttgggaggccaaggggggcagatgacaaggtcaggagctcgagaccatcccggccaacccaacgaaaccccatctctactaaaaaaatagaaaaaattagccgggcatggtggtgggcacctgtagttccagctactcgggagactgaggcaggagaatggtgtgaacccagggagcggagcttgcagtgagcagagatcgcaccactgcactccagcatgggcgacagagcgaaattctgtctcaaaaaaagaaaaataaaaaaaattagccaggcatggtggcacacacctatagtcccagctatgtgggaggctgaggcaggagaatcgcttgaacccaggaggcataggttgtagtaaaccgagatcgtgccactgcactccagcctgggcgacacagtgagactctgtctcaaaaaaataaagaaagaaagaaagaaaatcaagggtcctggcggttcagtgaactgccccagggtcacacacccaacgaggccacgtcggctctgtgcaaactcaagacactcacacaacagggtgtgggacatcgtggagattcacttctcagccctgctgtccttcctcacagggcagggctttgggacaccacagcccccagtgtgcaagggaagctggccaccaagactgttggaggatgtctgattttaaattattggcaggccaggtgcggtggctcacgcctgtaatcccagtactttgggaggctgaggtgggtgttatcacttgaggtcaggagttcgagaccagcctgaccaatatagtgaaaccccatgtctacttaaaaatagaaaatacaaaactataggcttgtgccaggtgtggtggtgcatgcctgtaatcccagctactcaggaggctgaggcagaagaattgattgaacctgggaggcagaggttgcagtgagcagagatctcaccactgcactccagcctgggcaacaagaataaaactctgtctcaaaaataaataaataaataaataattggcaactaattacaaaatataaaaatcggcaggtcagtggttgttacctgactctcaggacatcagtgtgagtaatcttatcacacagattataaaaaaaagcccttgccacagactaaactgtatccccacaaagttcctctgttgaagcccagcctctcaaggtggggtgttgataaggctgaggtgatgatgagatgactgcccggagaagacaccagagggcttgctctcccctctctacctcatgaagacacagaaaaagtaggtctcctgcaagccaggaagagggtcctcaccagaacccaaccctaggggcaccctgacctccaacttccagcctccactgctgtgagaacacatctgccgtccacaccgcagtctctggcactttgttacagcagcccaagctaactgatgcacatgtaaacattcaggaaatcacacagtgctttattcactgtttcagtaaaagtaccgaacggtacaacacatttaattgagcagttaaacagttactgtgagggatgggaaatgaggagcaaaataaagaatgaaaaggttgacaaggcctggaaacagtggcaaattctactggtttctcaagacttcacttcaaggtcccctgcccacactagagggaagcaaaccccagagccccatttccaccaaaccccgatgtccaccttccacccagcccccactcctcagcttccgcctcccgacctgtaagggtctccgcacatctccacagagccatggagagaaaaagctaatagggccaagctttgcctactggtgaatctgagcaggatctgtggaggccaggcagcgggagtctgtagaggcacagctacagtgtgttctagaaatgtggggggctgagaggcagggccagctctagagcctgaatcacacccagggaaggaggagcaaggggagactccacacaggaggaggtcacagtgagtgggacaaacattggtgcaggacttccagaggcggaacaggatactgcagtgggcgcaccttccgacctcatcctcacaggaaaaggctgaccagagcgttccccgggctttcccatggtcgcctcctcctcacgcacgttatcgtaactggcagaggaagtgtgctcaggagcgggctgctgaagctctggaagtgtttaaaatatcttggctctttaatttggcagacacctccctgctgcacactcaggcaggccaccctcaggaacataccagcacctcacgatcttgtgagtggaggactcctcctgtactccagcagccaaagcgtcaagtgcaactgaagacagagccaggaacagaaaacagatgtcagcacacggcggcagcccaccagaaacaatccccaggcgctttcagacaacagatccacttcaaccccccagagggcccacatccatcaagacttctacaatctgtaggccttaatcaaaacacacagacaagaaaatgcttccctgtgacccacagattcatgaggtatcccttcacagctctgaaaatgccaaaacaagggcattccagtaccaggactctgcacagtgaaacatacagaggagaaatacctcaaatggaaaggcagaaaactgatacaattgctaataagcaaactaagtcatttacagtctgggctgcagtgcaattaacttacaaatcagcattctctgcagtacatcaaccgtgacctgtcaaaatagaatgtgagttaccatcttggtaatcttctgtaatttgtgtgatacctgcatcacacaagagaattattacttgttactctaaagtaaagaaacggcacttcaggaggccgaggcgggcggatcacgaggtcaggagatcgagaccatcctggctaacatggtgaaaccccgtctctactaaaaatacaaaaaattagccgggcgcagtggcggacgccctgtagtctcagctactcgggaggctgaggcaggagaatggcgtgaacccgggaggcagagcttccagtgagctgagatagtgccactgcagtccggcccgggcgaaagagccagactccgtctcggaaaaaagaaaaagaaatggactttacaaagagatcaactttaaaaaccctcatagacctagaaattactccagtaccgaagggacctagacagagtgaaaaggctgaactttctggaattaccctaagactgctctcagcatggcctgaggccatgagcctagggctgggcaggacacttttgcacgcagagttttgctgaagtacttcagtgaagagaggaaagctcaggccttgaatctgggctgtggaactaaggactttcacccttgatgcctctggagccagaagacggtgagaaggtaccattgtccatttcccttcttcacatctcctgggcttaaagcataccactactcagagagcaactcatggtaacaataaaacagacttcctcaaacaaagcccacagactgcagtgtaggcaaaatgggagccactggctcaggaacctccaaaagggaataaaaatttgggacgtatccaaaactatctacagattcaatgcaatccctatcaaaataccaataacgttcttcccagaaatagaaaaaaagattctaaaattcacatggaaccaaaatagaacacagataagcaaagcaatcctgaggaaaaagaacaaagctatagaatatagaaatcacactgcctgaggtcaaaatatactacgaggctacagaaatgaaaacagcatgaggttgatataaacatacacacagaccaacggaacaggatagagaacccagaaacaggccgggaactgtggcccacgcctgtaatcccagcactttcggaagtcgaggtgggtggatcacctgaggtcaggagttctagaccagcctgaccaacaaggtgaaaccctgtctctactaaaaatacaaaaaaattagctaggtgcggtggcgggtgtctatagtcccagctactcgggagactgaggcaggagaatagcttgaacccggtaggcggagcttgcagtgaaccaagatggcaccactgcactccagcctgggagacagagcaagactccatctcaaaaaaaaaaaaaagaaaaaagaaaaaaaaaggccaggcacggtagcccacgcctataatcccaacactttgagaggccaaggtgggcgggtcatgagatcagaagttcgagaccagcctgaccaacactgtgaaagcccatctctactaaaaatagaaaaactagccgggagtggtggtgggcgcctgtagtcccagctattcaggaggctgaggcaggagaatggcgtgaaccccggaggcggagcttgcagtgagccgagatcgcgccactgcactccagcccgggcgacagagcaagactctgtctcaaaaaaaaaaaaaaaaaagccaatgtcactaatcatcagggaaatacaagtcaaagccacaatgagctattatttcactccagttagaattatcattatcaagaaaacaaaaaataacaaatgctggtgagaatgcaaacagaactcttatatgctatcagtgagaatgtaaattaatacagccattatggaaaatagtatggagatttctaaatagttgggtagttctaaaaacagaactaccagcccagagggtctcactttcaccaggcatggtggatcacatctgtaatcccagcacttcaggaggccaaggcaggcagatcatgaggtcaagagatcgagaccatcctagccaacagagtgaaacctcacctctactaaaaatacaaaaattagctgggcatggtggtgcatgcctgtaatcccagctattcgggaggctgaggcaggagaatcggttgaacctgggaggcagaggttgcagtgagccgaaatcgcgccactgcactctagcctgagcaacagagagagacaccgtctcaaaaaaacacaaaaaaacaaaaaaaaaaccagaactgccatatgatccagcaatcccattactgggcttacagccaaaggaaaggaaatcagccagctgaagagacatctgtactcctacatttattgtggcactattaacaatagccaagatatgaaatcaacctgtgtgcccaacaagagatgaccggatacagaaaacgtggtatatacacacaacggaatactggtcagctttaacggagtctcgctctgtcacccaggctagagtgcaaggcgcaatcttggctcactgcaacctccgcctcctgggttcaagcaattctcctgcctccacgcctgtagctgggactacaggcatgtgccaccacgcccggctattttttttttttttttactagagacagggtttcaccatgttggtcaggctggtcttgaactcctgacctcaggggatccaccagtctcagcctcccaaagtgctggattataggcatgagccattgagcccaacctcagctatttttttctttttctgagatggagtctctgtcgcctaggctggaatacagtgacacgatctgggctcactgcaagctccgcctccaggtttcacgccattctcctgcctcagcctcctgagtggctgggtccacaggtgcctgccaccaggcccggctaattttttctatttttttagtagagacgggattttaccatgttagccaggatggtctcgatctcctgaccttgtgatccgcccgcctcgtcctcccaaagtgctgggattacaggcatgagccaccatgcccggccagctattctttttttttaaagtgaaatcctgtcattcacagcaacaggaatgcaactgaaggccattatgttaagtgaaataagccaggcacagaaggacaaatattgcatgttatcacaaatatgtgggagctaaaaagtggctcttgtggaggtagagagtagaacgagagataccagagatgagaagggtatatgcagtgggggaacgaagagagttggttaatgggtacaaacatacagctagacagaagaagtaagttctaatgttccacagcagagtgaggcggctatagttaacaacagattgtatatttcaaagtaactgcaacatgtgaaatgttgccaacacacagaaatgatacatactggaggtgacggagactctaaacaccctgacttgatcattacactctatgcacaaaacaagtatcacatgtaccccgtaaataggtacaaacagcacgtttcaatagagagacacgtaaatacatttcaacacttggaataaggacggctccttccgctaaactcttcacttgacttttcctcctacctgcggcattttttcaggctccacagttcttctcagatctgagtttttctgaaatcccctcaaaacaaacatttgaacaaaatctgaaaaaccataaaaccaaagttatttatggacatcatggtctccaagcaactgtgaatggcacagaccatccacttcagaggggcgggtgagcatatggcttgggcccaccaggacccctgtgagctgctcctaacctgaggaacgctgcagaagttactgctcacctgaccacagctacactagcgttcaccaaacccaatcaggacccttagatgaaccagattttttcctcttgcacttctatttgaaagggaacaagtttatagtcagatttttttctttttttttttttttgtgagacggaggcttgctctgtcgcctgggcttgagtgcaatggtatgatctcgctcactgcaacctccgcctcccaggttcaagcaattctctgcctcagcctcaccagtagctgggaatataggcgccgccaccacacccagctaatttttgtatttttagtagagatggggtttcaccatcttggccaggttggtcttgaactcctgacctcatgatccacctgccttggcctcccaaagtgctgggattactggcatgagtcaccccacccagcccaatttttttctcttaaataaaagtggtttccaagggaggtcttatggattgtcttgcctgccaatctccaataccagagggtctagagggacccagaagcatcctattctgaggaatgtgatgggggaggaaaggcattcttagctttttaaaaaataagaccaagaggactgaaatccacaagattttctaactttgatttaaatttaacctatctggtaccaggttatagtagctcaggaatgctaagtcgctcatgccaccaaaaagctttaggaaaaaggaaaaaacccacaagctactgtacagatcagtttctcatctaatttttatttgtaggtgtcacttgtagtgggatgggtctcccagcaggtgttcctcagaacccaaatatcccagagaggatctgagaactcaccaaggaaaagagtctcatcactcaaacacagcaggcaaagagccagaaaacgagcttcaatgcaccttagagacaggtggtggggcggttctctagagctgtcctgccgccgtccaggagtgcgctgaatataagtcctgacaaacccaactactcctcaagctggattggtccaagccattctctgacaagcccaactactcctcaagctggactctggtccgagccatcctctgacaagcccaactactcctcaagctggactctggtccaagccatcttctgacaaacccaactactcctcaaactgggttggtccctagtctgagccatcctctggtctctcagcaccttcttagtttgtggggggacattacagtcccaagtttttctcataatatcattcctcaggaaggccaggcatagtggctcacgcctataatcccagcactttgggaggccgaggggggtgcatcacgaggtcaggagttcaagagcagcctggccaacctaatgaaaccccgtctctactaaaaatacaaaaaaaaaattagccgggcatggtgccacgtgcctgcagtcccagctactaaggaggttgaggcagagaatcacttgaacccaggaggcggaggttgcagtgagctgagatcgcgccactgtactccagcctgggcgacagaaggaagcagctgcggtcactctatgggaaaggtgaatggaaacacttaaactcatgtcaaggccgacttactagtatttccacatcagtcaagtaaaatgcaaccccacaacaggctgagactgggagtctgtcatgccaggttcccacggccacggagagacaggctgttctgcctcgcagagctcttgagagcagaaggcattatcacagatcaaaatgagttttacccaagaacccgcatcttgtcatgaacgcaccagaaagcatggccctggcgacgtcagcatgctggcaggatgcttccatctgttcacaaaggcagcacagattcctgaagagccacgatcccacagcatgcatgtcgggatggctggagacacacacagaggcagacgtaaggctcaactaaatcccatcatcaggggattgagttgagccatatgtcccaattttttttttgagacagttttttgctgtcactgaggctggagtgcagtggcgcaatcagtcactgcaccctcgacctcccaggctcaagcaatccttccacctcagcctcctgagtagttgggacaacaggcgcataccaccacgcccagctggaggtcttactactttgcccaggctggactcaaactcccgggctcaaaacaatctcccaccttgccctcccaaagtgctgggatgactggtgtggcactgtgcccagtctcaagttattttctaatttcccttgtgacttctttgactcattatgttaactttcaaatattgtggattttcccaattcccttctgttgtttattctaattaaattcatttgtggttagagaacatattttgaatgatttcagcccttctaaatttattcctctttgttttatggcctgaaccttttttttttctcttgaaacagttttgctcttgtcatccaggctggagtgcaatggcacaatctcagctcactacaacctccgcctcccaagttcaagcgattctcctgcctcagcctccacaacggctgggattacaggcacctgccaccttgcccagctaatttttgtaattttagtagagacagggtttcaccacgttggacaggctggtcttgaactcctgacctcaggtgatctgcccgcctcagcctcccaaagtgctgggattacaggtgtgagccaccgcacctggccttggcctgaaccttatgctgtatcctggggactgttccatttggacttacgaatacacactctgctactactgggtagagtgctccacagtcagtcaggtcagctggtttgcagcattcaacttctatatcattcttttttttttttttttttttaattgatcattcttgggtgtttctcgcagagggggatttggcagggtcataggacaatggtggagggaaggtcagcagataaacaagtgaacaaaggtctctggttttcctaggcagaggaccctgaggccttctgcagtgtttgtgtccctgggtacttgagattagggagtggtgatgactcttaacgagcatgctgccttcaagcatctgtttaacaaagcatatcttgcaccgcccttaatccatttaaccctgagtggacacagcacatgtttcagagagcacagggttgggggcaaggtcacagatcaacaggatcccaaggcagaagaatttctcttagtacagaacaaaatgaaaagtctcccgtgtctacttctttctacacagacacagcaaccatctgatttcgcaatcttttccccacccttcccccctttgtattccataaaaccgccattgtcatcatggcccgttctcaatgagctgttgggtacacctcccagacggggtggtggccgggtagaggggctcctcacttcccagtatgggcggccgggcagaggcgcccctcacctcctggacagggcggctggccgggcggggggctgactcccccacctccctcccggacggggcggctgttctatatcattcttaatctaacttgttctacccattactgaaaggggagtattgaaacctctaatgattattgctgaaatgtctacttctccctttaattctggccatttttgcttcatagattttggtgctgagataagatgtgtatatcctaggaagcaggtttttctttttttttttttttttgagatgaaattctgctctaggccgaggcgggaggatcacaagatcaggagttcgagaccagcctagccaacatggtgaaaccccatctctactaaacatacaaaaattagccgggtgtggtggcacgcgcctgtagtcccagctactgaggaggcaggggcagaattgcttgaatccgggaagcggaggttgcagcgagcccagatctcaccactgcactccagcctggcgacatagcaggtctctgtctcaaaaagaaaaaaaaaggccgcgcgaggtggctcatgcctgtaatcccagcactttgggaggccgaggcaggggaatcacctgaggttaggagtttgacaccagcctggctaacatggcgaaaccacatctctactaaaaataacaaaaattgccaggcacagtggttcatgcctgtaatcccagcgctttgggaggcagaggcgggcagatcctgaagtcaggagatggagcccatcctggctaacatggtgaaacccagtctctactaaaaatacaaaaattagccaggcgtggtggcggacgcctgtagtcccagctactcgggaagctgaggcaggagaatggcgtgaacccgggaggtggagcctgcagtgagccgacatcacgtcactgcactccagcctgggtgacagaacgagactctgtccctaaaaaaaataaatacataacaaaaattagctgcgtgtggtggcgggcgcctgtaatcccagcgacttgggaggctgaggcaggagaattgcttgaaccctggaggtggaggttgtagtgagctgaaatcgtgccactgcactcccacctgggccacagagcgagactccgtctcaaaaaaaaaacagacaaaaagcaaacaaaaccaaaacaccataaacgttctcttgaaataataaagcaatagttcctccaggtctagtctagtataaatatgcaatgcaatctagtctagtacaaattatatgtcaaagccagaaatcaaacccgtctgattctgggctttgaaatataatttatactagactagactgcaaaaacagtaacactgaatcatcattagcacgctacctttccagcagctcttgcaggctcacaatgccttgtacgtgaagatgccacaccgcttcaagcaacaaagaactctgaaaaacaaaacaaaacaaacaaaaacaaaaacaaaaaaacccccagcattctgagtcctttatgaatgcattttcctacaaaatgttcaacttaggttcttaaccatgccgtattgaaaattaacctcaagcaaaaacttagagcctgaaacacatctttttttacaaagctgtactggttttcaaactccctggcctttgggcacccacacaccgttgcccaacacttgcttctcttccttctctcttcctacgcactgtagcctacttctaaccctttctccacactacagccaacacagtattacacacactgacatgacagtctctccttcagaagccttcactggctcctcgaagctgccaggacaaaggtcaggcttcagtgtgccctgtgcatgtcccttgtctttctcactcaaccctctcccatttgataaaacaggatctgctttagccactcactgtgaacactgtgcctgtcacactgccctgatctccctgcagcctccccttctcatccccctaactcacactctatttttttttttttgagacagagtcgcgctctgtcacccaggctggagtgcagtggcgccatctcgggtcactgtaagctctgcctcccgggttcacgccattctcctgcctcagcctcctgagtagctgggactacaggtgcctgccaccacacccggctaattttttctattttttagtagagacggggtttcaccgtgttagccaggatgggctcgatctcctgacctcatgatccacctgcctcggcctcccaaagtgctgggattacaggtgtgagccactgggcccggcccctaactcgcactcttcacagtccgtgcaggaaggctttcctaactctccaatctgatatgcatgtccaacatcttcttcgcaaatctgtgagcacatgaatcatcgcacttcttgtggatttagtggcttgtttcccaagctacgtgataatgagggcagggaccaaagcaataactgaaaaatctaatgaattctataatgtatgctggataaaagaatgggaaaggccggacgcagtggctcacacctgtaatcccagcacttgggaggccaagatgggcagatcacctgaggtcaggaattgaagaccagcctggccaacatggtgaaacctcatctctactaaagatacaaaaattgggcagggcgcggtgactcacacctgtaatcccggcactttgggaggccgaggtgggcagatcatctgaggtcaggagtttgagaccagcctgaccaacatggagaaaccccgtctctactaaaaatacaaaaaaaattagccaggcatggtggcgcatgcctgtaatcccagctactcgggaggctgaggcgggagaatggcgtgaacccgggaggcggacgttgcgataagccaagatagcaccattgcactccagcctgggcaacaagagcaaaactccatctcaaaaaaaaaaaaagatacaaaaattaactgggcatggtggcacgcgcctgtaatcccagctactaaggtggctgaggcaggacaatcgcttgaacctgggaggcagacgttgcagtgagccaagattgcgccactgcactccagcctgggcggcagagcaatattctgtctcaaaaataaaaataaatgccaggcgcggtggctcacacttgtaatcccagcactttgggaggccgaggtgggcagatcacgaggtcaggagatcgagaccatcctggctaacacggtgaaaccccgtctctgctaaaaaatacaaaaaattagctgggcgtggtggcagtcacctgtagtcccagctactcgggaggctgaggcaggagaatggcgtgaacctgggaggtggggcttgcagtgagccaagatcacgccactgcactccagcctgtgcgacagagcgagacttcgtctcaaaaaaaaaaaaaaaagaccagcctgggcaacaaggcgagaccctgtctctggaaaaaaaaattacatacatttttttttaatagtttactatactaccctggaaaattctccatactaatatacccaaggctaaacgtgtttttcaatatattctagtctaataaatattactaatgataggtgaatagggacaaaaaatggcaattgaaggtacttctttccaatccacagatgatttctaaaccctttttcatccactctctgtaattaatgagaagcttggagaattcccaagaaaacccaggtactctgttgcctccatccagatcaacagaacattgcctggaacactggagagtcagatttgcaatctcaaatttacctgtattttccataattcttgacagaaggaaagacgggagaacatactgtgtgccaataaatactgagcaaactctaacagggaagacagcttcttctgaaaagagagattacattttttaaaaaacaaattacctgaaacaatactaaagctatgtcctattttcccaaccagcttaaaagtaacaacgggcaggtttcctcatctttgctggtgtcttactctctgctccacagtcagcagcacagggtgactggtctccgctggagccgtgcagatctgtcccacgctagaggcaaccatcccggctgagagaatacccacgggaacccccagccttgaggcttgatcctgcaaagcagagccttaaacacaaaacaaaaccatagctttctcttaacacatgagacaaaatctaaaaccaaagacttgctgtttaaaatgccttattttaagatgcagcacaaaaaaaattgccttttaaacggggagaatagatgcaaagggaaaaacatgagataaaaatgagaatttgatgatccaagcagctcacaataaaactggtggcaacacctgaacccagagttatacattggtatttgttacgtttcccatgacacaaaaggagcaagataaagaaatatattctgaccaagaactttatcatctttttacaaaggagcacaataaattgagaactgcagcaggctctttcaattacattgtttttctaattacttcagagataagcctgcccctgttgactcacattgatggttgtgataaaattaggcagggatttcccaacattctgccatgcacctggtgggcaggtgcagtcacagctgtgctcagtccgcaggccaccaagtggaacctcactaacagcctgcaggcagccaccattctcctgagcaaccagccactggtctgcattcaataaagtgagaaacggtgggcaacctggaagcaggcaatgccaagaaatcattttctaatttatttgtcttccaaaattaatttttttttgttttatttttttgcaatggtgtcttacactgccgcctggactgaagtgcaacggcgccatctcagctcactgcaacctccgcctctcaggttcaagcgattctcctgcctcagcctcccaagtagctgggattacaggcacgcgtcactacgcccagttaattttttgtatttttagtagagatggggtttcactatgttggctaggctcgtctccaattcccaacctcattaatccgcccgcctcggcctcccatactgctgggattacaggtgtgagccaccacgtgagccaaaattaattgtttaaagaaaccgggccgggcacggtggctcacgcctgtaatcccagcactttgggaggccgaggcgggcggattacaaggtcaggagatcgagaccatcctggctaacacggtgaaaccctgtctctactaaagacacaaaaacaaaattagccaggtttggtgacgggagcctgtagtcccagctactcaggaggctgaggcgaagaatggcgtgaacccaggaggcggagtttgcagtgagccgagatcacgccactacactgcagtctgggcgacagagccagacttcatctcaaaaaaacaaaacaaaaaaaaactggaggccaggctcagtgggtccctcctgtaatcccagcactttgggaggccgaggcgggtggatcacctgaggtcgggagtttgagaccagcctgaccaacatggtgaaaccctatctctactaaaaatacaaaattagccaggcgtggtggtgcatgcctgtaataccagctactcaggaggctgaggcaggagaatcactttaactagggaggcagaggttgcggtgagtcgagatcacaccattgcactccagcctgggtaacaagagcaatactccgtctcaaaaaaaaaaaaaaaaaaaaaaaactgttaactgcagtacgaacctgttattgtaatgtactggctctaaaaacacattatcaatacataagtaaaaacatttacaggctggttgcggtggctcatgcctgtaatcccaacactgcaggaggccgaggcgggtcgatcacgaggtcaggagtttgagaccagcctggccaagatggtgaaaccccgcctctactaaaaatacaaaaattagctgggtgcggcggcgggcacctataatcccagctattcgggaggctgaggcaggagaattgcttgaacccaggaggcagagtttgtagtgagccgagatggcgccattgcactccagcctgggcgacagagcaacacttcgtctcaaaaaaaaaaaaaaaaaattttacaatagttctagaagcttaaaattatagtacgagaaatcatcagctgctggtgaaattctcggtagaaaagtagacagatggggcacagtggctcatgcctgcaatcccaacaccttgggtggctgaggtaaactgattgcttgagctcaggagtttgagaccagcctgggcaatatggcaaaaccctgtctctatgaaaaaattagccaggcatggtggcgcacacctgtagtcccagctactcaagatgctggggtgggaggatcacttgaggccaggaggtcaagactgcagtgagccgtgattgcaccacggctctccagtccaggcaacagagtgagaccctgtctgttaaaaaaaaaaaaaaaagtagacaatgccattttctgttctgagacagagttttgctcttattgcccaggctggagtgcaatggaggggtctcggctcaatgcaacctctgcctcccacgttcaagcaattctcctgcctcagcctcctgaatagctgggactacaggcacccaccaccacacccggctaatttttgtgttttttagtagagacagggtttcaccatgttggccaggctcgtctcgaatcctgacctcaggtgatccgcacacctcagcctcccaaagtgctgcgattataggcgtgagccactgtgccaggccaacaatgccaatttctagtcatttgtttccaatgtgtctccataggaaagtttttttatctacaagtcttttactgtgtgtgtgtgtgtgtgtgtgtgtgtccgtgtgcacgtgcgtgcatgtactaactatatctttagcagaaaaaaacaaactcaaaaattaatgaattaaaggtttatctgtgtggctgagcttggttccttggaatgataatatgcaatttgtgaaattcaaatacaatcatggcagtgaaaatctgtatcatttgccaatgacattcagtgaccagttgtcaagggagcgctattactgaaggttattttaacagaaacaagtcatcacataaggacgtgaaggatcagaaaataacttactgttgttgacccagaacttaccctatctcccactctcaaactggggggagaaggaggtacctagaaaattgttctcccgtctgctctcctgggcacaccacagcctgtctcactacttccatgagcaaggggcacatccctgctgttgctatgtcccatgtttttccaagggacactctgggtcctactgcttctgagtcgcaggttgaatcagacgctgtttttaaacacagcatcgtaagaagcccaagagcaagtcacacaaacatcccatagaatttgcgactacacacaccagtggaaacccatcgcctgagaaaatttacatttctacttaatttagcaaactatggttactatataaaaacccttctgcaattcaaaatagagaaaatgaagctataacttacctataaatgaactagaatgattagcataggcctcagaactgtcacagtcaatcactttgctgagagacaattttttacacagtggaccttctacctagaatccaaaacacaacaaactccatttaaaaaattcaagctccaggccaggcgtagtggctcacgcctgtaatcccagtactttgggaggccgagatgggcagatcacgaggtcaagagttcgagaccagcctggccaacatagtgaaaccctgtctctactaaaaatacaaaaattaggagggcatggtggcgcgtgcctgtagtcccagccactcgggaggctgagacgggagaatcacttaaacccgggaggtggaggctgcagtgagccgagatcaccccactgcataccagcccaggctacagtgtgagactttgtctcaaaaaaaataaatgaaaataaaaaataaaaataaaaaaaattcaagatctgtgcataaacacaacctgtgtgtaagtaatgcttccctactgggctattttcctttttttcttttttgagagggagtctcactgtcgtccaggctggagtgcaatggcgggatctcactcacggcgacctccacctcccaggttcaagcgattctcctgcctcagcctcctgagcagctgggattacagacacctgctaccatacccggctaatttttgtattttaagtagtgacggggtttcaccatgttggtcaggctggtctcgaactcctaacctcaagtgatctacccacttcggcctcccaaagggctaggattacaggcgtgagccaccacgcccggctttttttttttttttttttttttttttttttgtgagacagtctcactctgtaatccagactggattgcaaggggcgtgatctcggctcactgcaatttctgcctcccgggtccaggttcaagcaattctcctgcctcaggctcccgagtagctgggattaaaggcgtgcgccaccacacccagctaatttttgtattttcagtagagaccgggtttcactatgttggccaggctggtctcgaactcctgaccctgagtgatccacccgccttggcctccccaaaagctgggattacagccctgagccacggcgcccggcctgtttttttgttgttgttgttttgtttttaataaaagaggcggggtctcaccccgttgcccaggttggtccagaactcccgggctcaggcgaccctcccctctgcgggccaggccaccgcgcccgccgcctcgggtgttttcttaggaaagctgtgcggtggctggactcaaaaaccccgaacctaaatctgcccgcagacggacaccagcttcctcttacctcaagcaaaagggcattcaggtcctgatggcttcgcaggaggcgcacagctgattcctttaatttctgtgccctttcaggattatatttttccctcttgacccttcccgctacggagagaagtcggttcgaaaccatcacagcacaattcacacacggggtccccggcccgacgcgcaggtggacgccgcggagaaacccaccagcgacaccctcccgaagaggggccggggctcctccccagggcgcaggtctcgggaaactaacggagacggccccaccgcggacgccggggaagacggcccaggagggcccgaggcaggggagcccggggacggctggcgaggggcggcctctgcgctgaggggagccccaggccgcgcaccccaggcccgcctgacagggcggccggcgggggcggcgttcgggaaagaagggagcgccccgcgggcggcggctgggggcgtccgcccaggcgcaggaggggccgggtccgaggcagccgcgccgccccagccgggcgcccaccccgcacagccccccgggcgcggcgtccggggatccgaccggcggaggctctggcgggaagggatcggggaaccggcgaaaccgtcccgggccggacgccgcccactcccgcggcctgccgcgcccacctacccagcagctcggcccaggccctccggcggccccctgggtcctggcccgaggcggagttcgggacccacgagtcggacatggccttggcgcctacagccccggcggcggctccctgcgcccga

SEQ ID NO: 114 - DNA, 182393 bp, Homo Sapiens
tgattgcccctcagttcagacaatgtagagcttgagttggttagctaggcaatgtaattcagaaaacagaagagcacacaataagcaagaagccaaggttaatttttgttctgatttgtcctactacactgacttagtgctcagcttaggcctttaaaattggggaggattgtcagattcagcaaataaaaatacatatcatggagttaaactggaatttcagataacaagaaacaatttttagtataagcacataccaaatattgcatgggacatacttatactaaaaattgtttatctgaaattcggaagtaactgggctccctgtatttatctggcaactctaattggggatatatacttgatttgacaaagttactttaaaatcctggttcttctaaatattgactgtgtgtgtgtgtgtgtgtgtgtgtgtgtgtgtgtgtgtgtgtgtgtgtgtgtgcgcgcgtgcgtgcgtgtacatcactgatctgattgactttttttcatcaattgctctggctttatgtaaattatgccgtacccatgtagattgcaacatgataaatccagtgagactggcctcattatctcaacttaaactttagtgcagaattctaagctttacactgtccagagacttcaggtttgaaatgcatagctcaagatctccagtcctgtggttcccaaacttgcctgcacattagaatcgcctggggatattttaaaaatcccaagccttagacacaccttacaccaactaaacctcaatgttaggaggggcaccagcctctgtatttctgcagctccccaggcaattctggtgtgcagacatgcttggaaagcactgttctggtttataacccaatctcatagaggctatcaaaaggcttgcacctgttttccatttcaaactctgggagagaaacataccctttgatatgaagaatgttacctcctgtaacaatattgcttgagaactaaagttaacattttatgtacagtagagagagaaagatttttcaaaatctgttccagaaaatatttgataaattaatcctgctggtgaagtaatagttatatgctactctgttggaatgaaaacaaaaatatttcacagtccctattaatgctgcaaatacctagatgtaaagctgaatatttgttgtgagacattgcttatattgaggagtttatgtgggtatgagctcactgagttctgactgcatccactgaaaggtttcctgcacatactctgggctggaagagataaatctatcctgttagctgccctgtctcactcttcgctacctctcaggaacattttgtcctgccatagataaggaaaacaagtaaacaagcacaaatatcctctttgctgtacattaccttttaatgttgtgcctttctcaattttctcctcactgcctccctgttggtgctaacgtttctttaatcacattcacagaagtccagcacacagcagcaaaagttcaggatcacttgtgccacctagaaaatattcttacattacgatggtatttcaacacaaaacagtacagagttaaaagaattcatgctgcaactgtctattggtcagtggatggtttaagtccttcaacaacttcttttacatatggtaatactgctcaggtttcccaaacttaccttatcataatgagactcacctaggacccttgtgaaacatactaattctcagcaaaattcctttcagatgttgatttataaagttgggtggaatacaagaatctgtacccttaataagcactctaggtgattattatgatgagataaatttaagaaacactatcctggcttactgactgcatactctcctagaccaaagatggaaaatgggtttcattttgcttcccaattctaaatagttgttagggaatttttgaaatgctgtgtgaaggattcttagactgtacctgggctctgtgggaatgagatctgtcatcaattagcaatgtctggcattacataataacagatattaaagactaatttttaaaaaagtataactagcaaacaaggggggttggatatggaataataaacagacaaaatcaatctaaagcaccagcatggcacatgtatacatatgtaactaacctgcacattgtgcacatgtaccctaaaacttaaagtataataacaaaaaaaaaaaagaaagagggaatgcagaaccagacagacaaagagaaagcaaatagagaagtggtagattaaacccaaatatattataaatgcagtaaagaaaaatagaataaatacctctattaaaagacaaacattttcagatgaaatttaaaaataaaactcaactttagtcagcctccaataggcacacctataatataaagatagagaaagcttcaaagtaactgtggataaagatatctcatgcaaacactaaccaaataaagccagtttagctccattaatattagataaagtagactttaagaccaaaattattactagaaatagagatatttcataatcaaaatgatcacttcaatagggggatgtgattactatagatatgtctacaacgaataacatggcctcagaatacaccaagtttaaattgacagatataaagaagaaatagacaaactcacactcatagtgaggaattgtaatatacctctcagcaactgatagaaaaaaagcagacagaaagatcagtaaggatataaaacatttaacaacataattaacaaactacaccctcaaatgcagtaaacatatacttttcaagtcagaagaaacattttggtatatttatcatgagttggactataacgcacctcataacaaatatcaaaacactgaaataatattatctgagtaaatagaattaggctaaaaatcaatggtacaaagataactagaacatctctataaattgggaaataaccaaatacttctgaaataattcaggaatcaaaaagaattcacattggaagttagaaaatattttgaattgaaagataaattgtacatatcaaaatatatgaactgagctaaagccatgcttagtgaaaaatgtatacttcaaatgcatattttataaagatggaaagctgaaaactgattatctaagaatctatttcatggagacaaaatgaagaataagatattaaatccaaagagtgtagaaggagtgaaaaactatgaaaaaaaacacaaagagcaaaaattaataaaataaaagaatggtccattaagtttactgattatcttgtcatgaatgttttcaaatcagcatttgggaagaaccagattgcagtagtttaaggtaggtgaggatatggaaaaagcaagtatagattacttgaaaatttagctctcaaagggagagagggtaaaacaaatttctgcacaatctcactccctgtcatcattagactactcacaggttaaatatatatattcattcaaaagatgtttattgagcacctactatgcttaaacatggaaagctgtgaatatagtagagaatgagagggacaaagaagtagaaaatgaggttgaaaaataggtaatttcaagatttatttgcaagccagtataaaggattttattttattctaagtgattggaatccactagttagtttcaatatagcaaataggctattgagtggatagttgtggtgtcaagagtagcagcagataagttaggaggctattgtagaactataggtggaaatgttgatggcttagattatggtattggtcatgagaatgaaggaaagtggttaggttcaggattctttcatttgttccacaaaaatttatttacttcttactatgtgccaggcactgtgtaaatccttagaatacgttgcttcacaggacagaaaaaaatgcagccttttgatgaaacttacattctagtggttatgctttggaggtaaaaccaataggtcatgctgatgcattttatgtgaagagatgagaagatgaattgaatatgactcacagatttttggcttaagcaactgggtaagtagtgttaccatttattaagatggggactattgtgacaagcgcagatttggagtggaacttgagtcacatttttatgctcttaagttcagatgcccatgagacatctcgatagagttggcaagtaattagatagaaatatatgttcaagaaagggataaaatctggaaatgtatatttggcagtgaccagcaaacagatactgttttaaatccacaaaactaagtgagattacacattgagataacagaaacaaaaaaaaaagctctgagaatggagcattccatcatttagaaagcctatctagagtggattgggcagaaaaaggaacaaaggaaatggtgacaaaccttagatatcacttgcaattgcctttactgtgcaggggaacatagaagatggtatggaataaaatgtgtgctcatggggggatatattttttccaaaatggaagataaaagaatgcatttggcaaaggaaaagggaggtattcacattgcagtgaaaggagggcataatttcaagaacaaatgtcttaagaaggtgagaaaaaataaaattcaaagcaaagggtcagggttggcattacatggagacaactatttcacccattttaataatgacttaaattattgccagttcatagatggagatactgaagcacaaagaggttaaatagcttgctcattctcatgagccaagaagtggtgtagtgggtctgaagtgagatactgtgttcccagagtctgtgtgcttcaccattgtacaaacaaaatgggagaatgactatggttgctagccaattggtatgtccaattatgataggatgtaggagctcctaactaatagctcctatcatgtccatgaattctgaggctatcagctaagagtatggtggaaaaaagaaacataggtttgaggaagaaggatcaagtattaaatagtagtttgggagggtaaaaaagccattcctccaagaagagtaatggggcagaatgctgaggcagaggcagtgggagtgcccatatgagaactgtggttatgactttaaagtgtgaacaatcaggaggtatgtgtttccccccagcaagcttccaggatcagattcaggtactgagataacaggtacttcggtttaactacaattgaagttttgccaaatgagcaggaaagtgagtggaagacaaagagaagacaatagaggagttgaaagaagagaatgtagaagggaagaaggaaggaagaaagaaaccaagaaaggagaagaagggagggagagtgggagggagggagaatgggatggagggagagtgcgagggagggagggagggagggacggaagtgaagttaagggaggttgcatggcagtagttgcagtgatgaaccagaaattctaaggtggatagagaggggaaaacacggaagagacactgtattcaagagagagaaagagagagactcaaaattaagatttcacaggaagtaaagacaaagataaggttatgatcataaataagcatgtgtgactaaggttgggttgagaaaaaattattgacagcaaggcagtccaggaattggaaggccgaggatggggtctattatccatatgaatattgaagatcccccaataaagatgacattagtatgagtgttgggttgacagggaaatggatgctaaagtcatcaactaataaaggagtacaactaataaagggtaacagcacagataggtaacagcagtgataaggaaaatcagtagtgaagtctaatgacctgagcttcagagacgccaaaggatctgggtttgaggaaggaggaaaaagatatggtttgggcattgcagtggggagcaaaaaggataccttagattaaaagatgttttagagatgccagttggcagttacaatccctgctatgtttattgagaaatgcaagtttgcatgtttgacatggagatgttcttaagtttgtgtatggctattcagaacataatgttttattaccaaagttaagtcttggggggagttgaagagcaaatcaaatcatgcttaagctttgtggtcaagtttcctaattatcaccgatggttgaattttgaaaaaataggcaagaaatatttccaattatttgtcccttaggaaaggcagcatttttcagctttttaaaaaagtctgaaccatggttagaaaaaaaaaaatgataacaagagctaacatttattgagggcttactatatgccaggtactcttctagatactttacatatagtaattcatttaatcaccactacaactgtgtgagtaatgcaatcatacagcccagtttacctgggaaagtcttgatttaggcctatttttccaataccttgtgtgatttagaatttgtcctggattactcattttaaacaaaatgttttttattaatagttgcattaaaataagtggaaacgggtttggttgacctccactttatagacctggattctgtcatagggtgatcctccggtataggggtatgcatgtgcagtgaacgagttctcaccttaacacatggtgaaatcgaaaaaataataataatcactactatccaggcatcttttcttcatatgttccagatgcagtgtcataactaacactccctttccaggatagcttgcgggaggggagcttgcttataaaatgaagtgcaattggacaccagaggctggggacagatgttgctctctatcagtgatgggtcactgctgcccctactggtcacttgggataccagccttgttctatggcatggcatggcatggcatgcaaaatccatgaagccaccgggctatcacttcatagggtcagtgggaaacatggaaaatcacaggttctgtacacataaaaaggaaagaaaaactgagcagtcttgctgttgagcatctgaatgctcataattgagtgatttttttcatttttgtatgatataaatccgttttaactacgttttattgtttgataaaacttttttttactttgcaattgtcaacattatagagttgtaatgtctgtcagtgccacttgccactatcaaaattgtccttgtttggattaaattgagtaaattaactaataacaatgaagatactgttcttatctcaatttacagatgaggaaactaatgcaaaaagaaaatagggtgaggcaaggtgaagcaaatagggtgaggcaagtgagtcacacaagtacagggtcagatcctgttttattttttatttaatgttttgttcaccatggattttttgtattaataatgatattttcaaacattgcattaaatatcatttgagtactggagttttgggtaccccctcagattttgcccctgaggcctcacttgttttcccctagtttggggcccacctagtcatgaactactaaattaattttcacagaaatgcattgtggcctgagttaatttttttttaattatttaaaaatgttcaatattttggccgggagcggtggctcacacttgtaatcccagcactttgggaggccgaggtgggtggatcacctgagggcaagagtttgagaccagcctggccaacatgtgaaaccctgtctctactaaaaatacaaaaatcagccaggcatggtggcatgcacctgtggtcccaggaactcatgaggctgaggcaggagaatcacttgaacccgggaggtggagattgcagtgagctgagatcacgccactgtactccagcctgggcgacagagtgagactctatctatctcaaaaaaaaaaaaaaaaaaaaaaaaaaaagtaaatattcccaaggcaatatgtcatctctttaatttcctactgagaaactgacctctgaaataacatacaggttgatattttagaaggtataacaaaaaacaagagcagatcatctcccaaaaagacaatggcattaagctttattcagggaaggtatttattgagagaacacctgagattacatttacatgcatgggaagagtgtctggtatttactgagcaatcaagttatcaaatggggtcactttcaaggagtggccgggcaatgtgcaactaggtgtatttgctttgattatcttttctaggttttgtaaagcagccactgtcaattttatcaaaacagagtttctcagaaacaatcacgcccagatcttccctgacagaactggccaaccccagtctattagaagctgatgccccaggtctatgcaataaaactctgttttaatgttatcgcctctgctccaataagaaatatgtgcaccatgtgaagttataacaacttctctacaatgcagcctcacctgcatttatctcccactttcattttatatctggctgcaccatgccttacttctggcattgtacctaatttcaaatgtttccagttacccagatagccctgacttctttttgttcagctactaaatagaaattgtggctgcttgagaacatggttatggcatgtgggccacctaatgacaagttgccttttacttatttttcttctattttgtttttaattgacacataatagttgtatatatttatggggtacaatgtgaggttttaaggttttatacattgtattatgatcaaatcaggataattactgtatcaatcatatgaaacacttatttcttcaccaaatcatctcttctagatattttgaaatatacaatacattatcattaacgattttcacccaactgtgcaatagaagaccagaacttattcctcctatctaactgtaacatagtacccactgactaacttctcctcatctctccctccccctcattttctctaggcactgataaccactattatactgtctacccccatgagatcaaattttttagattccacatatgagtgagatcacgtcctttgcagggacatggatggagctgcagggcattatcctcagcaaactaatgtaagaacagaaaaccaaataccactcattctcacttctaagtgggagctaatgatgagaacgcagggacacatagaggggaacaacacacactggggtcttttggagggtggagggtggaaggacagagaggatcaggtaaaactaatgggtactaggcttaagacctggggtgatgaaataatctgtacaataatctgtacaacagacccccagttacagacatgaccctcagtgtgggataggtgaaatgtgagagatggaggtagcgatgtccatgaggcagtccagcactcaggagagaggactgggttggacagacatgctgagaagtcattaggatatagatggaggttaaagctatggaagtggataagattacccagcaggagtgtacagagtgagaagagaagtggaggagaaaggttgagaaagagcaggaaggggcagggacggagcaggaagagggaatggaaggggaaggcagtgtaagggaaggcagtgtaaggcaaggcagagggctgagggcaaactcctgtgagcaccagcatatcagagacaggcagggggaaaggagcccatgagagagacagagaaggtcagacggctatgtaatcactcagaggctagaaaaagaaacatattcaggaagaaaattcatagtatctaaagatgtggagttcacataaaataaaagctaagaagcagccatggattttaggaagtcagaggacattggtaacctcaacaacagcaggctcagtggagagacggaggcagacacaagattttaggcagtgtagtagtgaagtggacagtgaggaagtgaggacattgaatgcagccattttatccaagaaaaagaggcagaagtggctgaggaggcatataggccatggatttttttgttggttggttggttcttttgctttttatttagtgttttttttaatgagcaacttgagtacatttaaatgctgatgagagagttgtttatagagagaataatattacttacaggagttttgaggaaaggtgggagagcatacttaggtggagccactagccatacccagtagaaggtattccttctgataactgggagacaaaagaaggaataagaataaggacatggcaagtttgtgggtgggtgggtaggcggacaggattttgaaggaatccccacatgatggcatctgattgttttctgtgacacaggaaacacattcattttcagagaataaagagggaggtgacagagtaggaggtgtgagaacagtgggaaaactttgaaatgtttgtgaattgcgaaatacatcaccaggaacccacagaagttttctcaagcaggcttagggtccatcggacgtaggggaaattggatatgtaggggcatcaatgtgctggattcggtgaggttctccagaggagctcagcagcctagaataaccagatggtgggttccacaattgatccaggcaggactgactgaaataaaaatgggcaacccctggttcaaaaacaattaagaatttcaagatggcaacagcagagcattaaactaagcctagcacccctctgtgtatggaccctgtgtgtctgcacaggttgcatgcccgtgaagccaatcttggatccaagctgagggttttgccagacaggatggatgaatggataaaaatatgaatcacgtgatggtccaagcagggtagagaaagggggatactgtaaagaagagatgagaatgaaaggagaatattttacacataagtgaaataaatgtaagcaataaaatgtggcagttagcccacttatttattctttatttgcaataaaacagttaactctagcttttaatttcaatgattctttatatttctatagttaccaaatttagttgaagttctagttttgcacagaccttcttaagggagttttgctttacagattttttgaagggagttcaatgtttaaatgagaaagaaaacttgtatcaactagtgtcctttttgtgttgttttgtttactggggtagacaggctcagacaaatatttcagtgcagaatgttgtgtgctgtgggaaaggtttaagtgcatgatttaaagtgatgactgaggacaaagcatcttctccacttggtagtgccagggagttgagcctttgtctgggtcttgacacaggagtagaaatttgccaggtcaaaaggaaaattaagaggatatccaggctgaggaaacggttatgcagaggttcagatgttagaaacgacatgatgctttcactacatcataaaaagttgagtcaggaaagtgctaaagcatggggcctaaaaggaaggaagacttcagttgctcttgaactgggagccaccaaaaggctttataaatgatagaatgctacaatcagattggaactgtggaaacatcactctatatagaaaggatcagattggaataaggcacaagatcaggaaaatgctgcttcagcatttcaacttaaaaacacccttaattttataagtagtctacacttccctgaagcccctccctagaggcatagatcattattactattttggtttgcctttttgtaattttgctagaactagctttccaaatctgggatgtatattataaacttaccaaagcttgtcttaagtgtgaatataaaagtggctttctggtttgaattctttgcagtaacacaggtgtcttatcattgctgtaacaaatcactacaaacttaatggcttaaaacaggaaaaacttattatctacacttctgtaggtccaaaatgggcctcactaggttaaaatcaaggtattggcaggactgcattgcttctggagggttgtcacgggggttcaagggattgggggccatatcaaagaaaaagatatgaccacgcaggcagtaatacacaacaaagtttattgggtggcacttggacagggttgcgtgaaaaggtggctcctcacagcatgaaatgatccagaggcttagagacaggggccaccatacagagaggagaggacaaggggactcccagtggggaggtgaatcagagggggctcacttgtctaggtgatgttgctcagctgcacagtgggggagcctctgggtcagagagcttcaaagagcagcagtgccatgggaccttataagtgcaaggaccagcagatgctaggcatggtttcgtgggctatgcaaagcagtcagggtctagatggctaaaaatctgcttgtttaggctatttttaaaataatggaatgtgtaaaatttgagtttggtgccagcaagctttggagataacaggtctcaacctatagtggggaaataaacaaccaaggggacaatactcagaggccatctttggctcatttatataacagtgttctaggggagaatctgatttcttgacttttccaacttctagagctacttacattccttggctcatagtcccctttctccaaaggggaaagttgttcaaagccataacattgcatttctctgacccttcttccattgccatgtgtacctctgaccacagttgagaaaggttctccatttctaagagtcatgtgattaagttgtgagcacgtagatcatctagggccctctccccatccttagtttcttaatcacatctgcaaagcccctctgctttgtaggataacatattcacaggttccaaggattaggacacagacatctttggtaggcattatcctgcctgccacaaacagcaatggtttccactgcaactctgagagcatccgttgggcactgtagcatgctccatgcacactcaggacagtccagaagtaccaggaggtgaatgctacaggagtggccctcaaccaatgagaactgggagttggtggccaaataccaagcttcctcaacccttggtaagtcaagtctcagtctctcagaggtttgagccccatttggcaaccatggtcacctgctgattattcacacatcctttattgacttttctcctttccttgtcctacacttccccactccctcaccacactcctgttgttgcctcccaagtaaacctcttgcatgcaatccctcatctcagggttgctttggagagaacaaaaacaaactaaggtgcaatgcctcctaggccaaggacctcatgagaatcacaacccactgaaccccatcctcggcctccccactaaacaccagattctggaggactttttgtgcctaaagtgtggaaacagagggaatctaggagcagcaagtgtcaaacaatggtttattgtaccttacagttggcattgctaaaatatttctgtgctgctgagcttctaaaataggtttcataacacaattctattgctttatgtccctgaaatcaagcctgtgccttcagctctactagtgtttcataaaggctatgatggcagataccttgaaccttcttctttcactatctagctcttaattggtgtaagattctttttttccactttaaaatccagatcctgcacaatggtttaagattcttgatggcaacttgagctgtagttatttcagcataactggactctcataaaaagatcgagctaaatgacagaaaagtctggtgcttccttggcattacatcagagatgtgggtttgcctaatcatagtagtaatttgtctctatcactgttattcttgtttttaacaagctgatttggggacaatatgcttaaatggagttatttcccacctgattgatgaggcagcatcagacgcgagtataaccgtttataaaataaatgaccttggctctgtgcaggagtgggtaaaaggaaacgacccctgccttcttagttttcattctaagctgctagacaatcctagatttcatttcttcaacaaatagtttttgaatgcttgccttgtacagtgttttgttttagataaggggcagataaaaaaaactgcttgaaacctgttttcacaaaattttagaggtcaatatcagaaaaaaagtacaaaaatgttctaatatgaggtagagaattttaagaaccataagagagttatagttggagctgtggcaattcccaggaagggagagtatagtgtacttccagctcttaaggagggaggagattctcaagaaagaagcagcatttgtaaagttcattttatcttagaatgttaactgtaagttattctaaactcatcttgttattgtcagtaaatgaaacagagattaaataattaaataggtaatgaaaactacattctttaaggtggcatttaatgctcattagaaagtagccttatcctgccttgctgatacacatttacatcagatgaacctggagagcttcccactccaagaccttcaagaggaaagtgagagtcagtgacacggaagctttgtttgatctaaggcagtggttctcagccaggagctatttttccccaccccaggggacatttggcaatgtatggaggcgtttttagttctcacaacttggggttggggactgtgtgtgttgctgaactctaatgagtagagaccaaggatgctgctaaacatcctacagtgcacaggatggtgcccatagcaaagaatcatctgacccgaatatggatagtgtcaagtttgaaaaaccctaatctaagggacagaagcatgctgtgcacacagaggactgaggtttagcttcatgagtgcaagctgcttatgaataaagatgtcactcctgtcaggagtaattaattagagctagtataacccagttgacaaaatagtcagaaaaacctttcattaagaatttcctcttttgtaagtgaactcttttactctacataaagttctttttatttacatcatatagcaaatcagggatccaaaatatggttctttgtactggtaatgaacaggggcatgaattttgttgggtgtatgatttaattgcttttcaaaatgttgacatgttgacatgggtgtaaaaacatcaggaggttaagttattaaatgcctccacttcattccactctatctgctgctgctaggatttgttcaagagcaacagaagtcataccagaaatgagctctggtattttctagaaacaaggtaacccattacagcatggttctcaatcctggttacacactagagacacctgggagctttttaaaatctaaatgcccagaccccacctcagaccattaaatcagaatatttaggtgtagagcccagacatcttggttttataaggcttcccaggtggttgcaatgtgaagccaagtttgagaaccttgcttctttaaatgtcatctgttgaccagcagcatcagcatcacctacagcttgctagaaatgcagcctctcaggccctaccccagacgtgtggaatcaaaaataacaggattctcaggagattcactagcacattaaagcttgagaagtgctgctctagaatatatcgcagagagtccacttttaaattgtatgcatgttgcaatatgcacagtctaaaacaaggcatactattactattaagacatggtaaaaagctccaaagctttaaatagaattattttcacttggtaagaaatattaagtttattactgtggctgcttgtgttttgcactaaattttatttttaattgtgaaagatttcaatcatatagagtaatttaaccctatgttgcttgttgttttgtttctctcaagaagagtaatcactaagtagcctaggattatcattctggtattaggagccaaatgggaaccccatgaaagaccttttcctataactgagaaggttccttctcagctctgtgttcacatacacaaggaggaaatgatctgaaatggcatgtaacaggatccatgatagagtgaggagcttcacctttgttaacaagattgaacagtgcacacatgcattgtagtaaaacaataattctaaatagtcatacaacttcattctggaaagcacaaaatgcttcaaattatggtagtttggcagtgatatctccacagggagtttataaggtttgctgaatgtcgtacagccaattcctgactgccagacctgagacgccttaattcaacacagaatcattgaatgttctttcacacttcctgtcttttagggcagattgattaaaataaaacttacaaaaatacctgtcttaaagtcagccttcttcatcccagccaagtaccctatcctgtcaatatgtttcattacagcaccatttcctggaattactgccattgaattcccgtcctcttaataacatatactttttctctccaaaacatgcaaaaaagaatatgagagagaagcatgacatagtgacacatgcttagggccaggagtccagctggctgaatctaaatcctggctggtgctttatttgctgggtgattagagtcatggcctaaccactctgggtctcagtttcttcatctgtagaaagagtctaataaagtcctttctcatgggctgctgttaggagcaagcaagattatgcacgtgaagaacagtgccttgcatacagccaatacttatgaagtatttcctttctcttcctttcgcctgctttttgacatgagaatattgcatgatacagagtttggagcatgaatcccttcaccctggtagtgagcttagaacctgataggtagttttttaacccaccccccaccctccaccctctaaaaaaaccaaaaaacaacaacaaagaaaatatcatggtatatcctgctttgtaaaagtaaatactactttgtgaaacttttgttgccattagatatattaatgtgtgtggaagtgtgtgtatgtgtgtcctggttagtaatggaaaatatgttttcctactttgacagcaaaaaaggtgtgtgtgtgtgtgtgcacgcgcgcgtgttgcatgcactgttagatgacagtctttattttttttctagctttaaggtataattgacaattagaaatcatatatatttaaggtatacgacttgatgatttgatatatgtatacactgtgaaataatcaccatgattaaactaattaacatgtccatcatctcacattgttaccagtttcttttttttccttcctttctaccttctttccttccctccctccttctttctttcatgagaacactaaagatctacccccttagcaaatttcaagtatacaatacagtattgttaactatagtcacattgttgtacattagatctccagagcttattcatctcacagaactgaaactttgtatcccttgaccaacatcttcccctttcccctcactctatctcttggcaaccaccattctactctctgcttctgtgagtttgattattttagattccacatataagtgagaacctgcagtatttcacagcaaaaagttttgaaggccagtgctctcagggtggatcaggccaggtaaacaaattcacctgaccatctcaggcttaaaccttctcacataccctcaagaggcagtcacagacacagtaggaggggtcatttggttgccatgatgacagggacaggaggtatatgttgcactaactatattgcacctcactaaaacttgctaagccctcgcttttgtttgaccagcccacactcacacgccacctgagtattatgatgcccatgacccagtgggctcatcactccgtgacctgccttcagagttcaagctgtgtcatcctcagctggacacaacatctgcccaattatacagcacacagctgggagaaaagagagacatcaggccaggcgcggtggctcacgtctgtaatcccagcactttgggaggccgaggtgggcggatggcctggggtcaggagtttgagaccagcctgaccaacatggagaaaccccgtctctactaaaaatacaaaattagccgggcacggtggctcatgcctgtaatcccagctactcgggaagctgaggcaggagaatcacttgaacctgggaggcggaggttgcggtgagccgagatcgcgccattgcactctagtctgggcaacaagagagaaactccgtctccacacaaaaagaaaaaaaaaagagagagagacagcaactcaggagttaagtccattttctatgaaaatatatcgtcttagaaccatatcaggttttcctttttgcctctgattataactattgtattgacatctttgaaaacgaaagggagagctgggcccagtggtgcatgcctgtaatccctgctacttgagtggctgagatgggaggatcacgtaggccagcagttcaaggctgcagtgagctatgatcacggcactgcactgcagcccggacaacagagcaagaccctgtctctttaaaaaggagtagggaagggctacagaccccccatcatgtgccaaatactgtgttacataccttcatgcacactttcttaactagaaactcagctggtcaacaattagatcaacagatactggcattattttcccatagtgaccaatctgtcttctgtgtttacttcaatcaatcttccctctgggcctacagacaagttttctctctgaaatattaaatctggtaaccgtaataatgaagcagagaaaagaggaactcttggaaatgcactacagatactccaccaaacaaactctcattttatccataattttccatttttttccagcaagagttgcgtataagaagctataagcgacagtgaacaaacaaatggttgcagggaaagcataagggagctaggacagagatgatctgcaaagctaaatcaatcataagccagaataatggagcatagactgtgtttctggttcactctgctgctttgatctgcagtccaatgctctacctctgagctataccccctccttactctgctgctttgaatgtccttgagagaagcaataggaaagtgcctcctgatggtttacagtgttcacctgcttcggtaactgctaattttaaaccagaacctacagtccatattcattaaagaagagctagcttaccaacatcattcaaattcaggagataagattggccagagaaagcaggtttatagtttttcacctggagaaacacatttgttctgcagctgtggaaagcaatgacatgatggcccatagatgtctctctcctcaggacatgcctcactgcccctctgctagaaacctcctaacacttctccaagtcacacctgggcgatttcatcatgaacctaacctgtctcttctaagttggcaggaagacatcgagggccagaccaaatatagatctgatcctagtgattgagttctcagttcttgagtttactgagccccctgcagaaacaaacaactcaccaaacttccactgcaaacagcattgactttcatccctctgagctacttccagcagaaattgagcagtaagagggaagaggggaaagaaagcagtggctatctggaaggttgatatcattgcttgaagcctctaggctatcaaaacaatataataaagacaggcctctgtgaacaccatgtgtcagcctctaaaaggacatacattcattatttacataatgtgaggtaacatgttactatatcaggagttttcttattctatattctatattttatatattctatattagagtcatcttcaaaattataacagcagcaaagggacttgttgcctaattaaaacccttaaaaatgatgaaataaaatattatgtacgtcaaagataattgaaagaggaaaatatgcctgaactgaactgttgttacggttgattatattagaacagggtttctcaaaactggactagaaacttctgagagattatggagggccatagcaggacatagcttatcaaatacatctttcctgaacttgggtcagcaccttcaatgtggtttaccctcttagacttcttaacttagcagtttttacacacagagactccataaatagaagagatataaattttcacctagtcccctaacccattcaacatttccaacaaatggctgaatacttgactatttctagcaatggtgagttcattaccttccaaggtggtatgttccatgttcagtcacagagttgttaaaagttcatcctcatatagagttgaattctgtctccctgtaatatcaaccaacagtctctgattagtttccttggagccattaatacaaatatgagtgaactcaaaagagcccttcattcttttgaaaatacttgtcatatcagccaggcttatctcttctcaaggccagccttttgttgttccttctattcttgttccttttatgcttcctcatgtgttgtcactttcaggaacattcaccaccctgggagggttcccttgcccccaaacttattctcaatctgtcctgtttgtatctcataatcctacccctttttctatccagtgacccagggacaactgtttataaattggaatatcaatgagattctctctttcaagaattcaaacagaggttctgatacgctaattagatgacagtgaggacttgagttgaacagtttcacatagagctgaggcggtgtgggcctgattggaacatgaatgattatgggaacctggtaagagaagagcagaaattggagagagcatgagccctgagaaattgagaacactctcacttcctgacttgctcattggagctcctgggctagatagccctgtgtataccatcatgctaacatttattgagcatacactatataccaggcatgtaaacttttaatgtacatttccctgaatcttctcaaaaaaccctctaaggaaggagatatcatctctattttactacaaaagagactgaggcacgtagtaagtgacttacccagttcccacaatggttagtggcagagccaagatttgaaaccagagttttcgctccagagcccaggcttctcacctttacagggcattgcttccctatccttggaaacttatgagattatcttacaataattttcttataataattccttaaagacagttccatttatttaagctactatgagtgagtttctgtcctttgtaacaaatcttccgcgattaagatgccagatggttaaaagataccaactaatggccaaatggcagaggcagtgcattttgtcatgttattatagaaaaaaatgccatctagctttccttcaattgccttggcataacattaccttttccatagtatctggtggtctgttcctttgccagagcagatatcacattatattatagtcatttgtctgtatcagggtttcccaaccttagcactgttgagatttgatgctagataattcatgctttgtggtgggggctgtcttgtgcattgcaggatgttcagcagtatcctggcctctatccactagatgccagtaaaacaccctctcccagttgtgacaaccaaaatgtctccagacattgccaaatatcccctagggggcaaaaatgaccctagttgagaatcactcgtctacatgttctagatcctctccactaatcgcacactgacttcaagtgcaggattttgtcttctttatccttgtttctgtccaacgcttggtacattaagataatcactcttaattgaaaaaaaaaaaactatagttgcttgcattaaagtggcgttttgtagttaaaagtctggagtaactgtacacctgtatccatctgggtatagtcatgaagacaaagacattaaaagtagtaccaaaatcaagggtttaatatagaaattaggctttatatgaatgtgggggagtaactgggggggttaaggtctaaaaggcaatagtcaaaggatgggacttaacatgaagttctgagtagaaaaccaagtgttcacagaaaaatctgagaagtcaccaggtctaggcaccaaagtaagatcataaagtgggagtccacagaaaggtctagccaccgtgtctaacaaagcagcctcttctgaccccaatgattcccaaaagtaatagcctctgcttcctttctgctttccagatcttccaagtttctcttactgaaaaatcctaacctgcaaccaatccagaagagaattctgggaaatatagttcttcccagccttaggcagatgcctaaggagtggtggtgccagataaacaacagataatcccatacaataaccactttggcaccaagtgtgtggatatatatagagagagaagttgaagcacgataaagatctagagaatttggcagtcagaatcatccaagttagtaaacaagcaaatgcttgatgtgatttgtcactgatgctgttattattgttttgagtttagtagtgggttcatcccctaatcacctgacccctccagtctcaacattcaccttgcaccctgaacagatggcaaatgatattaataatcaaacagctcatactccagatggaagatgttcaccttcatgcttcttagaattttgtgtgtcttttgagcactctagctagagcagaattgacagaaactgctgtgaaagaatttccatatgcaaggcattgcttctcttatgaggaattgaaatatcacagccatattatccatttctaaactactctctaaggctacagatgacattaaataaaaacatttctgcttgatagattttgaacagaaagccaaacaactatttttaaacaattacttctagtccatttaaaatgtggtgctgtaggtgaggtatgatccaaagaagagtgaaaaatatatttcactatagaaaattctattcaaaatatacattgaaaagacaaagacttcagagtttgcatggcccacaaagcctaaaatgttgactatctagccctttacagaaaatgtttgctgactcctgggctagagggagaacagcaggagttaaggtctgagaggtaaaggggatgttacaaggacttatgaggagaaccactggagagttttgagctgaagatgacctgatttgactggaaatttaacagaatccatttatttgctatgttgaaaatagacactattgttgggaggacaggtctagaagccagcagaccatgtagatgactactgcaataattctggtgggaattatcctgatgagccaccaaggggtggctcagaccagcatgtagtgttggagatggcaagaagttattaggttctggtttgaagcttgaactgattctatttcctggtttgaagcttgaactgattctatttcctgatactagatatattgcatagccccacataggtgtaggggaggctagaatattcagactttccacgtacacatttatgaccagccaaaacaggggttctcaagtagggttgatttactcatccaggagacacttggcaatgtcttgagacatttttggtgtcacagttcaggggcggggtgctactggcatctagtgggtaaaggccatgtaggctgctaaacatcctgaaatgcaaagctcagttcccaagaacaaataattatctagccccaagtatcaatattcctgcaggtaagcaaccttgaactaaagaaagatccaccattatgagaagaaataaagaatgggttttggtggtaactaggagttgtatagcccaactcaactccctatgccgccaccccagccatttacaggctgtggcaacatcagttccaagatttctgctcataccacaactgagttctgtttgttctcccctgcccatacattttccccactactgggggtgaagtctgtcatgaataagaggccctactggcatttttaaatgcatgaggcttgtaaaaataacatgtgtgatcaaggcaatgaaggtgatgttgtataatgatagctaaatagtacaaagcaccacagtgcaggtattaatttgttttaagagatttatgaagagaatattccattaattagaattttaagacttaaaaacggatgtttggtaattactatagatttacagggattttgctttccttgctaaacccaaatgaatagaatatgagttcaaataccctaatgttatacaaatactccttagtcttttgctatgggtgttaactgataagatcgaaatttatttggtaaaatatttgaatatatctaatatgtattgacttttaactagctttattattttgaattgtaaacacatacataaatgaaaaaaagtctttatattctaaaatttttgtctattccatttgttttccttgcaaataagtatgcactttcttttaagattcttaacagggtgaatctaattttcacactatgtggctgctcacgagcttaatacttggccaaaaaaatggacggtgtttcaaaaatagaaaacctcagttattgagtgacattgttaagcttaggtttgccctaattttatataaatccagtatgcaaaaataagccatatggtaaataagcaaggaaatgacttttcaagttacaaaatacttttttcatattaccattcacttaagcctttactttatacatatatgcattcaatgtaggaagattcagccaagtattattctaggcactggggatatcaaaatatgtcagaacgggcccctgcacttgaaagttacatgaaagaggcagacacgtaaatagttgaatttaatatgatgcagtagattccattatggagacatgtactacaggaggtaaggaggaacccatggctcaggatcaggggtcaagaaaaggcattctgaatagaataatggcagagtagaatcttaaaagacttgaaggagtttaccaggtaaaaagaggtgaggattattctatataaagggaagcagtttatagtcaaaggtcatgtaatcctatgagagaagtaggtgtaaggcaggacatgggggtccttgaatgtcacacaaaggagcttgggagtggtcattaaggagatgagaaactgttgaaaagtattaagtcttgaaatggaagcaatggtccaacggcatctattccactaaagtagaaggcagggatagctccataatctgcgtagcacagtgcaaaattaaaatgtaggtcccttgtttaaaaattattatgaatgtcaacatggctatagcagagcattaagccaagcacaggacccttctaagcactgggcactgtgtgactgtatagtatgcatactcacgaagctgaccctgtcagaaggtctcagggccggggttgaaagaagacaataaaacccttatttgcatgtgtctactccctggttgggaagaaaaatcttaaatatatcaaccagctagagattagtctcaaggcaacatactagccagcattatagtcctatacccacaaattcagaaaatggccaaatgtcctatctcttcattttaaagatgaggaaattgaagaacaaaaaaaaattgagggactgtcccaacctcacacatctaggttatagtaaagatgtgaattcaaccaaagcctttcagattctagcccagtgatttcctctgttcctctgcaatatccagtctatttaaagtgagtagaagaggatggaagtcctttgagggaagagattgatccagaggctgcagaaaggactacaattggtaaagagagagttatctgccaggagacaactgctgtcctctcccttcccccagggagcacgacttttctgtgtccttacttagaattaagaggatcactacaaacacaattattgagtaatgattaggaaccaggcaatgtactctagagaatagggctacagagttaattttgacatgctcccaggagctcacccctctggtgagcaaagataatagtgaaaatcagctatcaaaacccagagtccttgggcatctatcctttaatatgaatgggaagcaatattaaagaaaataataaaaagaaaaatggaaattaatacctaaaaccaataggtaactagaaagtctttttcagaataggagaatcatggatgatttgcacatcgccttgtatgtctcagcagtgttaccatcagtaccttcaccaactctggagacttcaggctaaactgaaccccaataaacctttgtacatatctcaaaaatatgcctcctattatactctatttcgttatttatgcccccttcaaaaaaagcaacaacaaatctgacgtgtccaaagtttagaagtatatcttaattatgtgcttccagagccaagtccagtgcctgccctataataggagcttctttattcaacattactgccgatggtcaataaattgaatggattgacagatgaggtcagtgtaactgggggcaccctccaagtggagggcctgggtacagagagaagctttcagtgcatcaaggtgagagaagcagggtcagccacatccaagagatacttctgccatttcactcttcttttatccttctgccaatttcttcacttaagaaagtaaaaaaaaaaaaaaaagtagatatcaagtcctttacctaggcttaattcttatatatactcctacacacagttttacctctcattgatcattttaaattgaaataattaaactaccttataggacacgggctcacttttctaaccaggtcaggttttgattgcattcattcacaatctttacctgtgcataagcctgctctaatatttatttgtagagatcatctttctttcttaagtttattttgtcatagagttgtatatagttatgagtacattcaactctgtggaatgcagatattatagaaaaggttaagtataaatcactttatatggagtacatcatgaattagatgagcttggatttactagcaactggaagatccttctgtaaagtaaaaaaaaaaaaaaaaacccatcggtcaataaacaaggatttatcaagaattttttgagcacgcattagattactcagttatgaatccaatttcaaagaaatcatccactgatttattgcttttatatggttcagatacttattttgaaaggaagcacacttgtgtttggttttataacagaggagagataggctgatgagtaaatgtgattctctgaaatggtacccctgagaatgtcgtcgggtacgacattggtttcctgctaatgtatcattactgagatgaagtcaagatgtttatttttcaagcagaagttacattctctatcaatatgacattacattatagtgctgctagttcttcagggatatgattgattcctatagtagggtggatataggagccttaggcagtgatgctgtatctcaagtgactaagataagatacaggcagctcactgcacagagagccactagccagtttacctagcatgacttacagagcagttttcaccaacactgtacttagactggcatttttagtcctacttttaaatttgaaaagccaaccagtggtcaatcaggaacacattcaatcccatatatttgtaatatttatcttactttatggcaggaattctaggtttagataactagctattgaaagtgtaatatttggcacaacgatgactcaaatagcctgttccagttactgtgctgaataaaccacttcaaacttattggcacaaaacaaccatcttactatgctcaggaatttgtaaaaggcagagtaggaatgacttgtctctactacatgatgtctgacatattagctcagacgattcaaagacacatgattatttgacagctaggagtcagtcatctgtagacttgtttgtccacatgtctggtgcctaggctaggaaaactctaagactaagactgctcatcagagtgcctacacatagtctttccatgtggcttgacttcctcacagcatggcagcctcagggtagttggattttttatatggtgtcccaagactccaggcccaagtgcaccagtgaacatggcaaggctgcattgccttttatgaactaacattggaagtcatacagtgtcatcttcactgcattctattacttacaagcaaacataagcctgcccagattcaaagggaggggacatagacccctaactctcagtaggaagagcttcaaagtcacaatgaagaaaccatgtgaatgggacatattgttgtggccatctttgacaaatacattttgccacagtccaccctcttcgcacaacaattcacatccctcccacgtgcaaaatatgctcactcccttttccaagaccaccaatattaaatgcacacctacaggaatagtaaaatagaaagctgttttttgttattggtgttttattttattttctgggtaaggggaaataattaatgacctataaaagacttcaatgggtgaaacattgattacaggtattgaactaaaatgtagctcaacctgaagaataggagaagacactttcaaactcttcatccaataagggatcaatatcaaaaatatacaaggagctcaaacaactcaacagcaaaaaatccaaataatccaatttaaaaatggaaaaagtatctgaatagacatttctcaaaagaagacatacaaatgaccaacaggtatatgaaagaatgctgaacatcactagtcatcagagaaaagcaaatcaaaatcacaatgagatatcatctcaccccagttagaatagctattatcaaaaagacaaaaaataacaaatgctagcaaaaatacagaagaaagggaactcttatatactgttggtgggaatgtacattaatacagccattatggaaaacagtatagctcaaaaggctaaaaatagaaataccatataatccagcaatcccaatactggctctatatccaaaggaaaggaaaacagtatgttaaagagatatctgcactcccatatttactgcagcactatttacaaaagacaagacataaaatcaacatacatatccatcaacagataaatggataaagaaaatgtagtgttcatacataatggagtactattcagtcttaaaaaaatcaaatcctgtcattaatagtatggatgagtctggaggacattatgttaagggaaataagtcaggcagaaaaagagaaatactacaatttctcatttttgggagctgaaaaagtagatctcatagaggtagagggtagaatagtggttactagaggaagagaagggtagaaaggagtgaggaatagggacagtttgattaacagatacagaagtacagctacataagaagaacaagtttcagtattctatagcactacagtaaacaataatttattgtatttttttcaaagagctagaagagaggattttgaatgttatcaacacaacacagtgattaagttttgaggtgatttatatactaattaacttgatttgatcattacacattgtacacgtgtattgaaataccacccttacctcataaacatgtacaattatgtgtccattaaaatatatttaaaaatttaaatgtagctcaaaactcaggatctcatcatgtaagtcaaatgaagcatctcaggttaagcattttggatacagttaaaaatgaaaacctgggaactaaagagacaaggtatctgctccacttactcaacagacaatatggagacatacagaggataactgttatagactcttccattcaaaaatagggggaacaagaggcacacagcagtcactagttaacaggaattctgagacctagaaaggtccatgttggaagatccttgtttgggggatatattccttggttgtcctctctagtttttgggtctgctctctggactcttattctgctatttgaaacatctttctttttctataagaaggggcacttgtttgccactgagtaacctttttagtctatttattgtctttaaaagattaggagtctaaagacctcctttcattttatactatctttgttgttttcagtccaaacatacaattccttaaaaactgttgggggcagggctgggcatgttggctcatgcctgtcattccagcattttaggagaccaagatgggaggattgcttgagtccaggagtttgggaccagcctggacaatatagtgagacccccacctctacaaaaaaattagccagacatggtggcacatgacccgtccaccttgggaggctaaggcaggaggatcacttgagtctgggtagtcgaggctgcagtgagctgtgatcatggcactgcacttccagccttggtgacagagtgtgaccctgtctcaaaaaaaaaaaaaaaaaaatactgttggggtttatatataaatttataatccacttcattagacaaaagctatactcacaaatattttcaagataaaccctgttttagttaggaggattacgttttagagatgtattgcatagcatggtgactatagttaataataatgtacatttcaaaattgctaaaagaatagattttaagtgttctcaccacaaaaaatgattagtatgtgaagtaatggatatgttaattaccttgagttaatcattccacaacaaaacactacattatactccataaatatatacaattattatttatcaattataagcccttgttatcttaggctccctgtgagtatgctgtgtggcccaacacccttaatattcgtagaagcttattgtttagaggagacaatctgtaaggcatgttcttatgatccttataagacctattgcctgtctgaaagagcttatcaggtactgctttagatatttctcaggttttaacaaagaatcgtacagtcccaccctgtatatgattttttcccctgaggcctgttctgatttgaggacccttcgcaggctgaaaagacttattctggatcctttacatttcctccaacttctacttggacacttaatggcctgttcttcagttctttgtcctctctcagtttggtatcagcagctaaaagccaagcagcatcctcagtgctctatctggaaatctccttaggtagatgatgaggtttattaagtatattttctattttccatgttaccacaggaaacaatgttggtaaacttttccccatcctccagctttccacagcaattgcctttctttcctcccagtcttccaacaacctccttgagggccttccagcttctgcctgctgcctggtcccaaagataatgccacaacatttcagtttttgatacagcatcaattatctgtgtagctatctattactgcataataaatcatccaacatcttagtggcttaaaacgataacaagcagttcattatctctcacactttctgtgtgttaagaatttgggaagatctcagctaggcagttgtggttcggggtctctcctcttggtgcagtcagacagtaactggggctggaacagctgggagttgggcaggcatcattctttcttcatgtactcacagggcttttccatgtgatttctccacatgggctactttgagttcttcatagcatggtggtctcagggcagtcagacagttgacatggtggctcatggttccaagcacaccaggattggagcttcatcactttttatgacctagacttagaagttacttagtgtcacttccaccaaattctgttgattaggagcaagtcacaagcccacttagactcaagtggaggggatacagaccccatgtctcaatggaaagagtgtcaatgataatactgttaagaaaaaagcatatgggatgggagatattgttgtggctatctttggcaaacacaatataatacagtctgtgacttctatatgacatatggaagcatgcagaggagaaagaagtgggaactgcttctcttctctttgccttgccaacatgccactatgctatccacagaccagtttgagagggccctgcagaatgagtgtaggggatcccaccagctgacctaaaccatggctactccataaagcttcctttggaatacttagctgacatgcagaatgatacttataatttcattttatcctcagcatcagagcaaagatttattctgaatccaaaattatttacaagtattgccttatctgggtaaaacttgaaaagtatttaaaagaataattttaactgtattggctaatggctgattttagcataagtcaccttcagtattttttgtcttgcaaacagtttggggttgaaaagaaagactgccagtcatgcattaaaatataaccaagtgtatgcctccagctgagatctctctgagttacagactgtccattgcaatcaatcacctaccccatgtatctattcgaatgtctcaagtgcacctcaatcgtattattttccccaaacttaatgtgatcctcttttggtgtcttctttctcattgaatggcattaatatccatctagtggtttaagctggaggttaaccttgacaatttccaatccatctctaagacctgttgattgcccctctatgtctctagttggcacattgctctctacctataccaccacccattaaatccaaatcattatcatctctcatctggaccattgctgtagctttgtaacttcttggattcacttttgcgttcctctaggcagtcatccacatggcaaccaaagtgatttatttcaatatgctgatctggttatgtcatgcaatctccattaaaagccagttatggctccccttggttctcaaaataaagcttcatcagacactggtttacagggccctatatgatgtagcccctggttcatttctgaaacattgtctcactccacactccccctgtattccaggcctcagttgcatccctcaattgcagcaaaccctcctatctcagacattgccaaaccctgccttcacctctttaatgcctctcattttttaaatctctaatgaaatatcacttcctaggggaaaagcttctcttatctgtcagattagaccaggaccccatttagtaagctctcatagcatcttataattttccttcagagcccttatcatagttagtaattatgtattcatgtgattactttattgtttcccttcatctcaaggttgcaaactccttgaaggcaagaatcaaatctattttgctctccactggatccccggcacatagcacagtgcctggcatctctgcaagccttttccaaccactcaatctaaaacactcccttctatgccacttgcctaagtctcttaccttaactgtttatttttttccaaagcacccatcattatctgtgtgtgtcttgtgtgtatatgcattcgtatatgtatatgtgtgtatatgtataaatatgtttgtgtgtgtgtataatttgtttacttgttactgtttccccctctagaatgtaaattccaaaaaatcagagacttttgtattcttgttcattgctgtaactctaccacgtacctggcacataataggtactcaataaatatttgttaaaaatgtgagaaataagccaggcatggtggctcacacctgtaatcccagcactttgggaggccgaagcgggtgcatcaccggaagtcaggagtttgagaccagcctggccaaaatggtaaaaccccgtctctactaaaaatacaaaaattagctggacatggtggtgggcacctgtaatcccagctactcgggaggctgaagcaggagaatcacttgaacccaggaggcagaggttgcagtgagatgagatcacaccactgcactccaacctgggtgacaaaagcaaaactctgtctcaaaaaaaaaaaaaaaaaaaaaaaaaacaagaagaagaatggcagttgctcaataaataaatcctggaagtttcttctttaaaaatcaatgataaaaatatgctgcactgagaaagagataatacattgacatgtttttcttttggaaaaattgcctttcacaatctgcccaaaatgacactttgacagttttaattcatttcagcacatgtcattaagcaacaaggggctatatttggtttagtttatttcaactttgttgttctgcaaagctcagtcagattcttcattcataatcttgaatggaagccatttgggatttgataatggaagccatttgggatttgataggggcaaaaacgtacacaaatcaaacccagagactttggaatcagttttagaatcagacagacctggatttgaatctcagcttcaacatttattagcactataactataggaagccacataacttttcttggcctcagtttccccaagaaatatgtgacttgaaagatcaattcagtaacaggactgaccatggttttaagtgaatggtacagactcttaataaatgctatccatttattattcatgtctattcccaaagtacccatgatacaaaggaggaaattgaagccttaacagttgaagaaaatttcccaaggccattcctcttatatccaggtctgtgattaagcatcattcaaccatcatttgcttgggagattttttcagtgaaaacccactgtatttggacacatattgcttcctaagacagactggagagtccattatgtccttgcattgagtgagactcactacaaccttcagttccaactgagaaatttcctgtcccaacagaaaggaggctcagtccaataaaaaaatctgggtgagaaatgcgatggaaagatttttaggagtccttttacttcctcctttctcaagaataaaagaaaaattacaaatatagactctgctaaaatcttttcatctgtaagtgccatgttctttaattatattgaaatcatttgcttatgacaaacaattcactacaatgcaactccagtgagctttaggtcaatttcccatctagacaagaattattctaaacacaggaatgagcaaattttacaataagtaaaactgatgcataaaatacataaaattagataataaatttcaagcaaattgcacagtgccatggcagtgctttatacagcagacgggattaaggagatcttatcaaagtgcgatataaaaattgcatgtgttgaaaccttgactggatgattcattttctgtgagaatttaactaatcagtgaataacaaaagagggtcagctagaagtgcttattgctcagttactaaagatggaagatgatggataattaattgagtttctggctaatcagaagaaatggagaatatatgcctaaaattaattatttccttactggaaggacctaactgagtctacctgtaaatatgctcaactcagctgtggctacagattgttctttattttagtttcagtttatccatgactcaagctcatttcatataggaatcttgtcatattaccataacattttattctgaacctgctagaaaggcaattagtcatttattataacacaaaaaaattcaaattggttgcagttatgttttcagaatcaaaaccatctcctttgatgtgaataccataaagttctatatttaaaaggcattgaatgcatcataatggtaaataagaagacccttaaactagcattcatacctcctgcacataaaaccttaaatggataatttttactcacaacaggtttatttttgtggcagagaattttaaagaattgattaaattagctataactatgctcagaagcataatttgaaatagtgttgaatgaatgaggaaagtattttcaagcatagggaaaaccctcttaaaattcccttttgttcattattcagcaaacatttattaagcccccacagtttgcatgacgatgtacaatataatgagattctaacctgacatccttctattctagctctgttaattgaatgagttaatctttttagctgtccattcacagtatgtgatgaaagactatagaaattaaatgaatgagtcaatctgaaaagacacgtggacatgtatatttaagtttccttttgtgtgctaaaaatagtttactacctacataccctttctatttctttaggggcttcagaatttaaaagaacattatcttactgaggcggtgaactatatgcttaatcatgagtttctaaaggtttatagaggtgagagctgtaatttgcaagattctgcagatacgcaaaggaaaaaaacagcacagtaaatttgagcagataaggagaaaggtattttgaggggttgtttctatttcaatagtaactttagacttaaaaatatagaataggttgtacattttagagatggacatcggaactcatctagaccagtggtttccaacattttacattagagtcactggatctttaaaaaaaatagaccctaagttctcatccccagagactggtctagaaagggctgggaggggaggcaggcatacatgtatttgtaaaagttccccagcagccagagctgaaacccacagatcccagctcagccttgacattattggcatgaggtccctgaggctttgaaagaataagtagcttgcctaaggtcaacacagcttataagccttggagcaggcacagaacagaaatatccaaattcccagagcggatctctctttactaaaccaactggcatcatttctacttcacactggttgagatctaattaccaattagtagtagttgggaagtccaagactgcctataacaagtcccctcctcctaatgacctgtatgtgcttccttttcttgctaagcactgagtaagtcttcagatagttatgaggacactgatgacactgtaataattaatatatccagttattccacattttgaaaggcttcacttatttaaaacttttgcatccataaaatattcatatttttaaggcaaagaaaacaggtttaatatttgaatctgagtcccactttaagtcttcattatcgagtttatataactgagcacatggaagtactccgatgttaggctggattttgtttgctgacttccttatatgataatacctttagtttggccccttccaccagattctgaaagttccatgcagatagagcccttgtccaacttcatcaattgtctcccagcacctagtacaatgcttgtcacagaggcaacactcaacaattaatggttgaattaaaaatcctttattatattttgttaagaaatgagacagagtgcctttagccaacttgtgtaggataatcccatataaataaaagtatggaaagatggctttataaagtagtagttttatagttactttttaaagacctttggtctgatttttgtgatataatggtctgattaaaggttacaactaggccgaggcaggaaaatcacgtgagcccaggagttcaagaccagccttagcaacatagtgggaccccgtctctacaaaaagttaaacaaaaaattagctgggcatggtggctcatacctgtagtcccagctactcaggggtctgaggcgggaggatcacttgagcccaggaggttgagactgcagtgagccgtgatcatgccagttcaccccagcctgggcaacagagtgagactgtctcaaaaaataataataataaaggttataattaattttttattggaagcactaggtgcagtcattaataaaacctactaatgtatcaagcaaatgaggtttctgttttcccacctgattttcctagagatcaaatttacatggcgaaggatgacatggaatatttggcaattattcacacttgctatctctccagctcaaattccaagtcattgccaggttgcaatggaatgttcagccatgtttagggctggcttcaccagagatactgtatcacaatgggcaatgtcgataaatcaaaagcctcaaggactgcgttgaactcttcttcattttcaggctgcatgtatctcccacaaagggaggtggcacctgggtactacactaatttagctaaatgagccacatagaagcaaatctgttctgccttgcaggttctgcagcttcccctctgagcacgtatactataatctaatctacctattctgaagtccttgcaccactctttaaactgttacctgctctttcactccccattttgcacatgatcaagtgtaattaactgaaatagttcttctcaccttccttacctctccagggatctgctgttgaacttacaaaactcatttaagtacacaaggtacaaattgtccttgttgtaccatttgagttttacttaggctgtcattcatattataagtccttcatttagtataccttttatatgtggatgaagacactactgacattcagtaagcattaatgaaataaagttaataccaagtttccttgtcttttgggaaacataaccattattattatctggcaagataaagagtttagtgcctctggtgactcagaggagttgcatgttattgtggaaggcagtaatctagttacagaagaagataattcaattgatggctgtttacagttaagtcatttcaatcccagcttttcaaccccaccttttcaaccccaccgtttgaccccctcctttgacccaaacacatacccagatcccatacatttttctctaaggctatttgtcctttacaccaaggaataaatacaatttttcagacttttatctaatttatgtagaaataatcatacaaatatcactgacatcagctaaaatgacacatttaaatatggtagaaatgattcaccagccaaataatcaatgttaaaaatcaacactggaaaaattaaattattaatgaatatttaatctctgctatataaatgagatgaactagagggctggagggggaacaggtatatatataaggggctcaccttagatgtaacatcaacattaaacctaatgttaatgggggaattgcgctgtgaatgaaccacaatactataggttccttagggccaggcacacagcacaggctcagtaaatgttttctgaatgaatgaatgaatgaatgaatggtcctcttcatagacttacagtgtaacactgggatttggagaactgctttaaaatctctattcatatctagggattaataaactagattttgggaaagtcagtactgaatataatgtaggtgtttctgtttgttaattaattaaaatgaccacagtcattattcttacccttaatttctcagtctgaaaagttaatcaactgtatctgttccatgaataattgagttgaacttgaaagagaactcgctattccaaaagcctcccacaccaccagttaactgtgatttatccttttacttctaaagaattttaagcatcttccatctaacttgactgacaaccaatctgtgcttcctctgtctttattccgtcaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggagggagggtcatgggggtgggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacacacacacacacacacacacacacacacaaacttcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttctacttatccagtaaataacaatgacaaaataaacaccaatgacagaaaaatttctactttactgtccatataggtgtgcattttaatatttttctttccaagataaaattttgaaacttaaattgtgtattgtgtaattaatttgatagtgtaccctcttaataaatgcccactttattttatatccaagttagtgcattatatatatatttttgctttggctatatttacacgtgactttaatcgcccaactgtgactagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgcaaacttctctagaggctttcgttttcatttttgaattaaaatgtagatatttactttatctcatttttttatttgaaaatttttcttattatactttaagttctgggatacatttgcagaacgtgcaggtttgttacataggtatacacgtgccatggtggttttctgcacccatcaacccatcatctacactaggcatttctcctaatgctatccttcccctagcccccgacccccccgacaggccctggtgtgtgatgttcccctccctgactccatgtgttctcattgttcgactcccacttatgagtgagaacatgcggtgtttgtttttctgttcctgtgttactttgctgagaatggtggtttccagcttcagccatatccctgcaaaggacatgaactcatccttttttatggctgcatagtattccatggtgtatatgtgccacattttctttatccagtctatcattgatgggcatttgggttagttccaagtcttggctattgtaaatagtgctgcaataaatatatgtgtgcatgtatctttatagcagaatgatttataatcctttgggtatataccagtaatgggattgctgggtcaaatggtatttctggttctagatccttgaggaattgccacactgacttccacaatggttgaattaatttacactcccaccaacaatgtaaaagcattcctttttctccacatcttctccagcacctgttgtttcctgactttttaatgatcgctattttaactggtgtgagatggtatcccattgtgattttgatctgcatttctctaatgaccagtgatgatgagctttttttcatgtttgttggccacataaatatcttcttttgagaagtgtctgttcatatcctttgcccactttttgatggggttgattttttcctgtaaatttgtttaagttatttgtagattctggatattagccctttgtcagatggctagattgcaaaaattttctcccattctgtaggttgcctgttgattctgatgatattttcttttgctgtgcaggagctctttagtttaattagatcccgtttgtcaattttggcttttgttgccattgcttttggtgttttagtcatgaagtctttgcccatgcctatgtcctgaatggtatcacctagattttcttctagggcttttatggttttaggtcttacgtttaagtctttaatccatcttaatttttttataaggtgtaaagaaggggtccagtttcagttttctgcaagtggctagccagttttccgaacaccaattattagagaatcctttccccatttcttgtttttggcaggtttgtcaaagatcagatggttgtagatgtgtggtattatttctgagggctctgttctgttccattggtctagatctctgttttggtaccagtaccatgctgttatggttactgtagccttgtagtatagtttgaagtcaggtagcatgatgcctccagctttgttctttttgcttaggattgtcttggctatatgggctcttttttggttccatatgaaatttaaagtagttttttctaattctgtgaagaaagtcattggtagcttgatggggatagtattgaatctatgaattactttgggcagtatggccattttcatgatattgactctttcaatcaatgagcatggaatgtttttccatttgtgtcctctctcatttccttgagcagtggtttatagttctccttgaagaggtccttcacatcccttgtaagttgtattcctaggtatcttgttctctttgtagcaattgtcaatgggagttaattcatcatttgactctctgtttatctattattgatgtataggaatgcttgtgatttttgcacattgattttgtatcctgagattttgctgaagttgcttatcagcataaggagattttgggctgagacagtggggttttctaaatacacaatcatgtcatctgcaaacagagacaatttgacttcctctcttcctgtttgaatacccattatttctttctcttgcctgattgccttggccagaacttccaatactatgttgaataggacccatggttttattttttaattaaacattttaatatgtttattttgagaaatgagtattaagtattttaatattcttttatgtatatctactgtatttcaaaaaaatgtttaaaataaataccagaaggcaataatttgcctgaagacctgtctcatcaaaaagagaaactgaaattttaaccaaacaattttacctttagagcatgtgtcctgttaaagtaaatggagaccaggcctgaagaatccttgggaagacaaagccagttagtcctcataaatgaccttaaccttgcttgatttgcaaacataaacaaaagttaacttggactatttcttataaatgcctatgttagagaaacaaaatgaaacttaagggtaaccattcagaagccaccaattaacttatataactttacaatttggtatgtttttgcagtgactggcactggtttttcctttccctatttagtgcttccttcaggagctctggtaaggcaggcctggtggtgacaaaatctctcagcatttgcttgtctgtaaaggattttatttctccttcacttatgaagcttagtttggctggatacgaaattctgggttgaaaattcttttctttaagcatgctgaatattggcccccactctcttctggtttgtagggtttctttagagagatccactgttagtctgatgggcttccctttgtgggtaacccaacctttctctctggctgcccttaacattttttctttcatttcaaccttggtgaatctgatgattatgtgtcttggggttgctcttctcgaggagtatctttgtggtgttctctgtatttcctgaatttgaatgttggcctgtcatgctagattggggaagctctcctggatgatatcctgaagagtgttttccaacttggttccattctccccatcaatttcaggtacaccaatcaaacgtagatttggtgttttcacatagtcccatatttcttggaggctttgttcggttttttttttttcattcttttttctctaatctttttgacaccctttatttcattaagttgatcttcaatctctgatatcctttcttctacttgatcactttggctattgatgcttgtgtatacttcacgaagttctcatgctgtgttcttcagctccatcaggtcatttatgttcttctctaaactggttattctagttagcaattcctctaacctttttttcaaggctcttagcttccttgcattgggttagaacatgctcctttagctcagaggagtttgttattacccgccttctgaagcctacttctgtcaattcatcaaactcattctctctccagttttgtttccttgctggcaaggagttgtgatcctttggcagagaagaggcattctgtttttcggaattttcagcctttttgcactgttttttcctcatcttcatggatttatctacctttggtctttgatgttggtgtccttcggatggggtttctgtgtggatgtcctttttgttgatgttgatgctattcctttttgtttgttagtcgtccttctaacagtcaggaccctctgctgcaggtctgctggagtttcctggaggtccactccagaccctgtttgcctgggtatcaccagcagaggctgcagaacagcaaagactgctgcctgttccttcctctggaagcttcgtcccagaggggcacctgccagatgccagccggagctctcctgcatgaggtgtctgttgacccctgctgggaggtatctcccagtcaggaggcacagaggtcagggaaccacttgaggaggcagtctgtcgcttagcagagctagagcgctgtgctgggagatctgctgctctcttcagagctggcaggcaggaacatttaagtctgctgaagtgcgcccacagccgccccttctcccaggcgctgtgtcccagggagatgggagttttatctataagcccctgactgaggctgctgcctttctttcagagatcccctgcccagagaggaggaatctagagaggcagtctggctagagcagcttggctgaggtgcggtgggctctacccagttcaaacttccctgtgactttgtttacactgtgaggggaaaaccgcctactcaagcctcagtaatggcggacacccctccccacaccaagctcgagcatcccaggtcaacttcagactgctgtgctggcattgagaatttcaagctggtggatcttagcatgctgggctccgtgggggtggaatctgctgagctagaccacttggctccctggcttcagccccctttccagtggagtgaactattctgtcttgctggcattccaggcaccactggggtatgaaaaaaaaaaactcctacagctagcttggtgtctgcccaaatggccgcccagtttagtgcttgaaacccagggccctggtggtgtaggcatccaagggaatctcctggtctgtgggttgtgaagaccatgggaaaagcatagtatctgggctgaaatgcaccattcctcacagcacagtccctcacagcttctgttgactaggggagggagttccccgaccccttgtgcttcccaggtgaggcaacgccccaccctgctttggctcaccctccgtgggctgcacccactgtctaaccagtcccagtgagatgagccgggtacctcagttgaaaatgcagaaatcacccaccttctatgttggtctcgctgggagctgcagactggagctgttcctatttggccatcttccaaaatgtagattatttaaatgacaatgataacttggattttcgtatctggttttcctcataagcttgaagcagttgtacagctattatattattgatgcattagtatctccacgaagaaagaaaaaatatgtttttctcgttgtagaaatagagaaatggaagtattagtggccattgtgaggccaggcatggtggcttatgcctgtaatcccagcactttgggaagccaaggcaggtggatcacaaggtcaacagatcaagaccatcctggccaacatggtgaaaccccgtctctactaaaaatacaaaaaaattagctgggcgtggtggcacactcctgtagtcccagctactcaggaggctgaggcgagagaattgcttgaacccaggaggtggaggtttcagtgagccgagatcttaccactgcactccagcctggcaacagagcaaaactccaacaacaacaaaaaaaagccaagagcactgaggaaccataaaatcttaaggtgaaacgaaacttaagttaccaacccattcagctacccatcctaactttgtcaacaatggagttccaagatgaaagaaaaattatgagagcccctgtgaagtagaggtaattcgtgttgactcctgtagattttccttaaccaaagatattaatcagtattctgaggaagatatggattcataagacaatgtttacggccttttaaacctattcaaatattgaataattttcatatagaggaatattgcagggtggttagaagctaccacttttaactttacgagagcttttagctaccacctttaaccactttggagatagggagactagctcagccactatcaacagtgtgaccttggataaattacctgacttttctgaatagttgtttcatagagtttcaagagaactgactggaagtaatgcagctaaagccattcgcatggtgtctaacacatattaaattctcaataactaaaagataataaaataattattgttatgaatagcattggttatccattgggcaagaagcttcacaacgtctagccttgtcaagttcaatgacatgctttttgcatcatttttaaaatactgtttctgtcttattggtcattcctttccagacaaataaggtgaagtgtttattctcaattcttttcctttctctgcaaaacagtaaaattgaggctaacatgcctcccaaagatgggcctaaccccataagtatcccaggaagaaccccaatgcagcatatggcagagtgggtaggcactttagggagaaaatcctaagacaattgattatgtttaatcaatgtgtgtgccataaaattttggagggaggtacagtcctcccattagaaaactgagaagagattcacaccaaaatatatctgccagccactaaagtaggcaaaggcgtcttggatggcaagaggacttcttgacttttctctgattctagactacattcagtgaaataaactcttaaatgcaccaatgtgggttatataaataagatgaaatctcagagaaaatattttgagtaccacatatgctggtgaaacagattaattcccttataacgttactggggattttattttggacatttttcttttgtgatagtatttcagggaaaatagttcaaaagtacaattatggctctgaggaagagaccttcttacctgttttcattagattggaagcttttgggagaaagtggctatgtttccactggttatccgcaatgcctgccaaagctcaaatccccaacggatattattactatcgctagaaaaacattggtgaaggaggatatgctgtgcctactgaaaaagtcacataagttttccccaacccagaaattacagaaggtaactaactactgccatcattttttcagataatggattactggaggatttgtcttttaaacatttttcaattcctaccacttggttttaaaaacacatagggatgacttaaggcttgagactctttatggcattctcaaataacttggccctaaaccgatgctacaaaccagactggctgtagatttttaaaaatccttccaagcagcgctagctttaagctcctcatctatgccactgaacaggactgccaaattctaaaagcgaaatttccaataaagattaaatgaatatcattttacatttcacttactccattaatatcaaataagaaggttctaaccaaaacacggcacaaaattccatatcatatgattcacagctttggaaaataaaaaaatctattcagaatttttttagggtttatgcatttcctactttaagcctaaagccaatttgtgggatgaatctaaaccatatgtctgtcagaaattcttttttaatctttcaacctctgctttaaaccttttcttattttcaccaatttagggttttttaagtataatttgaatgattcaagcaatatattttttcatagattataaagtagaagaattaaagataacactataacctcatatttacatagtgttttcaaaatatcaacatgtttaatgcctatgacagcatttgatcctaacaacaatccaaggtgcccagatcacaaagagtcaatatacaccctttgatcaacagataaacagaagctccatgaattaaactccttgcccaagatcacctatcatattagagtttgaacatccagcacaatttgtttcttaactcctcagactatatacagtttcactatatccacactaagaaaagaaaaacctggaaagtaaaaggtcatggtaccactgatccatgctcatgaatgacgaaataaatgtcaaaagagagcccagaatatttctgttgaaaatgcttaagagaaataatttaaaattgtgcataccgcattaataacatcttcagagtcaagattttgtgtgattgaatggcccaaaagatacaggagttgaaaaaaagaccaacaaaattccatttcaaaggcgtttattttcatttttgaaggagggaaaatgacgtttgctttgttacacatgctcccacatgagaaaagaggcactatttctactctgggtgcaaatgcagtttaaaaataacaagtaatatatagtttcccaagatgatggaagcgtgtattagatgtttttagactatgagctagcatttagaaaggacattatcactttggcacaaatgattcataagcaggtaaatgtagcttcaaagaggagtgcaaagctctagggtgctctttgtgaagtgtgtaccacactggccctcttgcagtagagcccagggctgctcatggaacagacaatttggtcagtcctcatacacactgaagtctcattagtagctccaggtcctcaaaaatgatgaaaccaaggacaaggagacccttcacgtgcaaggatcaggactaaccaagagttcatcaaattcaatgaataatcatttcttatactatttctgcttcttgaggagaaatatttaggggcagggtagtagggaagggagaagagataaaaggaagacaacagccagaaaggtgttttttagacacaaaccagataatgtcactgttttagtcttcaatgcctccccatattactcagagaacaagccagagtcctcactttggccacatgatctaactacatgatctcccatcatgctcggccataccttctccctccaagcatagtggccaccttaccagtgcttaaacatgccaagcacaattccaccacaggtcctttgcactagccaattcgtctacctggcaccctcttttccaatactaggaggttggcaaaagttttctttaaacagccaggtagtaaatgatttaggcttcacaagccataccatctctgctacaactactcagctctgctattgtagcatgaaagcagccacagacattaaataaacaagtgggtgtggctgtgcaccaataaaactttatttacaaaagcaggtggcagaccagatttggcctatagacagtacattgccaatccctgctctagatacatacagggcttattcactcatttaattcaggcctctgctcaaatgccttcttatcagagaagccttctctgaccaccttgtataaattagcacctcccaataatttctctctatttcccatttctaccttatatttttcacagcatttgacactttctgacaattggtatttttatgtgtttattctctttctctaatacacaaacacatgcacacacacacacacgcacacacacacacgaacacacgaaggacagctctaagtgagaaattggaacctggttcattattgtattctcaggatctagacctgtgcctggtatttagtagatgtttaatcaatatggtatttgttcaatgaataactgaatagttaacatttattagggagttaattgggtgtatggaaggcttagagatagaactaaggaacctagtattacccagttagataaaaatcactgtcaaaacttaagtaggttttgagtctataacaatgaaggaactgcactagataaacattttctaaagtgtgttctgaaaaaccctactatatatccttaagggtatgggacattagcagtcctatctggattgagtcactgtagtttcaatgacttttatcagatagcatgggtattctaaatgtgggctctctaagagggaccccagaggatctcctgcattctgaacatatttctccttaccctcactatgtactagtaactcactttcctctgaatactcagaataaatcgccccagctagtacagcaacccccttctttgcctactgactccctggcacaagaagcaccaagtgccaggtagcagtatcagttcaatgaaatcactgttttgtcatctgaatgaagcagaggcagagattccaggaaaggttttacacttgaggttttctatcaaatactcttaactcatagtattcaaaaggataaaatcatgactcttaggcaaatataaaattagcacaagtccgaaatttagctttttaattgatgaaaaaacagtaaaatgttccagaccaaagagcatttaaggagcgaggtatttacaagcaatgttaggataagtttcctgggttagatttttttaaaaacgggctaatgtccaatagagttcataaacagtaacctttatggttatctgttctttggacagaaattatttgagtttctattagataaaattctactagttcatctctgcctctacttatgggtgaaatagcctagaaaataccatgccatgcccagcactacactaaaagagcatctgtaatcttttttgcctaattccaagtttcttaaggacaagtgcaattcaaatgtaatgcctaactatcatctgaatatcaatatcatacctcaacaggaccaatacccagagagttaaagtgacatggcccatattacttagcatgttaatgtgcctttgagctcaaaaccaaagtcccctgaattctatcctgattcctttctaaccattcccatgagcctttttccatatattctaggtagagaaagtttaaaagggcagttcctctcctttaagttattctacttccacgtgattatttgcccattcttccggaaggtaagtgtcatagctctaaaggcacagtttgagaagtcacattggcatttaaattatccctctgtctttggtttgctgagtgtccttgagcaaagctttaatgccctgggacagaagatagtgtaaaatataatagtatataccttgtacaattgcaggtgaggtttaaattgattagtacctgcacttagtgggtactaaataaatactagttctcatttcccttcctacccaccgttaattaataatgttttacttcactaatgatgccattcagaacctatcgcctataaatgaagtctattcctttgtggtctactataactaccgtaattttaaatcattgcctaaacatcaaaaaggctggttggaagtgaagagaccatatctagagacagtctggacaaacttctttagcaaacggtgacaacagggtttttactgtttcattttgacctactacagaaaggtaaacattttcctaattgaaatgttaaaaaggcttatgttggcataagcagggcttttgctacatataactaatattgatgtagcgccagtatagtttataaattgctttaacataaattctgccaaatcatcctgtgaacacagggatggcggccttgggccagtttctctcaaagcctcagtttattctgtaaaatggagaagaataatggtttcccatcagagagactagcacggagtaggcgagtaggccttcagtgcataataaccatcatcaaaaccataagtagcaacaccaccaccaccatgatcataaccttacggataagcaaactgaaacagcacaggttaagaaactagtccactgtcacagaagtgggccctgccatcaggtattagctgtgtggctcttggcaatgtttataagatgagaatgatgagatttgccccacctccccacctttcaaccatgaatgtcaaaggtatctgaaaactattccatggatgagaaaactggggcacagggaggctaagtaacttgcctagggcacacagctcataaatgtcacagccaagattcaaacccaggcaatgtttccacagaatccgtactcttaatcaccccatcatattgcttcaatgaaataaattattatgatggaaaaaatgctatattaccctcccctcttcatcagttatactcccctccagggcttctatgtaacattttgtgtatttctttctttttttttttttttgtagctcttgtcatatcattttaaattattcatttccttacccatttcccctaccagcctatgagcttttgaggtcactgtattagtttcctagggctgcaggaatttattctctcacaatcctgaaagccagaagtatgaaatcaaggtgtcagcagggccatgttccctccaaagtctctggaaaagaactcttccttgccttttcctagcttctggtgattcgggtaatcctttgcattccttggcttgcagttgcatcactccaacttctgcctctgcctttacatggccatattctctctgtatgtctgtctctaaaactccctctccttataaaaacaccttagagggcccatgttaatccagtatgacctcattttagctcaactaattatatctgcaaagatcctatttccaagtaaggtcacattctgaggttctaggtgaacatgaattttgggtacacactattcaaccaagtataggcaccaactgtgtctaatatttttatagattccctggccctagtgtaaaatacatacagattaagccagagatagcttggtgactgagcatgcaggtgccggagtaaaattccctgggaaaaaaacattctttctgcctctaacaactgtgagcctttaagcgatggttccaaatgctctatgccttggagtcctaatgtttaaaatagtacctatttcacagggttctaatgagactgaacttagttaattcagaacaagtgcttagaacaataactagtccataagaagtattcaacaaagattatttttagacagcaaacacaatatttttaaatgaaataatgcaagcaaggagttccagaaagcactaaaacagcctatattcagctgttaatattataaaatattctcacatcaaccctttctctgtgtgtagtatttttagagcatcaatgaacattcaatttaaaagagagaatggctgtaggagggaaggaggtgaaaaggaaaaggcttgccttccctttcccctcaggggaaaaaattaaaaagccatggagaagcagtataatttctaagagaccatgccaggaaaatggaattgcttttctgaaaatagaagattaatacctggagggtctaaaatgtaattatggtattgatctcaggaaagccttggatggatcttttttttcctcttgtggtctcagttatcattaaaatgggctcacatgtcagggtcggcagactacaaagtacctgcacggaacacatcaaggcaggcaaaaaggtcctcttagtgggttctgggaggtatctcaaggtaacttttaatgtatgtcagcatggttcactcattaattttctcaatggctttggtaactgatttaataagctgttaatgaagtagcaaggcaaaactaagagctactgtgtcctagttccatccatcctgtggtgtggctgcacgaacaggaagaccccaaacctcaggattgaaatgaattaaagctgattttacatctttcctctctagctccattaaggaaatgaattttttaaaaattccagatatacttccccctgttaaaagataaacttaggcacattaaaattttaaagagtttatttgagcagacagtgattcatgaatcaggcagcaacaaactacaaggggtttgggctccactgacacagggtaagaagaaaacttttgtaaacaaaagtttggaagcaaaacaaagaaaacatttgatgggttaaggtagaagagtagccttagagtccctagtttgaaattagttggttatttcttattatttaagcttaagtttcatttcctaggatacgaccatttgctctgacttgggttttggtttgcttatgcaggaatccagggtgctggagccacctcaatctaatggcctctcaattaattattttaacactcctcagttcccttcccttccaaccagttcagaatcctgcaaccaacaccttcccctccttggttggacaaacacataacccagtgttttactgggaggctctggctacctccaaaatgaatacaagtcttgagactgatgactggaaactctggaattttttttttttttttttttttttttttttgagacagagtctcactctgtcgcccaggctggagtgcagtggcatgatcttggctcactgcaagctccgcctcccgggttaacgccattctcctgcctcagcctcccatgtagctgggactacaggcgcccaccaccatgaccggctaattttttctattttttagtagagacaaggtttcaccgtgttagccaggatggtctcgatctcctgacctcgtgatctgcccaccttggcctcccaaagtgctgggattacaggcgtgagccaccgcacccggccgaaactctggatttttaaagaaatagccctaacaacaacttgtcattaatatattaggggccctttggggcagttaaggggagcaagatgaagatgtgtctgagaacttttggagatctctgattttatgattatagtttcactaaatcattcagtcaaaacttttagcattccacatccttctccagagaaactatgccagctgcagatagtttcaaatgattgaatcttgtcattctagaatgagaatgagaaattaggctggagagaaaagcagggatgaaaatatgaagtcacatgcctgttttaggatcttgggatttatcttgtaagcagtgggatgccattacaagattttaagagtgattttgcatttcagcacataattctgactacaaagtatggaagagatcagaaggggatgaaaggataaaagaagaatgaaaggataaatgtaattatggtattgatttcaggaaagccttggatggatctaagtgatctctaaagttttgaaattaaatattcctgttgaaacgtgacaagatccatctactgatgaacatcatttgaacaaaggagaatttccagcctagacaaagacagaaacaaagcggaccctagaaacttgaataaaaactttaccagtgaaaatttgtcaaaaatcatggtgctaccagctgaatattcagcaacattccacttccagttacaatcaggagttaagcaaagtatgcaaaatggtaaggctgtatcactttgtggttaagtacatttgagacctatgtttgagtatcaaatgtgccactttctcttcctttttgttcctgttcctttgatgtgttgcttcatctctcaaattctcccatctgtaatgggaacaaggatagcagcaccaaatttacgatgggccattgtgagatccatgcatgtaaagaattggaacattacatggtttgtgatgagggtcatttctacccaactcagtggtttctttacatgtggagagagctcactagggtattctttctggcctctgtcagcccctccacagaaagaatgactggatctgactagggagtttgaagatgtttttctgccccactcctctttcctttttcttgggagatgcctaccctccaaaatggtatgttgtgctctggtcttgccttatgttttcaacataatgggaatgttttctacggagaaaaatgttttcaatatttccctccagggaaagcttacagttctccaacatgatctatgactcaacaggtaagtctaactaattctagagtacagaattttcaagcctgcttgtccacagatataaatcacattttccaatataagcactatttgcaacaaaattgacacaggtataccacacagaatttgtccttggttaatgttttctcaggagaatgcctcttggtttttaaaaactaaactttacctaagtactcagtggaatgagggttgcatttaaaaaaactacatttatgcctttaaaaatcaatacaacatttttaacaaaagaatgtgtgaaaaacatccagaagtttcactccaaatacaactggcatttagaatgaatcaagtttagatgaatcagaagtacacatagctattttaaagtgctccaagtatcaacagaggggatttgtggctaggatgttcctagcactaagaaaaatatcactgcagacaaagcaactgtttgtcaatagccatattaatttcggttggtttggtaccaaggaaacaatgttttaagcatttatctcatgatatgacagtttcttcttcatgcgtggacattttaatgtgttttagttggttgggggtttggggttgatttgtaatgcacaataattttccctatttaaaataattggaaaagggctcctttagtattttcatatagaacaactgatttcattaacacaaaaccaatgtcaagctagaggtgtctgtattttgggcctctcatctgccttacctgtttgtcttatttttcaactggttaacaacccaatgaaaaaaggagatggctatttgctggccccagctaataactagaatgcagcaagtgtgacagggtgtcacctccaagatcaggttacaaaagactctgacatctgtcttgccctctctgtggcttttattgcttgcttactcaaaagaagcaagctactatgtagtgaatggccctacagagaggtctacatagcaaggaactgagggaggcctctggccaatatccagcaagcaactgaggccttcagtccagtaacctgtgaaaaactgaatcctgccaacagccatattctccaccaattgaaccttgaggtgactgcagtcctggacagcactttgtggccttgtgagagactctgagacaggggacccagctaagccatgcacagattcctgacccacagcaactgtgcagtaataaatgtttgttgtattaaagccactaaactctaaggcaatttgtatgcagtaatagctaactaatacactcagtaaatgtatgctgataacaacgacaacaatgcatgatttaattactccctgaagagttcacacgatctggatacttagatacttccttcttggaaatagaccatgactttctgaacattgtctggtatttgtggaaaactaaataggggacttgccaaaaactaggttggatcccatcactttaaatcaaggccaaatttagagcatcactatccggaaaggaactttgatgtcactagccaaatcccatcattttacagaaatggaaactaaggctcagaagagctaagtgacttgcccaggaccatggcagtgtcattttagaacgaagggctcctgactcctacactaaggttcttccacaacatctcttgatagtgtatagaagacaggaagatcagaaaggctggagaaccctgaatgtataaagtatgacttaagcagggcttgaaacaatgggtagggttagggaaggcatttcacataaggagtctatatgacagaaagaacagtgatgggactgtgtctcatgtgaggggtaccaaaaaacaaaatctccatgattcagtcagtcatcctgaagctcatatgaaaagcaaggatgaagaggccttggagcgaaatggtacctacaaggagcagggtaaggaggacaaattttggtagacaaacaaaccaaggaacatttgtgtgagactttatggcaggaagcagaatgaatgtggaaataagataaatgggtgggcaggaaatgtggcaggcatcagaatttgggaaactttatagtttcacagtcttgaagcagaaggaaagaaagaggaaaggctcacacttgtagacgtagggctcagatgtgtgcttagagtatgccaaaacccttacctggatcttgtggcaggatcctcccttatatgaccatattggctgccagatattgttatgtagtgtttaatctatacagatgtacactacagccgtgtggtaggcgaataaagctttggaaattgatacataaaattcgtatacaaaaacccacctttaaataaattattaaaaaagtaataatttatttgaattactgattcctcatacccaggctgaggaatcccaaatgtaacatcttatcataattggtttagcaaatccagtgataattctctgattcttgacacagacactggcacgtcagagaggagccaaaagggcaatgaactggagccacaagtctggattctagtctagtgtgacttaacctctctgcatttcatatattggtaattcaactgcccaataaagataataatagctgcctgtcctatgtcacaaagcttctgtgaaggttgaagtttgaaaagtgttaaagggctgtacaaatgcttggctacacagaaaaagagattccactaagttttccattgcagccatgaaaagaccctttttcagtgtgtaatggcttcctttacaaagagcaaagagtttcaaaggataaaataacataaaaattgtatcacattgtcacagaacgtacaataaataatggggctgaagacgattcacaaagataatcagattgaggctctgtgaagcagagcattcaattcctatgattctcaaatatgttttccaggtttcagccatggaagaagttccagcatccaaatgatttaggcagggggaaatggagggatgagtgtggggacttccctggtgtattagttaaggtaatgctagctgctttaacagataagcccacaaactcagaggcttaacacaatggacgtctgtcattcactcaaagcaacggattggcaggtagcttttctctcttctaagcagtgatttgggatccagactccctcaatggctccaccatcaccatggctcaaagtctacggccgaatcctctgtatctgtttggtgtacaggaaaagatgaaggaggaacacctgttttcagctacctatacttggagatgacatacatcacttccactcatattcctgtggtgagaactttttatacattctgctaggcacaagggtggtagaaaacgttgttcctggtttgccaggaacaactcaacactatgaaaggggagcccaagtctctgggggacaggaaaccactatgcctcacttgggaacagaaagaacacagatgtctactgttttgtatccttgcctcttgccagcatttctagggaatacacacatcaaaggtttttatagctagaagtgttatcaataaaacaaatagctttgctcagaaagctgctgacatttatccttaaatcatatgaaaataggccttcatagttctaaaccagagatcagaagctaatgggaagacattatttaaaaaaaaaaaaaaaaggcactgaagtcaagccaggctaggttctaatccctgctccagcccaagcaatgagagaccttgcataatttatttaacccttccaaacttcaatgtcttcagcagcataccctcaataagaagattactgtaatgacatggcaagtgcttggctcataaaaggcacttgtaaaatagcgccctcatggcatctcctgaagttgagcacatacatctcccatagcccagcaactcactcccaggtatatagccaacaaatacatatatttgccaaaagttaagtaccagaatgttcagagcagcactgttcaaatagctaaaaagcagaaatatactcatgctcaccaagtgtacaatggataaatagattgtggtatatcttacacacaatgctacacagcatgaaaatgaacaaactgtagctacgtgcaccaatatggatgaatctcacaagcatatattgagcagaagatacaacagaatacctaccgtgtgattccatttatataaagttccaaacagacaaaattaatctgcaccgttagagagaaaatgattgatcgttacccttggagggagatattgcaagggaatagacatgaacatggcttgtgggatgcaggtaatgttctctttttggataggggtgttaattactgggtacactcagtttgtaaaaattcactaagttatatacttacatcaataaaaagtgtttaaaaataatgtctttcccctgagagacccccaaagggcttaaatattgctcacaagtaccacagcctctggaaggggataaaagggtaaaaggagcaagaagggagaaatgtgaaaataagccataaagagggaggagagggtgaggacacacaataaggctgcagggtatcaacagccagagatatctaccacttctctaaatcatgccatttctgttatatctaaaccctgacaattgcaaaagggtccaggtcacttttttcacagtaccctggcattcttatttgggctaagttttagcactgctgaaaatacaagtcttccctatgggcaatccactacatgtcttccagattataatgtgtctttctgttccatatgtcaccctgtcatttctgtcattgtgattcttttttcctttgtcattttggtatgctgggggagttaggttgtgtctgtgtatgtttgtgttttgtaagggtagggagtcatcctaaccaatgccagtccttgcaatttatatattaccctaatcaccaataagactttcaatatcataatcatgtaaaaatcattatctgctaatatcacctccagatagcctggtttccacaggggtaactacaggtaataactcaagcttatgctcacatgcttctacatattgaacaaggcacccataaatacttgtcatgtggagttatcccataataacaaaaggccactaagattacaacactagcaatcattgatcaacacatttggcttccttttataagtgattgtataaatgttaccatcaaagggaagtttaagaggttacctttccatttagtctaagataaaattaaggccaagagacttgaataacttgttttaagacatatagtatgaccaaaagaaatccagatttttctcttccctatttagcatcctttccctaccccatacctttaaaggacttctgtttctcttcacatgtagttgacatgaaatgaatatgattccaacattctgcatttcccatttcaatcataagtccccaggtctgatgtctacataaatgagtatcttggcttttgcctaaaacaaatgtactgagataatattgttaggaaatttctagaggaagctgtatcaattatgtctttatttcctcaattgtcaaggtttttctttttactttttttgaaacattttttaaagttaaaaaatacaagaatagtacaaataactcccataaaactttacccagactgctcaatttttacattttgccacagctgctttataattctctcctcctccctccttccttcttctctgtctctggctctctctctctctctctctctgacacacacacacacacacacacacacacacacacacacacacacacacattagtttttctctattgagagattacataaatcatgccactttacctcataatactttagtgtacatttcctaagaatatgatattttcatatataaccacaattataaaatttgagaaaattaatatcgccaccatatttttatcttttctacagttcacattccaattctgttaatcatcccagcaatgtcctttaaagcattacctccactcaatccaagatccaatccagtatgacattttatattttcttttcaagcctctttactctcctccaatatggaaaagttatttggtctttcttttctttaatgatactgacattttggaaaaatgcaagccattatttttacaatagaattatttatctaggttatacgacttatctattgctatgtcataaaccatcccaaaagtctgtggcttaaaacaaaaatttattagaacaaatacttctcatctctcactattccgtggttcagctagatgcttcttctggttgggccaggttggctaaagctgggtggtctaggatgacctcattcacatgtctggcagttggctgaatatcagcttgggtgacaaggatgacttagccatgtgtctctcagcagcctaattcaggctcattcacatggtagtgattaccgagttcccaagctcaggaagagagtaagccccaatgaacaaagacctcccaagccttcacttgcatcatgtttgttaatgtcctattcgccaaaggaaatcacaaggccagcctagggtcagtgtggcagagcgcttccctagaccatagatagaagtagaatgatctgtggccatttttataatctaccacagcaggcaaaagccagaaataaaatattttttcaagaaagaaagaatatgctattagaaagaatatgcacaggatctgagcacagtttggggagctggcagaagtttacacagccgcattgctccagagaagccaatgtttgccccctccccctccatgacccaagctgctgcaacatggtgccatcttgtaaccagacgcattgtgagagtgtgtcctgctccaggatctggtagccaatgcatctccccatccctgtggctttacagccatgacaccatacacacgtacaatagttcgccagctgaactgctgcagttaaactcagagaagtaaaaggagacattacaattgaagacataaaaacatcataggggagactattatgaactatatgccaacaaattgaaaagtctagaaaaaattgataaactgtaaacacacaacctaccaatattgaagcacaaagaaatagaaatcctggacagaccaataacaagtaacgagactgaatgatggccacagtgctatattctaccaaacgtatttttaaaagcaataaatgttacttttaagatgaaaatctattacgaaaacataattctaagctggttgattaacagtaactcacagaaatgtatatatgttaccctgatatttgatattgtaaggactcatgcccttaacaaaaatatggagctaaattgctgtgaatagggttgatgggcaatatcacacacacacaaaatgagaggggctgactcaatctcagaataacagtcattggaggagaatccctatttcatttttctgagatttttagtttttttaatgtttatttaaggttcaggggtacacatgcaggtttttaatatagtctaccaaacacctaaagaagaaataatgtcaattattttcaaacgacgcaaaaaaaaaattaagaagagggaattcttgcaaactcattctctgaaaccagcattaccctgttacgaaaaccagaaaagaatacacaacaacaataaaaactacaggccaatctccctgatgaatatagacgcaaaaatcctcaacaaaatactagcaaaccaaattcaatagcacattaaaaagatcattcatgtggtttaacgtatacaaaccagtaaatgtgacatatcacattaacagaatcaaagacaaaaaccatataatcatttcattagatagagaaaaaagcatttgataaaattcaatgtcccttcatgataccaaattaggtatacaaggaatgtacctcaacgtaataaaggccacatgtgacaaacccacagctagcatcataccaaatgggaaatagttgaaagctttttctctaagatctagaataagacaaaagtgttcattttcaccacttccaatcaacatagtacagggatcatagaacaattatgcaagagaaagaaaataatacaaattgaaaaggaggccatcagcttgtctctgtttgtacataacatgatcttatatatttaaaaaaaatccctaaaactccacacacataaaaactgttagaactaatgaagaaattcagtaaagttgcaggatataaaaccaacatatgaaagtcagtaacatttctacgtaccagtaccaaacttaatggaaaagaaaccaagaaagcaatcccacttacaacagctacaataaaaataagatacatgggaataaatttcatcaaagacatgaaaaactttctacaaggaaaactataaaatattgatgaaagaaattgaagaggatacatataaacagaaagctatgcctatgttcatgaattagaataattaatatcattaaagtgaccatactacccatagtgatctatggattcaatgcaatccctatcaaaaaaccaatgacattattcacagaaatagaaaaaaaaatcctaaaattcatatagaaccacaaaagaccctgaatagccaaagcaattttgaccaaaaagaacaaagctaaaagcatcacactctgtaatttcaaaatatattacagagctatagcaaccaaaagagcatggtactggcataaaaacagacatatagaccaatggaacagaaaagaaaactcagaatataaaagagaacagaatagagaaataaatttgcatacttacagccaactgattttcagtaaaagtgcaaagaacacatattggagaaaggacagtctcttcaataaatggcactgggaaaactgaatgtccacatgcagaaaaatgaaactagacccttacctacagccacatacaaaaatcaacccaaaatggactaaagacctaaaagacctgaaataataacactagaaaaagaaaacttaggggaaatgtatcatgacactggtctgggcaaaggctttttggataagacctgataagcatgggtaacaaaagcaaatatagacaaacaggattacatcaaactaaaaagcatctccacagcaaagataatgctcaataaaatgaagagacaactgataggagaaagtatttgcaaactatgtacctgacaaggggttaatattcaggatatataagcaactcaactcaatagaaaaataacaataacaaaacaaaccaaataatttagattttgaaatgggcaaaagacctcaatacatgttggaggccgcacaaatgtttatgattaggcacaactgaagcctgtcagtaacaatatgaacctgtgatcaattaagcaactgaccggtcattacctcctcctccttgctcctgttacccaataaatatgaagggctgagaagctcgggcagcggtctttgctcactagaagcagggagctcttctcttctctccacgttgcctttcctcaaaacagtttcttttgttttatgttatcatttctacgtttgtcccttcattcagtcataatgacggtctcaagcagtaacagtagtaaatgctgtaatgacggtctcaagtagtgacaatagtaactgtcatagtgatggtctcaagtagtagctgtggcagtcagccacaaatatacatttctccaaagataacacaaaaatggccaacagggatatgaataaatgcttaacatcactaatcttcatggaaatgcaaatgaaaaccatactgaggtatctcctcactccaattagaatagctattattaaaaagacaaagtaattaatgctagtgtggatgtagagaggggaactcttatacactatcgtgggaatgtaaattagtatagccattatgaaaaacagtataaaagttgtctaaaaaattaaaaatagaactaccatatgatcagcaatcccactactggatctacatcccacggaatggaaatcatgtcaaagtgctacctgcatttccatgtttattccagcatgatttacaataggtaagatatgggatcagtctaaatgcccatcaacagttgaatgggaggattaacttacagctgtcactcggatggacagagcagtgtgtggagactcacatcatgaacttttgctccaagaactaccacaggaaagttatctggaaagccaagacactccacagaccctttgaaggaagtggattgctgctacaagcccctgaagacagccaaaaaactgtgagtgctctaagaatgaaagggagatcatctgcccccaaacacagaccctcactggggaacctggaggtccagatcacgggaaaaggatcttaacttacctggagctgagaagaatttagagagccgaacaaagtacggggtagaagaagcagcaaaaagagccctgtgggctctctcagtccccaggaaagccatttctgtctcacgcggatccttggggagggatgccagaggaactgggaaaagaccacagggagaagaaaacttccagctgaactttgtaacacttttgactgaatgcaaagtttcctggacagaacctgggggagagggcaaatcgggagtgcagacacagcacagaagccacggcaggcaggcggcagacggagaggcatgaaacctgaaagccctacttgctttctcagctgggaggctggtagcctggggcaagttctcagctctgctcatccactgactggaaataaactaggtgctgttggggaggcacggtggaattgagaccagccttttgggctgcttgggagccaggtgaggcctataactgctagctttcccccatttccgcggtacagctttcccactgccttgcatgacgcagcagaggcacccacagtgcccccgggaacataactccattggcctgagaaccacaccccatcccccacagcagccacagcaagccctgcccaaagagactctgagctcagacaagcctaacctttccccctcttaatgatctttctctacctgtgctgacagcagaagacaaaggacatattcttttgggagctctagggctccacccaccgtctcatcctccctatactaccacagctgatgctctcttgaaagcaacacctcctggctggaggccaaccaacaaaaaacttgcgcaataaacaaaactacaaccaaggaccctcacagagtccacatcactcccctgccacctccaccagagcaagtgcttgtatccacggctgagagacctaaagacagttcacatcagaggactcagtgcagatactccccagtaccgacctggagcctggtagctctgctgggcagctagatccaaaagagaaatatcaattactgcagttcagctctcagaaagtcatattcctaggggaaaggggagagcaccatatcaagggagcaccctgtgggggacaaaagaatctgaacaacagcccttgagccccagatcttctctctgacatagtctacccaaatgagaaggaagcagagagacaattctggtaatatgacaaaacaaagttctttagcacccccaaaagatcatactagctcaccagcaatagatctaaatcaagacgaaatctctgaattgccagaaaaagaattcagaagattgattattaagctaatcaaggaggcaccagagaaatgtgaagtccatcttaaataaaaaaaaaattacaagatatgaagggaaaaatcttcagtaaaatagcataaataaaaaacaatcgcaacttctggaaacaaagaacacacttagagaaatgcaaaatacactgaaaagtctcagcaacagaatcaaacaagtagaagaaataacttcccagcttgaagacaaggctttcaaattaactcaatccaacaaagacaaagaaaaaagaattttaaaaaatgaacaaagtctccaagaagtttaggattatgttaaatgaccaaacctaagaataattggagttcctgagggagaagagaaatgtaaaagtttggaaaacatatttgagggaataatcgaggaaaacttccctggtcttgctagagatctagacattcaaatacaagaagctcaaagaacacctgggaaatgtatcgcaagaagatcatcacctaggcacatagtcattaagttatctaaagtcaaaatgaaggaaagaatcttaacagctgtgaggtaaaagcatcaggcaacctataaaggaaaacctatcagattaacagcatatttctcagcagaaaccctactaactagaagggattggggtttgatctttagcgtttttaaacaaaataattatcagccaagaattttgtatccagtgaaactaagcttcataaacaaaggaaagatacagtctttaatgctgaaagaattcaccactaccaagccagcactataagaactgctaaaaggagctctaaatcttgaaagaaacccttgaaatacaccaaaatagaacctccttaaagcataaatctcacaggacctataaaacaaaaacacaatggaaaaaaaaaaaaagtattcaggcaacaaatagcatgatgaatggaatagtacctcacatctcaatagtaacattgactataaatggcctcatattcagccaaactaagcttcataagccaaggagaaataaaatcctttacagacaagcaatggctgagagattttgtcaccaccaggcctgccttacaagagctcctgaaggaagtactaaacatggaaaggaacaaccggtaccagccactgtaaaaacataccaaattgtaaagaccatcgacactatgaagaaactgcatcaactaacagacaaaataaccagctaacatcaaaatgacaggatcaaattcacacataacaatattaaccttaaataaagaaagaaaatgtggtaaatatacacaatagaatactattcagccataaaaatcaatgaaatcttgacatttgcaacaacatggataaacctaggacattatgctaaatggaataaaccaggcacagaaagacaaataccacatgatctcactcatatgtggaatctaaaaacattgatctcatagaagtagagagtagaatagtggttaccagaggcttggagggtagtggggaaaggatgattaggagagacaggtcaacaggttcaaagtcatagttaggagaaataagttctggcattctagtgtgcagtagagtgactatgattaacactattgtatatttcaaaattgcttaagaaatgataaatgtatgaggtgagggatatgctaaatgcactgatttgatcattatacaatgtatacacatgtcaaaatatcacacagtactccagaaatatatacaatactatttgtcaatttaaaaccaatttttaaaaaacaaaaaagccagccaggtgcggtggctcatgcctgtaatcccagcactttgggaggccgaggtgggcagatcacttgaggtcaggagttcgagaccaccctggccaatatggtgaaaccccgtctctactaaaaatacaaaaaaattagctgggtgtggtggcgtgagcttgtaattcctgctactcaggaggctgaggcaggagaatcacttgaacccgggaggccgaggttgcagtgagccaagattgcactgctgcactccagcctgggtgacagggtgagtctctgtctcaaaaacaaaacaaccacaacaacaacaaaaaaaaaaccactgaattatatactttaaaatgataaatcttgtgtaaattttacctcaacaaaaaaatacaaattaaaactataaatagaacaaaaacgtaggtcagttctcttaaggaaagattgaattttatccctatagaggtaatttttaaaggtttattttatttttattttttattttgtagagataggatcttaccatgttgcccaggctgatctcaaattcctcggctcaagcaatcctcccaccttggcctcccaaagtgctgggattacaggcatgagctaccatgccccacctaaaagatttttaagattaacataaaagtttaatatttgagaaagagtctggatatttttaagacaaattggacaaggggaatactggcagggaggtcagttgcaaacgattccagaggtgatgagttttaattaaggcaggggggtagagaaaagaggatggcataagatagaatctccaaacagaaggtacagcatttcatgattgggcataggattgaaagattacaaaggactgggaacataacgctggtagaagtagatggcagtgttacccaaattgagtgatgcaccaggaacaggtttgaggggagtcctaatccttgagcacctgcagatcagggaagggtgcagacaatggattagcagtatgattgcgatatctgggcaaaggctaaacttttagaacactaagaaacaattgcttctttgaccagccccaaggaaagtaggtccattcagcccacaagtatcatcactttccagaaaagtgatcataattttgatagaatagacaacagtctcagagactctaaggctctaagggtgatccctgaatgtggttgtaggcattaagtgggaaaaaaatactgccttctcaatgtataaaaatatagtagagtagggagaatgaaaatggaggttaggtggagtccatcttagtgcatttctgctgctataatgaaataccacagattgagtcatttataaagaacagaaatttattttctcacagttctagaggctaagaagtccaagatcaaggtgccagtaggttcactgtctgctaagggcctgttcccttcttccaagagggcaccttgttgctgcatcctcacatggtggaaggcagatgggcaaaacggaagaatgctatgtcgtcacatggcagaagagatgggaggaaataaacccactccctcaagcctgttggtaagggacctaatcgcatccatgagggtgctgcccttatgacttaatcatctcttaaaggccccaactctttttatttgattttattttttgtagagacagggtctccctatgtttcccaggctggtctaagaatcctgggctcaagcaatcctcacacctcggcctcccacagtgttgagattacaagcataagccactgtacccggccaggccccaactcttaatgctactaccttggcaactacattttaatatatgaattttcagggacacagtcagaccactgtggccctcgtgcttctcctgttttctttacagttttctttatgtttaaagaaaacaggcatacagctacaacaggtgtgcatgatagccaacaaaagcaagccaccgaatctaccaacctccacatttctcccaagggaaatgacaactaagtcctctggctgatccaggaaaagacaacaattaaatgcaaggtcctttacttcagaaaccaacatcaacaccagactcaataaacctttagaagatcaaatctttttgtggttcacaactactgtaatagcagccaactcttctccctgtatcaggctcgcctccttccaattcattttccaaaatgtaaccaggtagatatattttaaatgaattttgatatttcattttatttactttaaccctttaataacttatcaggataaagtccagattctactgtggcttgtggggcagtgagtaatctagtactgacctacctttccaacctctatttttagactactgtctcctctgaatatttgtacttcagagagtgatctaaactgagcttggaaaggtaggctggtgctagattgcttagtcctccattagctattttagattgccccctctttgattacaaaaatccaatgccttgatcctatgacccacttccactcctaaatatctactcaaaatatgctgttgttcaccaaagtaatgtacaaggatgttcacagcaacactatacataatagtcccaaatgggaaacaatccagatcactcacaataacataaataaatgtggtatcttctaaaaagggaatactatacagccatgaaataaaagtagatatggccatatgcaaccatatgaatgaatctcacaaacttagcatcgcgggggaaaagcaggtacagaggaaatcatagtatattgttccaagtacataaagtacaaagatagtcaaaactaaactatggtgttgcaaatcagggcagggttaccattgcagagaagcacggtgggtcacaagggagcttctaggaagcttataactctgcttcttgatctgtatagttacatgggtgtttgctttgtaaaaatttgtcaagctgcacagttaaaatttatgcagtattctgtgaagtcatatcacgattgtttacactttaaaaaattatctcccttcttactcagcatccacttttgcctggctaatgcttgctcctacaactttcagtttcttccagaagttcttttctaaactcttagactattttagctcatcatgctgtgtgttcaaagttccccgttgttctcctatcttaacaactcttcatatttaattacaaatagttgttgaatcaagttttgcaaattggctttatatatcttttcaggcacattgtgaaagtgcacaacttttaatagggggcatgcgaagggagtaagatttaataatactccccgagggtagactatcagccctggtgcagtgcaaaagatagaagggtaaactagttatctattgctgtgtaacaaattactacaaatttagcagctttatacagcacatatttatcatctcatagtttctgtgtttcataaatccaggcagagattagctgggtcctctgttttggggtctcccaaggctgcaattaaggtgtcacttgggctgcatttcttttaggagtctcagggtcttaggctcacatggttgtggttgttggtctatctttccatactgttccttgcagctgtacgactgagatccctgctttcttgcttgctgccagctgagggccattctctgctcatagagtctgctcatattccatctcgcaggccctctcacaggcttctcaacatggtagcttcttcaaggccagcaagggagtgtctgttgctctagtcagctaaaagggacttatgtaacagaattaattatgaaaatgacatcctaccatctctgccctataagttaacctaatcaagggataaatatctcatcacctttttcacattctattggctagaataagacatgtgagaagcaagaagcaaatccaaggctctgcccacattcaaggggaggatattatacaagggcataactcatttggggttctcttagaattctgccaaccacaaaaagagtaaaaaaaatcccacaacatagatgtgggagccaacctccatgatggcacctaatgatcatacctttgtataatcccctctcacactgtatcatgtttggtttatgtgaccaataaagtatggcagaagtaatggcatgtgacttctgaggctagatcataaaagacaatgcaatgttcacctatttgtcactagttctcaggaaggctagctaccatgccatgaggacttttcaacagccctttggagcgccccatgtggcaaggaactcagaccaactgccaatgccaataaggttgccagataaaaaacagaatgccagttaaatttgtatttcagataaacaatgagtaatcgtttagcataagtatgtctcaaatactgcatgggacatacttatattacaaaatttttcattgtctatctgaaattcaaatttaactcggcatcctgagttttgattttgtgtatgtttcccataatttggtaaccctacgtgccaggggccatgagagtgaccaagcttccttaagccctgcttcagtcaaatcatctgacctgcaactgcagctgacattttaattgcaactttaggagagaccctaaatcacagcctcctatggaagctgctcccaaattcctgccccacccagagagtgaaataatacatacttattatttaaggccacttgtttagggagtaatctgttacacagtaagagaggactaataaaatatgtaactgtctaccccattatcttggccagccagcttgtcttttttatgagatacaatcatcaagaacagttccaccattaaaggagcaaactccgttctccagttgaagagtaagaagatagctcagaaatgacagttaagttggtcatttattaatgaaatgcctcagcatctatttaatcaaattaaatctgtcaaacaggacttcttgttagggaagtcagaaggcattttttgttgttcttacttactgaagttggcaacagcagcttcaacataacaaagcctgacagcttgattcagcctaaaaatgctgatgacaggcaagtgatgtctgctgtaaacagaaggtcccacagttcctcaagcaaacatgaaaatggcaaatgcacattacacaactgagagatcaggcagtgtccactctgccgccggagaaatgaaaagatgtttaaaaatgatttacacattattaaacatgcagctggagagaagaaaggaaaaatgggtaaccaaaggatctcaagagtagtggttcttaaatgggggctgtttctcccccctctcccaggcgacacttagcaacttacaaaaacatttttggttgtcagcactaggggcaggtattactggaagctattgggttgacaccaaggatgctgctaaacatcctacactgcccccacatcaaataattatccagccccaaatgtcatcagtgccaaggttgagaaaccctgcttaagagaggtataaacacactatttgttatactgacaaaacagattgctgtaattctctggtattcaggaaatttctactatgaaaatatttagttcattgatctagtctatggctctttgatttattcattctacattcatatattcatacatttatttgttcattcaacaaaattttattgagtgcttcagagtgccaggtgttttgggaaaaactaacatgcataagaaattcattcattcagctattaaataagttagtaagcacccagaagtaatgagggatgaatcaaatatgtgttcttccttcaaaacaatacaaaatttagagttaatagtaaagtgaagcaaaatcctactgactcaacgaagctttgtattaatataattctaataatgggtaactttcttaaggcaaacatttgaagagcagttgtcactgtcggctagttgaagaatacatcattaggccaatgtataaaactacctggatatatgtgttttcattaactcatctttctttttcttttttttttaaattttcttcaacttataagtccaggggtacatgtgcaggatgtgcaggtttgttatataggtaaacatgtgccatggtggtttgctgcacagatcatcccatcacctaggtattaagcccaccattcattagctatttttcctgatgttctccctccccaactccccacccaatcaggccctaatgtgtgttgttccccatcctcatgtgtccacgtgttcttgtcattcaactcccacttataagtgagaacatgcagtgtttggatttctgttcctgcattagttttctgaggataatggcttccaactccatccatgtccctgcaaaggacatgatcttgttcctttttatggctgcataccccacggtgtatatataccacattttctttatctagtttccttgatgggcatttgggttgatgccatgtctttgctgttgagaatagtgctgcaatgaacatacacgtgcatgtatctttataatacagtgatatatattcctttgtgtccatgcccagtaatgggattgctgggtctaagggtatttctgcctctaggtctttgatgaatcaccatactgtcttccataatggttgaattaatttacactcccaccaacagtgtaaaagcattcctttctctccacaaccttgtcagcatctgttgttttttgacttcttaataatagcctttctgactggtgggagatagtatctcattgtggttttgatttttcatttctctaatgatcggtgacattgagcttttattaatatgtttgttggccccatgtacatcttcttatgagcagtatctattcatatcctttgtccacttttcattgttttttttttcttgcaaatttgtttaagttctttgtagactctggatattagacctttgtcagatggagagattgcaaaaattttctcccactctgtaggttgtctgtttactctcttgatagtttcttttgctgtgcagaagctctttagtttaattagatcccatttgtcaatttttgcttttgttgctattgctttgggcaatttcgtcatgaaatctttgcctgtgcctatgtcctgaatggtattgcctagattttcttccaggaattttatagttttggattttacatttaaatctttaatccatcttgagttaatttttgtatatggtgcaaggaaggagtccagtttcagttttctgcatatggctagccagcactcccagcaccatttattagacagtcctttccctattgcttgtttttgtcagttttgttgaagatcagatggttgtaggtgttcagtcttatttctgagttctctattctgttccattggtctatatgtctgttcttataccagtaccatgctgttttggttactgtaggcttgtatagtttgaagttgggtagtgtgatgcctccagatttgttcttggctatttgggctcttttttggttccatattaattttaaagtagttttttctaattctgtgaagaatgtcagtggtagtttaatgggaattgcattgaatctataaattactttgggcagtatagccattttcattatattgatttttcctatccatgagcatggaatgtttctccatttgtttgtgtcctctctgatttctttgagcactggtttgtagtcttccttgaggaggtctttcacttcccttgctagctgtattcataggtattttattctttttgtagcaattgtgaatgggcgttcattcatgatttggctctctgcttgcctgttgttggtgtataagactgttggcaatttttgcacattgactttatatcttgagactttgctgaagttgcttaacagcttaagaagcttttgatttgagacattggggttttctaaatataaaatcatgtcatctgcaaataaagataatttgacttcttctcttcctattttaatatgctttatttctttctcttgcctgattgccctggccagaacttctaatatgatgttgaataggagtggtgagagagggcatccttgttttgtgccggttctcaaggggaatgcttccagattttgcccattcagtatgatattggctgtgggtttgtcatatatggctcttattattttgagttatcttccttcaatacccactttattgagtttttaacatgaagggatgttgaattttatcaaaggccttttctgcatctattgagatagtcatgtggtttttggcatgagttctgtttatgtgattaatcacatttatttatttgcatatgttgaatcaacattgcatcccagggatgaagccaactagatcatggtggataaactttttgacctgctgctggactcagtttgccagtgttttattgaggatttttgcactgatgttcatcaaggatattggcctgaagttttctttttttgttgttgtatctcttccaggatttggtatcaggatgatgctggcctcatagagtgagttagggaggagtccctccttttcaatctattggagtagtttcaatagaaatggtaccagatctcctttgtacttcttgtagaattcagctgtgaatccgtcgggtcctgggctttttttgcttggtaggctatttatcaccgcctcaatttcagaactcgttattggtctattcagagattcaatttctttctggttcagtcttggaagggttatgtgttcaggaatttatttattctagattttctagtttatgtgcataaaggtgtttgtcatgttctctgattgttatttgtatttctgtggggtcattggtgatatcttccttatcatttctgattgtgtttatttgagtcttgtctcttttcttccatattagtctagctagtggtccatctgttttattaattttttcagaaaaccagctcctggattcattgatttttgaagggttttagtgtctccatctccttcagttcagctctaatcttggttattccttgtcttctgctagttttggggtttgtttgctcttggttctctagttcttttagttgagatattaggttaacttgagatctttctagctttttgatgtgaggatttagtgctataaattttcttcttaacactcctttagctgcatcccaaagattgtgatatgttgtctctttgttcttatttgtttcaaagaacttcttgatttctgcgttaatttcattgtttacccaagagtcattcaggagcaggttgttcaattcccatgtagatgtgtcgttttgagtaaagttcttaatcttgagtatgttgtgaactgagactgtgtgttatgacttcagttcttttgcatttgctaaggagtgttttacttctgattatgtgatcaattttagagtaagtgccatgtgggcaatgagaagaatgtatattctgttgaatttgggtggaaagttctgtagatatctatcaagaccacttgatgcagacctgagttcaggtcctgaatatctttgttaatattctgccttgatgatctgtccaatattgtcagtggggtgttaaagtctcccactattattgtgtgggagtctaagtctctttgtaggtctttaatcacttgctttatgaatctgggtgctcttatattgggtgcatatatatttaggatagttagctcttcttgttgaattgaaccctttaccattatgcccttctttgtcttttttgatctttgttggtttaaagtatgttttgtcagaaactaggactgcaacccctgctttttttctgtttttcatttgcttggtaaattttcctccaccctttattttgagcctatgtgtgtctttgcacgagatgggtctcttgaagacagcacactgatgggtcttggctctttatccagcttgccattctgtgcgttttatttggggcatttagtcgttttacatttaaagttagtattgttatgtatgaatttgatcctgtcattgtgatgctagctggttattttgaagacttgtttatgtgatagattcatagtgtcactggtctgtgtacttcagtgtgtttttgtagtgactgataatggtttttcctttccatatttagagcttccttcaggagctcttcaaggcaagcctggtggtgatgaattccctaaacatttgcttgtctgaaaaggatcttatttctcctttgcttatgaagcttagtttggccagatacgaaattttgggttggaaattctttcctttaagaatgttgaatattggcccccaatctcttctggcttgtagggtttctgctgagaggtccgctgttagtctgatgggtttccctttgtaggtgacctggcctttctctctggctgcccttaacattttttctttcattttgaccaaggagaatctgatgattatgtttcttggggttgatattctcatggagtatcttagtggggttctctgcatttcctgaatttgactgttgcctgtcttgttaggttagggaggttctcctgcatgatatcctgaagtatgttttccaacttggttccattatccctgtctctctcaggtaccccaatcagtcgtaggttaggtctctttacataatcccacatttctaggaggttttgttcattcctttttgttcttttatctcttttcttgtctgcctgtcttatttcagacagagcatcttcaagctctgagattctttcctctgcttggtctattctgctatggatacttatgattgcattgtaaagctctcccgacatatttttcagctccatcaggtcggttatgttcctctccaaactggctattctggctatcagctcctgtactgttttatcatgattcttcgcttcttttcattgggttacaacatgctcctttagctcagtgtagttcgttattacccactttctgaagcctgcttctgtcaagtcagccatttcagcctcaccccagttttgtgccattgctggagaggtgttgcagtgatttggaatagaagaggcaatctggctttttgagtttttggtgtttttatgttgattctttctcatctttgtggggttatctaccttcaatctttgaggtcactgacctttgaatgagttttttgtgaggtattttttgttgttcatgttgttgttgttgttttctgtttgtgcagtttgttggggtctgctctagactccagttgcctcagtttctcctgtacctggaggtatcaccagtgaaggcttcaaaacagcaaagatggcagccagctccttcctctagaagctccatcccagggggatactgacctgttgctggcccccacatacctgtaggaggtggctggagaccctcattgagaagtctcagtcagtcaggaggaatgggatcaaggacctacccaaagaagcagactggctgcagatgtgctgtgttgggggctggaggggttggggggccttccttgtccagaccacctgtattctccaaagctagcagactgaaacagttgagttgactgaactgcagagatggtggccgctctctccctgggagctccatcccagggagatatcaaagttctgtctatagaaccctggctggaatggctgaagcccccacagggaactcctgcccagtgaggaggaatggactggggtcctgcttaaagaagcagtctggctacaatctggcaaggcagctatgcttcattgttggggacccttccttatctggattgtctgtgttctccacagccagcaggctggagtggctgagttgactgagttgcataggtggcagctgcccctcctcccaggaactcgaacccttctcaggcagactccaaccagctgctgttggacggctgggattccaagccagtgggtcttaacttgtgaggttccatggaagtggggcatgcagaatgatgctgcctggctccctggattcagtccccttcctagtgatatgtacaaatggatttcctgccttgcaggggatcccagggccagagtatataaaactcctggatctcggtgtgtgcctgagcagctgctctgccacgactccacatagctctgtgtaccagacccaaggccctggtggcctggactgaggaggggatctcctgattcaagggttgcaaagaatcatgggagaagcatggtttcccaggcagagtcacacaatcactcgctgcttcccttggctaggggtgggagttcctttggctccatgctgctcccgggtgggtcatggccacaccccttcccccaccaccaccccacttacttttcttcgtttttcatgggttgagctgtttgcccagtcagttccaatgcaagaacctggatatctcagttgaaggtgctgaattcactcgcccgttttcattcctctccatgagtgccacagactgcagatgcttctaatcagccatcttggatcccaatctatttttctttaatttagtaccgcatatagaaatttataaggagatttttaaaaggtgtttgtgaacaacagcaattaagtgaaagctaaaactttagtgatgattgaagagctggctctaggatgcatgcatgccttgcacaaaaatgcagctaaaaagaaagcctaaataaacatttcatgtcagcaatggcaggggtctgtgagagctctgaacatacctcttgtgaatagtaaggtgtcataatattactatgggaatcagaaaatgggagaatctaggagatttagaacaggtttcaaaggcaagcaaggcaaaggtatagtcataaagcagtttagctgacatgcaggatgctggaagaaaaaggagagagaaatacaggtacagagcccatgactgcattttagaggatgctcaatgctcaatgagattctcacatctaaacaaaggcatggaggaggggaggaaaggaatactgaacctttatattgttaagtattcctttaataaaactatctttagcagaatgggattgcttggctcttgtaaacagcaagagtgggactctagtgagagatacctgaagcaggagatatatatcaccagggcactctgtatgtgtccactttcttctttcctggtaccttctccatgaagtgaaaccatctttgctcacaacctcacatctctacacccattgaggttcgctctcaaagaagtcccggggaagagtcttaatttgtctggcctgatacacagatccattaggtgaaccagatacaacggtgtggtgaggttctatatttcacaggacccacccaaatcatataattagactgagaaaggagcaactgcctcaaagaaggagagcaaataaagatctgacaaaataataaatgcctactacttaaatgtcaaaaaacagcataataaattcgagtatgaaaaatattaagtagctattaaaaatttaaattattgttttataaatttaatgagatcccaatgagtgccaatcatttttgtctagaaccagtcattctaattgaaaagttaaatgacaaaatatacaagaatagctaggcaaaagcctgaagaataacaaaagtaatgaagaatgacaagtgctactagatattaaaacatatttataatgttcaaaattattttaaaatatggagctgatacacaaccagaaatgccaatgcaactgaatagtccagaaatataaaatagaaatccatatgaggatttagcatatgatagaagggggcatctcaaacctatttggtaaagttgggctttttaatcaatggcaatagggacaattgggtagccttctggaaaaagaaaagttggctccatacttcacagtgtgcaccaacatcaactccaaatggatcaattttaaaggtaaaactttgaaatcttaaaagtactaaagaaaggaaaatgaacaaatttcctagaagtagaaaaaactttcctatgatttatgtgaagtatacaactcagaggaaaagtacaaatgttttaatagtcattgtctttcctatcttttcacaggtaacaaagggtcagattctgaaagccctggccatgtctctttattgtccgtaaacaataacatttctttttgaggctcccttctatttccactctgttatttttatttatttatttatttattttgagatggagtcttgctctgtcgcccaggctagcgtgcagtggcacaatctcggctcactgcaagctccgcctcccgggttcctgccattctcccgcctcagcctcccaagtagctgggactataagcgcctgccacaacgcccggctaattttttgtattcttagtagagacggggtttcactgtgttagccaggagggtctcgatctcctgacctcatgatctgcccgcctcggccttccaaagtgctgggattacaggcgtgagccaccgcacccggcctccactctgttatttctatttctctaatgttttttttttttttttttttttttttttactttggtaccgtcattctgactttctatttctccttccttctgggggatccttcctttgacttgccagctcccatcttcgcgcttctatacttgaagactttcttgctgctgatcgtgtccctgcctgccttcctctatctttcaatacaattgatacttggccaggcattgtgggacaaaagaactcagaagaactagctgagccaggagaaggtgttgcgaaggcaggcaggactcctgtagctgctgggaagcagtaagggcaggaggatagctattcgagactagctcggccagctaggcaagggtgcaagctgtagccaaatcctaaactgtggaaatcacttttcacagcccagtgaagtctcagcttgagcttatgctgtgtcaccaaggagaactgaggctgtctgggcctctctgtgggctcagtgccagaaatctgttttgcttatttatttgagcatttaagggttctcctgagacagaacaatataaaacaaaacaaaacaaaacaaaatcctgcacaacaagcttgatccagatatagtgatcagaggattggggctattttgagtacagcatcgagtcagttatttagagttatcttcctacccagcatccacaattggacaagtgtgtccaatacttatggagggtccttggtcacattcctaagagctctgtaaggcactggggcataagcagctgctatgcagaggatgacagagaaaagggaaattcttcacccacttcataccaagtcctcaagaaagaacagcagtgcccagtggacaggtcatcaatacctacaaactcacagggacaagtcacagcctgagcccaacaggcctgatggaaagaaaaattcgtgatttgtttatgggcacgtctgatatgccctgatagctctcgaaatcactggggtgggggtgggggaaggggaggaggagagccctgcaatggcaggaatggtggaaataaagaaaaaagaggtttcctctgagaagctatacatcatcagcttgggtgtggtattttttcagagtgctttttgtttcatcagcaatgataaagcaagtagttcagactgatttgggtctctgatcctagggaaaatgcccacccgcttcaggttgtcaaaaatacctgttggacatttggccaggatggttgggagggctgttggggaaagagcaacagttcaaatcttggctctgtcagaaatgagcaatgagacttggaatttgtgcccgaacctctctgggcctccgttttttctttgtaaaataaagaggttgtgctatatcagcaatttgtaaatggtattgaatagcgcactccagtctagggagtgcctgggctgagaaaaggggactgtgaaggctggctgagatggccctaggcccccagccccacctctccaagagcaacagcatacatgtcagtttcacatattgcagctacttagttgtttttatttgagggaaaatcttgactgctaaaataaacttggacaaccacttaaccaaaatagtaattcaaaggaaacaccacagtagagctatgaggactaatgggtactattagcaagagagaggagtgtttatcttgcaggtgtgccattctgaacttcctaaggattctgggcaaaatggaactcactaatgcaagaaatgaagacatgccatctgggccacgttgggtgggcttgtaaggcagttgaggtgttgaagctagagagaagggttggaagataaagtagaaagaggaatcaaggaaagaggattactgggtactcatgtgaaatgagctcaaagtaactggagggtgcctagaggggaacagtggggcaacactggcctcatctactggtctccacaggcattcctgctttatcacatgtaagaatgcgttgtttctgaagccttgccaggcattgctgggtctaaaagcaggttaacaaaataaaaccaatcattacaatactgaaatacttaaaggtttataaactcaactcgtaaagattcaaaagcctctcttaaatgaaggtctgctggtagtgtaaattagctgatttttcacaggggtctacctattaggacacctgctgagagttatcactcagttggcagttacttatcatcacttcaggagagattgaaaatagcatattatttttctaggatgggaaagtaatgttattctaccagttcaaattcctgagattacaatttgcattactcaatatttttttaaattctatctgctccaaatagataaatattcagtgctgaaaatggaattcaggggataattactggattcatataaagctgcaattatagtaatctgatgatttcaattactctggctttctctttgacaaggatgactgaaacacagtaaaattagaacccataggtcatataaaggtaagatcactggacagcattttgtatggaaatattcactcctaaatatgactcattagcatcacagtaacaaaatgttgcaaagctttccttctacaaagaagattggcacatcctgtcttacccaataacattcattctactcctcctgtccccaacaaaatgtaacaggaaacaatcaatcactacccgatatcacgatctttcaatgactgcttcccaaatgctggagtgagcaaagcagtatgaattcaaatcatggctcctttggagacttgttataagatatatgtgagttctctggatctctaagacctacatgttgcttgcagcatggccctccaaattcttacatttggaatgtgaggttcctccctgccttcctcctcaatgtccagaacaaaacaatagccaataataagaaagaaaataaaaatgaaaaacccaccatgtatgaaaaattctattatttaaagagggaaagggaggacattttctagcatttaacaggtgctgctgttaacctacttacatggtttctgaggttgaaataaactctgcacagctcctggagatttctttagtccagtgattctcaacaaagagtgattttgcttcctaggggacattttgtttcaatgtctgatgatatttctggttttcttaacttgagaaagtgctactaggatgtagtgggtataggtcaaggatgctgctaaacatcctgcagtgcacaggacagccattcatgataaaggatgatccagtccaaaatgtcactaatgctgaggttcagaattcccacctaacccaactgagacatcatgcatcatttgtcaatggtgcttaactgtactaaaatagagaagctcataaatcattccattgtgtcatataatagagattaatcctagatgatggccagaagagcaagaggttgccaaagactggcaaagtgaggcaatttcagatttaacatatgtggaagacctattgtgtgccagcttcccaggtaaccccttcaactcgatgaataattctctgaagtaggcagaactatgttcatttaaagaagcacaatctaagactatgagtttagtcatatgttcaaggtctctcagctaggtagtgagacagagttcaatcccagaccattttcctttcaacagaatttggaaatggaaggtggtacataacacatgccaagcatatgctagaggaaatcatgtgatagaaattgagatttcttttaccacttctgtatgtccttcccgtggcttctgcttaaaatggtctataacctgtgactttgttcagaagataccactgaaagccactttggtcctatgcatggggcaaagcacatgatgcctgggattctacttgcccctgagcagtccttcaccaataactcaggactttgagagtataaaagtccaactcctgttcctcaaggtaagacaaaggctgagaagtaacttacactccagagttcctctgcatgatcaggttgaaatacccaagcaagacaaaaatcacactcttccctgtcctgtttccctaactccttcaccattttctcctgagagcacttctttaagaaatcacttgcacacaaattcttatctctgggcctgtttctggggaacccaatccaacacataagaagagatatcttgcagggccagggaggttggagtgcttctcagagtaaaaggacatttaactgggctttggtgggtgctatggtttgaatgtaccccttcaaaattctggtattgccaatgtgacagtattaagaggtgggatctttaagagattattaagccatgagggctcctccctcatgactgggattaaggtcgtcataaaagaggcttcaagcagtagtgtttgtctcttgcctttctaccttcccccatgcccaccatttgaggacacagcaagaaggccctcagcagacaccaaatgccagtgccttaatcttggacttcccagcccctccagaactgtgaaaaataaatttctgttctttataaattacccagtctcaggtattttgttgcagcacagaatggactaaaacattgcgataataatcagaagatagagaaggaagtgaggactagatgatagtggaagataaggtctgagagatgggctgtacccagaatgagtcaaactaatgtatttggatatatcctgtgagcaatggaaaactattaacaatttttcagtaagagagaacattccacatgaaacagaattgctacattaataaaccttagttgatactaaacataatttattggacattttccaagtgtgttactaagtaatggggaacctgaaagtacagcaaaatgtaataaaagaaaatgaaaaattcttaggtgttgattactttctctgtacaaaggggctttgtgctccagaaatacatgaatagaccaaattactttgaactatgattataaccaaaccataaaaaggaaacttgtgttcccgaagcctgggaccacttattttacaaaatgcaacacttacctctataagaagctaattttctaacatgaaacaggaaaactactcggtatgtcagaaaaagtgtggtcgttttttatttgtttattattaaatattccctactatgtgtcaaacgctgaataggttatttaaaaggaaatattaaagtcgaatattgaaatcactttctgagtttttaatctctcttttctgtacatataaacagaagagttacctacaacattaaatctttgagatctaaaaagcaagttataaatgacagtcaagtagaaactctgttaaactttttaaatgactatctaaaacattctgaaagaaattattttgatgtgaataacacagaaggttagagttcagtctatacttgattaacaatgttacaattcaattttaatttaacatttattgcctagatcaggggccagcagattttaccgtaaagagcaagatagtaattattttaggctttgcaagccagatggtttctgttgcaattactcaaccctgcattgcggtacaaaagcagccatagatattacacaaataatgggtatgtctgtgtcccaataaaactttatggacactgaagtttgattttcatataattctcatgtgtcacaaaatattcttggttttttttgttttttttttccaaccattaaaaaaatgtaaaaaccattgctagttcacaagcaggctgtataaaaacaggtaatggacgaatttggcccaagaaattggtgtcccaattttttccccaaagcagggctgaggcaagggcttgggtacagacagtttatttgggaggcagccccaggaagcaagagtgaggtaacatggagagagaaaaggaaagaaagagatatcaagaaagagaaaaaaaccaacaaagtatgtgttgctgagttggttactgcaggcagttgggctctatcccactagagactctctgagaaactggtagcatatgctgtaggctgagcgtggtggctcatgcctgtaatcccaaaactttgggaggctcaggtgggcggatcacttgaggtcaggagttcaagaccagcctgaccaacatgatgaaacaccatgtctattaaaaatacaaaaattagccaagtgtggtggtggatgcctataatcccagctagctacttgggaggctgaggaacgagaatcacttgaacccaggaggcagaggttgcagtgagccgagatcacaccactctactccagcctgggtgatggaatgagagtctgtctcaaaaaataaataaataataaaataaatatttcttttaaaaaaaataaaagatgaatgtgctttagaaatgcctctctgaaggatgagaggcagaaggctagagtcattatctactgaatacagtcccttcacttcaggttcccccacctgtgggtcattaaacctccctctgctttggcaaaagcccccaggcaaaaaagtaaagaggtggttcaagaactcaagatgagatactgctggccagcttgggaactttctaccagagcagcatccaccatcacaagtgggccatggggatatggcacaaggaacaaaaagtgtttgctacagagggtaataccatttatttctgtaatattctatttctgtgggagcctaaaatcacagatttgaggagattaatattctaaaagcaaggtcactcacaagctataaagttaaaaactcagaagaaagccaatatcctaggggccttatccaactggccacacacccagaaagaaatgttggtcatggattggaaagcaaactcctgaaatcaaaacttacaactgcaggtctaagtggaccaatttagaatgtttgtgagcagttactaagtgtaggtgagtctgtagctttttagataaggtcaccagcagtgaagagggcactgttcatgcaacaaaggatgagtcctaacaactctttctggaagaaagggcattaagatagactcttagcctgaggtcttaatctatcactcagaagaaaatgaggagaaatatcactgtttgtaatcaagttggacagggggacattcaaagatggggcagagcccaccaggaaagagaactcactctcagtgggagctagcacaaaaacccaaagggaggcagagtcaatatctgttgttttgtctgcgggatttatttacctttcttgtaaaatgaaactcatcaagtccttaggtatcctcttaggacatcgtatcaactaatagtggacaatgttcagcagatgtttctgactagacctcacccctcattttaacacgagactctgaccactgtcagtgtatcttacttttctggccacagtgattggttcaggaataatttgtgacccagtcagaactattaagaggtgattagtctttttctagggcttcttggagacaggacagtgtcctttcttcctaggcctaaatccgagaggatatgaggtatattaaggctagagccagcacctgaagctcaaattgaaagccacagggaagaaggcagagccaggagatggtaagaagctagactcagaatccagccatatttatctggccaagatagtatggcacatgcttctcagacattaatgtgcatacagaccaccttgggctcttgattagtcggggggtcttcttaaaatgcagattcttattctagcaggtctagaatggagcctgagatgctgcatttctaacagtctcctaaggggatgaccatgctgctggtttgcaggccatattctgagtagcaaggaaggaaaatgcaccgaaccttatgtccataatctgatacaggaacccagcagttcaaattaggcagggctgaaacagctaattaagttggatggctgctcctgattggcagtgtgaaacctaaagcctggagaacaaaaacctcatatatctaaattttcacctcaaggcacagattaaaatcaaagattttctataaccatgctttaaaaaatattttatcccttatagcaaaaagaatgaaatatccaaaaatctaactcagactttgaatctgatcgaatccaagtttgcttgctgaatcacagtatcagttgaattcatagccctgctaggtctttgatgtgagcaaaggcagtgacctggaaagagtacaatcccagcagtttaaatggaaatatctgaaacactctgaggagtcccctaaatccccaacctcccaatgaagcacttcccacagccttctgggcctgcagagcagttctcctatccttgcttaaagaaactgttacttcctggcctgattatgctgccttgcagaacaaagtaatttgtaccccaccagttattgttgctcagtcaataaccataatcagattctagcatgcctggaaagggtttgagtgtggaatcaaactagggaagagaaggcttatacaatggaggctttaagatagaaaattggggatatttctgggaacagatcttaaggatgttgaacccaaaaggtaagaatatataaaaagaatggaattcacaataaaacaacacatatttcaatatgaaaaggttcaagcctgactacaagaaaagacaggagtgtttggatgcttgccccattaccttgaatgcaacagctataaatgccaaggaatgcaaatgtgccttgttagcaatacatgtctgtattaattattcgtttcccattgttgctgtaacaaattactacaaactcagtggctttttaaaacaatgcaaggccaggcgcggtggctcatgcctgtaatcccagcactttgggaggccgaggcaggcggatcacctgaggtcaggagctcgagaccagcctggccaacatggtgaaaccccatctctactaaaaatacaaaaattagctgggcatggtggtgggcgcctgtagtctcagttacttgggaggctgagacaggagaattgcttgaacctggaaggcggaggttgcggtgagcagagatcacgccattgccctccagcctgggcaacaagaagcgaaactcagtctcaaaaaagaaaaagatatatcaaatgtattctcctacatttctggaggtcagaagtctgacacaggtctcactgggctacagtcaaggtgttggcagggcagagcagagctgcattcctttctggaggtcctagaggataattcattcccttgccttttccagcttccagaggccacctggattcctcagctcatgactccttcccttctcccatctccaaaaccagcaatcatatcaccccaacctctgcttctgtcctctcatcttcttctctgaatttcctgcctccttcttagtaagatctttgtgctggcaaggttgcagagaaataggaacacttttacactgttggtgagaatgtaaattagttcaaccattgtggaaaatggtgtggtgattactcaaagatttagaaccagaaataccatttgacccagaaatcccattactgggtatgtacccaaaggtatataaatcattctaccataaagacacatgcacgcatatgttcactgcagcactattcacaatagcaaagacatagaagcaacccaaatgccatcaatgatagactggataaagaaaatgtggtacatatataccatggaatactatgcagccatataaagaaacaagatcatgtcctttgcagggacatgaatggagctggaagtcacttatccttagcaaattaacacaggaacagaaaaccaaacagcgcatgttctcacttataagtgggagcttaacaatgagaacacatggacacagggaggggaacaacacacactggggcctactgtggggtggggcaaaggataaggagagcattaggaagaatagctcatgcatgctgggtttaatacctaggtgatgggttgtaagtgcagcacaccaccatggcacacgtttacctatgtaacaaacctgtgcatcctgcatatgtaccccagaacttagaataagaataaaaagaatcttgtgataacagtgggcccacctagataatccaggaaaacctttccatctccagattgttaatcacgtctagaaagtcccttttgccgggtaaggtaacatatgcacaggttcttgggattaggaatataattaacactgggttttctagccttacagtatatccatgctagagtgcccatttctttgagctttctgacctcttcttacaccacctgctatggcaattctgccatttttacttgacttggtgcaggtaactgctttctccaagcttccatgagccaacctaattgtgtatcagcatactctccttgcattcttaccgagtgttaaatcctgcatcagaggaggatgcacctaagtcaatacactccctttgatccaacttttgctctttccttgatccagtgtcctcaaaatccagtagcacaatcctcctctggttcccaacagcagcatatgttgaccagatctggcagcaactttggggtatagtccccctttctcttgggaggccagcacttccctggcaggcttatattgtgatgggaccctcgtttatctggctgcaggagatgaaagcttcccatcacagttctaacaatcacaggactacagtacgccagatgctgtctgacctttacctcccccaagtgatggggtcctgattgctggcaagctggtgggtgattccattttagagtgtgctttctcagaccactccgggtaccaaacctcatggctacaggagtgctcttgggaatgcctagaaaagtctgagtaaacagttgagcagagagagaagttaactgcagagagaagttaactgcaatgtcttcaccaccatggcctcagctgagcccaggtggagcactctggagctcagatggtcctttcagttgtcctgccttgaagcaagggggctgggcctttatactcctacatcaactagtcaaaggctgtggctttctctggggaaatcaggtgtgatgcaccaggcaggtagctctcttcagccaaagggaattcccaaagaggaactctgctgagagctgtcagccagcagcacccagcagatgggggaggaggggagataggcgcttcagtcctaaatgaaaacccggattattcacagcatcatctattataagggcaatggttaaaagttgaaaaaagccttgtctcagcaccttaaatatgctgagaggactcttcctgacccctagatgaggactgtggcatagtggacccattatctaaaagtggtgggggtctgacacttctctttatcattgcttgccaagaatggaacctgacatatgaatgaacgccccaaaaggaaataaaacatttttaaccctctatttgtgctaatgcctatcctttcagtgtctcttggcctgcatgacaagggaaggaagctgaggaaaagtgcacttaaaagaaaattttccatgtctgcaataagaaagtgaggagaaggagcctcataattagtaggcaagaagcagattggggtaaaattgtccaagaggtagcaaaatcatctctatcaggcctccattaatgttgagaagttcaataccacctgagaacactatggtatcagccttgctctggctgccacctccatagtaccaatgtctccaggtttatgacataacaccagaagaatctgtctataatccaataataatatatttcatagaccatggatttagagctcagtgagtcaaacgaagtgaaatgtcagaatgcaaaaactttccagtgaagaaaatgggtcaaaggcaaaatgaagaccatgactctgagaaaagttaatttttatatggcctcagtcactacatggtgaatttctttagagaacaagcctcacttagggtagggggttgctgagggggagccagagaaatagacatgaagaagtgagagggaggaaaatttccattttcctcattgattaaagtctgtcatcaatgccccttgggattcattcaattcttgccatccttatgaaaagtcatttaaaacatatatgaaacaaaaagaacaaagaaaaaaaagcacatataagtgaaataagccaggcacagaaagacaactaccacatgatctcacttacacatggaatcttaagtcgaactcatacagagtagaatggtagttgccaggggatgagggtgggggtgtggaaaaaggggaaacatgagggtggggatgtggaaaaagggtcaaagggttccaattttcagttagaaggaatacgacttagtgatctattgcaaaatatgatgaccagaattaatgtattgtatatttcaaaattactagaaaagaagactttaaatgttttcaccacaaaaaataagtaggtaaagtgttggatatgttaattagcttgatttaatctttctataacgtataaatagatcaaaacatcacattgtcccccctaaatatttacaattattatttgtcaatttaaataaataaataaaggcaaacctaaatctataaattaaaaataaaaaagttaatttgttagttttttatgaacctagtataaataacagaaaggaacaatgaaacagacgtgacttagacaagggaactaaggagaaaaccagaagacaagacaaaaatagtaataataataaataactctaatttttaaaaatagaatatatatatatatatatatatatatatatatatatatatatatatatgaatgattataaaactgagatccagtgagaaaagtatggtatgactaaataaaacttcaacctttttaggtaaaagctgcagttaaaaattagcaaaaagaaaaggagaaatctggctagactgtgtcagaggaaagtgctaggacaagtcccggggctggagctgcattctactcaggcagctgtagaaatgtgcccgagagggactgagattccaggaagcctgtattgtgaccaggctggaaagcagacactatatgaagtattttaatggaaaggatttaatgcagagaattgaactgtttgttgccagagaactgaaaagaaaaacaggagaaactgacgcagttacccactactacataagaggttaaggttattggaatctaaaggtttagaggagccctgtggaatacggactcagacatccaaggtaggggcactgcccagcctggtcatggtatctctgagggatacaacgacgctagttctgggaatgtagcaatactggaaccaactgcaactatcagggtgaagaaccattgctgtcctgataccgactgatgggaccagagttggacagaaaggagcaggtcccttctcctccttctaaccttgacatctctctctagggttccctataggcagagcctaacacggcatcagctggcaaaggtttgcaaaatcccagcctcagcatgataaagcacagtgctgtccattctggttgccactagccacaagtagctatttgactttcaatttaaacacatggaaattgaataaaacaaaaaatttagttcctcagttgcattagccacatttgaagggctcaagagccacatgtggccagtggctaccatattagaaagcacagctgtagggaatagagtggccctaaatcacataagaaggaactcagatcatcttggaaattttcaccttctatgttgtatctgcagacccagggaaaccatccctaccccagcaaaggtgatctttcttcaaacaaataacagtatcatgtcattaaaaaagaacttttcttcaatatgatgatggtagtgatggtggcaatatttatttcagtatgtacatttagagtcaggtcctatcctatgtaaaacactttgatttcattatcttatttaataccacaacactataagctcagtactttttcttatcccatcttactgatgtaaaacctgaaaattagagggggtaaggaacttgtcaaagccaaacagtgaactctagtgcccttgacttaactgctggggtatattgtctcaggttgtcaaagggaccccatgctttcacaaggaagagattttatttgcctgccattattcagtagaatgttattttctcagaaagaataaattggacaaagaaagccaacaattaggccagtacggtggctcacacctgtaatcccagcactttgaggggccaaggcaggagaactgcttaagactaggagtttaagaccagcctggcaacatagcaagacctccctctacaaaaaataataaaaataataacaaattaagaaaagccaacaattaatgacacttaataatataagaattataacaatgaaagtaatttcagtttaataaaattgactcccaacagacaacccagcagggaggaataagggttgtctttctgcttttatgatgagtcgtcatgctccctcacactcagtgtttggaaatggcttggattaagtccttcacctttcagtttatgatgtttgcaagatgactgcttattatatgagtgatgattagagctccttgtgccattttctgtagcattgacactgcagttatttatgtcatgctaatcagaggtaacatggtgaagacatggtagggtcaatcattagtctggtgatactggaatagttactaaattcctctaagcctcagattccttacattgtagggatatcatgaggattagattagatcaagaatatatgtaaacaatctaaaacattctttgacaggtagaattgtgctattattaatgcatattaagtgacaatctaatagatggaataggagacagaaacaattatttcttataagaatgtatgcattcctctgttcactcaacaaatgcttactgaatgcctgctatgtggcaggtactattctaggttcttgggatataccagtgaatacagcagaccaaaatccctgccattatggagctaacattgtatctatttaggactcattctatgaaagacataaccccatttgtcacaaatataaatgggaatcttccctgtccttaagaaatttatattccattaccttgaaagcttgtaaaacaccctctgaaaggaacaacaaatatttcattgttaactaatgaaatattcctggcaacaggaattaagtgtgtggtgggaaaaatgctaatttagagatcagagaatctaggttctagccacatctctgtgtttaacttcttgtaattatcaatttatactctctgagcttcagttttctcacctgccaatatgggagtagaatctcaacagcattttcagtgatagttatattttttatatgtctactataatcatgctagcaagacaggttaaatttatggagactagaaaaatatactttctcatatttcatatcataacttcaggtactactatcatgttgagatgcagccttatgggcgatcacatagttgtcctactgaattgagatgcaaccttatggagggaggatcagttagttttcctgctgaaaaacaaaggcagactgtttagagtgttgcaaaagcagagtctgaaacaaggaaataatcccacaagagtgttggtcatttgattgagtagggatcccaagaagttgtactaagagaaaaggaccagtgagatagaggagaaagccaaaattgggatggttagtggggtgggggttgtagcaattaggactcagtcgcaccaggacttctgagaaaagacagaatacctcctagaattgcccaaccaaaggagaagaggctagtacattctccactggatcccatccctgattaattgaggtttatcccccaaaatgccaacaacctcactttctaaggccaactggtccccacagctttagctttgagaagaccatgagaaaaaaaaaagcaaggcgtgaatttaaggtatgacactgttatgtgttgaagtatgtctcctcaaacttcaaatgttgaaacctaatcctatctcagaatgtgaccatatttgaaaacagggtctttacagaagtaatcaagttaaaaatgaggtcattatggttggtcctaatccaatatgactggtgtccttataaaagaggaaaatttggatgcacgcatgtacacaaggagaatgtcatgtgaagattggagttatgctgccacaacccaaggaactagaaattgggagagaggactagaacagacccttccctagcacctctggagggagtgcaggctgctgacaccttgatcttggatgtccagcttccagactggtgatgataaattgctgctgagtaagtcactccgtttgtggtactttgtaacaacagctctagcaaactaatacagacactgctgtgtgaaatctgagcatgggaagaactgagcaacacagctatggctgatattacaggcaggcaagggaggtgacactgacacaagcactaaagacatctgctacagagctcatagactgtggacatactgaggtgacagattagcctcttgtttctcagttctccctaaagaaagggaatgcaaatggaatacaaatgcaatggctagaactataacctacactgtcatagggtttgttctctatgttcattatatttgaagcaatgataaaccctcctattcttctctcagttgttaatataccttttcttcccaaggcagccattaagatcccatgtccttttttatatgaagcaattacatttgttaacacatttgaaagggggacattttaacagcttgatctccagaacagcctccatttcttttagggtaagaatgacaaaaacaaaaagatggatgacaactgtgtcatacctaaaaatcttacatttatattcataatcttttacattggaaaagctttaaaagttataatgaattcactaaaaatgtatgatagaactgccaagaacatcgggagcattagtttttgcctgaaatttaagattctttaactgggtcaggaatatcttgctaagagcactcctctcagacactgtcattttgtactttccttccaaaaacatcaatctcaaaagagatatgtgcacaaattaatgagaggatttttttcaagatgctgaataaatttgatctgaaaaaagagcaaggctctccattgacgcctttctcatgccctactttggttagaacctgactttccctccccacctggctgagctgtccctcctcgaagtgaagcaatttcctggtatgaatatagatgttaaaccctgctggccaagtggaagcagaggcagtgtttcaaaatcaatgcaccattaaaaaaaatcaatatattcaattcaaaaattcaatatattgtcttattttaaaaggagtcaagaattaaaaacacaaaaagtaggttggaagtaacccagatattttgtcttacataatattttcacttataatactgtaaatttaaaaagaaaatgtgccatatttatattgtaggagaagaaatgtaaagagttgcctttttctaacacactttctcatgtatatagaaatacattctaaaatacattgtaagacaatttttttcttccctttcacaaaatttccaaagtagaaggcaaccgagggcattagttgtatttcacggtagacaagttaccatcattctttagaggagattttattatgatatctgacttatttctttatatattctccttatcatgttttcaatttatagttttttactatcccaggccaaacataacataaaataaaattagaggaatttgtagctaattctacatttccaaatgaattattcaattacaagtttcattggtgttttagtgggttatgacttaatcaattcttcttccatatttacctaatggaatttatctttatttcaataagccaagcaattgaattttttgaaggaaataaatcaatgtatgtttcttaacatgtaaaatttctcactgatatgtaaaaaatttaagtctttaaatttagattaaaaacccataatatattgagccataaaaagagatgaagtattgacacatgctataacatgaatgaacattgaaaacattatgctaagtgaaagaagccaattataaaagaccagatattgtatggttccattaatatgaaatgtctagagttagcaaatgtgtagtagattggcagctgcttagcagtataagctaaagggtatagggtttctttaggggcaatgaaaatattctaaaattggttgtagtaatggctgcacaactctgtgaatatacttaaaaccatagaattgtatactctaaatgggtgaattgtatggtatgtgaattatatctcaataaagctgttacgaaaaaaagatcaaattttcaaaatccaatagcaatattttctgtgtcagtgagcaagaaattcaattaatctctaactctgtaatgtcttaagctgttcattcactaaacagaaatcaaatactgagttaacacgcgtagagagaggacaaggatgaaactcccatcttgagttgaacacagaagccaggcaaagtggagtgtgatttttcttttttaaagtagtgctatataaaatatgctttgcaattatagaggaagaggtggtaacttgtatttcagtgagtcaggagtcagaaggggcatggaagaaacaatatttgggttgaagaaggagatggaatgggaagtatggaagggcaggagatgagaggacagcagttatttatgggtaatgaggttacaacgtgagtttaggccagaacatggaagatttcatatgtcctgctaaatttgctcttatttgtttgtttgtctggttttttgtttgtttgtttgttttttgtaggctctaggacactgttacaaatgtgtcttgtatgtaagcagatacttacatacttttacatacagctaggtaatggtccaggttgaagagtcaaagacagccccagccaaggcagtagatgtggagaggaggagagctttgatttttaacgtatcttagaggcagaatcaacagagtttgttaactgacagatcctggggatgaagactgaaggaaagaatgatgaaagatggaagatgatgcaaaagtttttatgttgggtggctgtgatgttgctattaaactatagaacaccagaggggaaaggatgaaaggtaaaataatgagttgagtcactatgttgaaaatgagatgactttgagatatgcagttggaatcatgggtttgaattaaagggaaaattggagctacatatattttggaagtcatcatgaatatggaagacaattaaactgccaacataataaatgtttttcaaaattatttcatttaatgtccatggcaactctgagctgtacattatttttactgatgaaaaccctgagagattctgggagattaagtaactttccagaagccacatagctagtaagctgcagagccaggattcaactaactctcactaaatgtgaagcctatgcttttccctctgtgtcttgctgatcttttctaagtcacacagtcattgcagtaggtgggctcatccagaaaaagtctgtagagtggggagagaataggcacaatattgggtgtgatggaaaaatccaatgtagcttgtttgtagtttatattccaaaaggggaaggtaataaaaggtgcgactgagaaggaccatagccactctgctatagtgatgctttcacctgacaatagctgttacttggcttcccagaaaacatttcattaggctctttgagtgaacatgcctttttgactctacagaataaagagaattgagaagtcaagaacacttaggcagcaataagagaaagggtgtcctggattgccagcttttcaatttcaacacaatgctttaaaggctgtcaagtggtcattaggtagccaaattggtagctgaccaccagtcagatacatctctcttttaaatctagtacatttgtttgatccttctactacatctctggagaaaaggctttaattttcatcttagtttttcatttcaacaaaacgaaatacaaattttggggtagacactagcaaacagtaactatattccattaaatgttgaaatgttttcaaaattaatgcattcactcatatatttaatgcactttcattgacaatacactgcccttgccttctagaagactacagtttagctgcagagagaagccagtctttaatggtcttaaatcatgagtagttttaatgagaagcagccagaagagaggaaaagggtgaagatgcagaccagcccttgaggagagagggtgtgatgcacagcacaggtgaaaagattcacctatgaaaaggggacatgactcttcaaatgtaacagctagaggagaagaaagattgcgtgcaaatgcaattggatgacaagacaattgagagaatttctgtttaatgacttctattatttttcctgtgaaattttcttctgaaaatcaaggggaaagtttcaaacaagcagagatatttagaacaatattatgtcccaaacacaaagatgtctacaccataaacacaagagaacagaattaccggagctggaaaggcaattctgagtgcacagaagaaagagacatcaatgcaatatgatccagccatacagcttgctgatagagggtttgatgggacatgagtatgaaactggaaaatattaaggagtaaaaaagaggtagcactacagatctgttgcttcagctagacatttgataggtgccttataatacaaataagtggttaagatccctttgagtgcctaaaaggcagatatttcatgatttttattgacagaagactaaggccatggtccttaagcttggctacatgttggaatcacctatggttgtagtaacctatggctgtgtaaccaattgccacaaaacttggtagcttaaaacaatgagcacttactgtctcacatactttctgtgggtcaggaatttagaagtagcttagctgggagttctggctcagcatctcttgcacattggcaatcaagatgtcagttcaggctttagtcatctgaaggcttgactggggtttccaacgtggctgttggtagaaagctgtattagtcagagttctccagaaaaacagaaccaataggatatatgtgtatgtatacacacacacacacacacacacataggatatacatatatcctattggttggttttatatattttttcctattgattctatatatataacacatataatagattatatatataacatatattatatatataacatatataatatataacatatataatctattatatatgttatatataataaattatatgttatatattatataatatatatgttacatattatatattatatatgttacataatatatattatatatattgctggaaaggcaattctaagtgcatatatacacacacacacacacacacacgtctatatatacacacacacacacacacacacacatatacacagagagagagagagagatttattataaggaactggctcatttacatgattatcgaagctgagtagtcccaagatctgcagtcagcaagctggagatccaggagagccaatgatatagttccagtccaagtctgaagacctgagaaccaggagagctggtggtgttgattccagcccaaaagctggcagttggagttctaaggtcggaaaagaccaatgtttcacttcaagtagtcaggcagaagtagttccatcttactcagcctttttgttctgtttaggtcttcaatcaatcagatgaggcccacccacattaggagggcaatctgctttactcagcctactgattcaaatgttaatctcatctgaaaatactctcacatacacacagagaataatgtatgaccaaatatctggcctagtcaagttgacacataaaattaaccatcacaaagacctcaattccttgctggctgttagcaggaggcctcagatctttgcaaggtaggactcttcctagggctgcttgagtgtcctcatggcaggttggctggctttccccaaaacatgtgatctaaaaaagaaaaccaaatagaagtctcaatatgttttgcgaccaagttttggaaatcacacacagtcactaccatattctcatgttagaaacaagtcactaggctgagcacatggctcacgcctgtaatcccagcacttagggaggctgaagtgggtggatcacctgatgtcaggagttcgagaccagcctggccaacatgatgaaaccccatctctactaaaaatataaaaattagccaggtgtgctggtgtgcacctgtggtcccagctactcaggaggctgagacaggagaattgcttgaacctgggaggaggaggttgcagtgagccaagaccgcacccctgtactccagcctgggtaacagagtgagattccattaaaaaaaaaaaaagagagagagagagagagagaaagaaataagtcattaaatctaacccactctcaaagaggggggagttaagttttgcttcttgaagaaaggaatatcaaagaatttgtggatatattttaaaaccacatctcgggagcttaaaaaaatacttatactggctaccacccctagcctttttgacttggtatgtgatgagtaaaagctccctaggtgattctaatgggtagccaagtgtttcctctatcatatgcatccactcttgtgtctcttataactctaagaccttagcaagcaagcacacagccctgtgatgggcaatttgtcagccttaatgttataccatatcatgcaagcgggtgtgaaaacttcctatgataaaaaactcagtatcattaaagaactttataaaattcaaaatgcttttctttcctgttttgtttttgttttttttttgtttttgtttttgttttttttgagacagagactcactctgttgctcaggctggaatgcggtggcgtgatcttggtggcgcaatcttggctcactgcaagctccgcctcccaggttcacgccattctcttgcctcagcctcccaagtagctgggactacaggcacctgccaccacacctggctaattttttgtatttttagtagagacggggtttcaccgtgttagccaggatgatctcgatctcctgacatcgtgatccacccgcctcggcctcccaaagtgctgggattacaggcgtgagccaccgtgcccagccttcaaaatgcttttcttaacacaaagaaataagcaatatgttttacagagaggtatgatacccaaaaggagagtatttaatacactgcattttcaaaatcatatgtagtctaaaacaaagatataaaataaaacaaatacaagagacttctggctaagtatgaagtcaaaaacttataaataaaagcataaatcatgaatattttgagcctataaaggatcagatgcttgataattcatgacagaacgtgatcaagtctgactttgggagtgtgacggttagggttttcttgtcaacttggctaggctatagtaaccagttatttaatcaaacaccaatttagatactgatgtaaaggtattttgtagatatgattaagagaatagaaaattccaggcagcagtttcacatgacaaaaaggaaactggtgaaattgctgcataagctaagggccaataagatcctaaaaaacaggatgtggaccatgctggctggactgactggaccgaatatggcactagaaatgacctaggtttcacccagaacctcattatatgctcattaacatactaaaccacatacctgccagcaccatgactgttccaggaacattcatatttggtgcaaaaatgagtggcaccacagttctgagaaatcttaatgtttttccagaaatgttcatgattattccaccccgtggttaaagaaacccataaagatagaaaccccaaacactgttggtgcaactcactctcttgagtactcacactcccctttcttgagtgtgtacttttgctttgcaaaaaatctccacactttcactattttctgacttatctttaaattccttctcgcaaagttgtcaagggcccagacactggccagggttgaagtcctaccagtgtttggggacctcctctagcccaccagtatcattaagatatacagatatacaggtatagatacagatctgtatgtattctattagttctgtttcgctggcaaaccctgactgatacagatcttggtattgggaagtgaggtgctgctgtaacaaatatctaaaaatgtggaagtggctttggaattgagtaatgagtagaagctgaaagaattttgaagagcttgatagaaaaagcctagattgccttgaagagatggttgatggtaatatagacgttaaaggtgacagggttcagagggaagtgaggagcacagtagagaaagcttctatcaaatcagaatacatgtatcatcatgaacagaatactagtagaaatataaatgttaaaggtacttctgataagacctcagacagaaaatgttgttggacactgaaagaaaggtgatctttattataaagtggcagagaatgtggctgaattgtattctagtgttttttgggaaatagaatttgtaagtaatgaacttggatatctaactgaggagatttccaagcaaagtatggtaagtgttgtctagtttctccttgctgcttatagcaagactctagaagaaagagataaattgaggagagaattgttatgtaaaaaggaaccagaacttgatgatctggaaaatcctcagtctattcagataacagcaaaatgtgagagagtatgctctggaaagaacatcaacggtgtgactagacaaccatttggtaaagagattatggatccaatcaaccatctcagcagcagccacggatattgatagaggtatacaggaaggatctatgaagaacactcatgtctaatggctcagaaccctgtgactttcatggaaggccgacaaactgttgaaaattttagaccagtagaaacactgttaaactgagagggacagacaggagaatgccatgtgaatacagcaacacacagaatgtcatgtgaagacagaggcagagattggaatgatgcatctacaagctaaggaaagccaaaaattgccagcaaccgccacaagttaggaagacacaagaaaaaatcctctagagctttcagagagagagagagagaatggctttaccagtaccatgactttagacttctagcttccagaaaggcgagagactaaatttctattgttttaaaccacgcagtttgtggtactttgttacagcaaccctaggaaactaatacaggaggtatcaaaaacacatattgactagctgaagtttcctcttgtacggaacccacatgtattctgtacctgcttggggaacagcagataaacattttaataaacattagactacattaattaaataatttaattgcatgatttcatttaaaacatggcttaagatattttgaaagttatagtacttgtcattttggtctgtttgcatcttccttgatctccaatttcctcatttcccctctggcatgattgcaaaaatacaatatttttgtatgtgaaatccaatgaaataagcaacagtgttcttttgacaaacaccactgctcattagtaagtaatctgaattctgcttgggctttgtttacatgctgagctgataattgtcagtcattttgatatgcacagtgaacgaccatagcagtagaaattaccgaagcagaagcagaagcagaagcagaagcaccacattgattagattgaccgtgggcgtggctgctggaagcattctcaaatggtggtgccatggcatgggcttccaaatccctgtgacctaagtagctgggacctaacggtcatcaatggttccagtctctgagttcatgttctgttaatcaggcaaattttttcagctcttggaagagtcaggatttggctacattgcactcttctttcaggtctttaaaatgcaaggaattctattcatcagctgatactgatctcaccaaccattaatcacttcctcccacaaacagttgtttcttgttagggcctctggggatgtggcccatcttcagccacatacaaccaagcacctgagtgaaaggaaggccgcttagacaacaggattcctcaaactacaggtcattacccattggtgagttgtgaaatcatttgatgggttataaacagatttttcttaaaaaacaaaatagaataggatagattaaatggaatagaaaatatcagaatgtgtgtcatgtagtaaagtgtttcataaacttttttccatttattgattttaccgtgtgtgcatgtgtgtgtgtgtactgggtcatgacaaaatcctatatccttctggggatcgtgtttttcaaagtttgaaaaacatagctctagggcatgatcattagctcaaaattcccttcagtttaaaaatgaccactggccccttatacagttcatgtagccacccttctatttattcttattaacaccatgtcctcaggccatgaggactgaggactgccagaaacaatgaatttcaaagactctagtcccgagaaaacataaacaaatgggcaaaatggacaataagaagcgctctgtgacttagtctcctttaagagccttatgatttccttgaaaccttgggactgtggtcacatgatttatcttcctccctttgctgtagcaagtttagatactaaagatacatgaatcatggctccttatggtgctccctgatggattgtgaagataaacattacagataatatcattcgaggcaatgttttaagtggtgttgagggtggggttaaggaaaacaaggtaggctgctaccaaggataagatgttcttaaaagacaactaggagtttgccagtcagacaagggggaggaagggcacttcaggtagagaaaaaaatatatatgcagggtacatgaaatgaatgccaactccataaaacttggtgtattataggatggcatggcatcatatgatgcagctgaaatgttgggtcacacagcagaatggtggaccatgggtaaagagggaaggcagagaccaaattacagagggaaagccttggaagctatattaaagagttcagacattattctgtagttatgggaaaccactgaggggtctaaacttctaataaagtaatcagatttgcaatatagaaagatcattttctaaggacagctgagtcaattgctgggagcaggggtggtaagctgactggaggcaggaaaattcaatgggacactattagtgccacagatcagatgagatatggtggggacctaaggaaagtgcagggaaagcagaggaaggaatgaaaataagagatttttagagatgaaaattttaaaaattgaaaattggtgaagaagccaaagtcttggataacccccgatgcttcttgattgagtggttggatgggtggtggacaggaatatgggaagagaaataacatatgaggacagatgagttcagtttggcccagattgaattaatgtgcctataggatgtccaggtgaattaggatgttggacacttggatctggcattccctttcttttgttttgtaagctgaagtgcaatcaaacaatccaagaaatgcacaggccttcagtcaataaattctttcctttaaagtcatcaggctatgatttctaccatgttcttttgaaatgaatttcagacagagaaagtgtcaatatgcatggaatacaagacattctgaaaaaattagagcacaaatgctggtatcttcagatcttaggtagtgctaaaacttgaacaaattcttgtcattccagtatatgacaatcaagtttcattatgagagccaagatgtttgcatgggtggagaagagttaaccagggtcctgatctcacaaatttgtctctaactccaagaaaccaaccagtttgtatacacaaaaagaactggttatgaacaatccaggctcaagttctcccaaagggaatgatttttattactagggacaaggtgtatagatcaaccagggatttcaagacctgtatgttgattagccacaggcatgtactgtgctggggcaaagcagagatgctacttggatttcagccataaacttggcatcagcaaatgctattgcagaataaggcttcagtttaatctattatcttaaaaaaactcaggaattcctttgccactcagtatttttaaatgatccccatgtgtttcttcaccaatgaagaaattacatttcgaaatgccttttgaagggaaattacctaataacagctccttgggtgtgtatgtctgtgtgtggaaggggagggagattaaggaggagaagaaactcctgccaacttttttctttctttctttctttttctggttgggggaggagcatcacgtagacatcagaaacgttaaaatgaggaaaattaccaacaaatttacaagaaaaaaacacacaaccccatcaaaaagtgggcaaaggatatgaacagacacttctcaaaagaagacatctatgcagccaacagacacatgaaaaaatgctcatcatcactggccaccagagaaatgcaaatcaaaaccacaatgagataccatctcacaccagttagaatggcaatcattaaaaagtcaggaaacaataggtgctggagaggatgtggagaaataggaacacttttacactgttggtgggactgtaaactagttcaaccattgtggaagacagtgtggcgattcctcaaggatctagaactagaaatactatttgacccagccatcccattactgggtatatacccaaaggactataaatcatgctgctataaagacacatgcacacatatgtttattgcggcactattcacaatagcaaagacttggaaccaagccaaatgtccaacaatgatagactggattaagaaaatgtggcacatatacaccatggaatactatgcagccataaaaaaggatgagttcatgtcctttgtagggacaaggaggaagctggaaaccatcattctcagcaaactatcgcaaggacagaaaaccaaacaccgcatgttctcactcataggtgggaattgaacaatgagaacacatggacacaggaaggggaacatcacacaccagggcctgttgtggggtgaggggagcggggagggatagcatttggagatatacctaatgttaaatgatgagttactgggtgcagcacaccaacatggcacatgtatacatatgtaactaacctgcacgttgtgcacatgtaccctaaaacttaaagtataataaaaaaataaaaataaaaataaaaaagttaaaaaaaatgaggaaaattaaagtgacagaagtgaaaacttagtacatcttctaccttcaaatgccatgcttgttttctacccatagcagatagacataataaagatataattctgctgatatggattatatttcatcctcttccaaatttattacctgaatcccttcgtagattcttaaagacctaacctgcctctgccaattttcacaggctgccttgtacaaatacagcaaattccataagctaaggcctgcttctcagctctaccacttaacagaactaagaaatcaaaggctgtagtttggcaaatgaactaaacttacgtttccctaatctacacctccagtcctgataccacccaagctccagtcctgatttttcagtggcttttggatatgtcccctgtacgtcactctgtcgcctcaaactccacatgcctcaattgtatttatcatctcctccttctcatgctactagacaccaccacttctccctgagcccaccattcctgacttctcctgatctccaaaaaagtgggtgcatgagtctcactcgcaggctacatgatcactcctaaacaccaatattttacctcttgattcatgtttgtgctttagtgatgtcatgaacctcaagaacattcaaaaccaagtgtgttaaagctgtgggtgccagtgtctgagggtccacagcttgctactcaatatatttaagatagtgtcacactggcacctcaaactaaccacaggaataactgaatccatgggcctctccacctccaccacaaactgttcctgattccttgctcccttatcatggagaacacaccatcacccccgctaaactgctcaagccagcttcattctctcgctgacttattggtccatctggctgccaacccccatcaatcccaccttctgaagaactctcaaacccattagggatgacccagctctgcctcagcacaggcattttgtatttccttctggactaaaagtcttataactattctcccagactccattctgcccctctgactgtggttagagtgatctttctagaatgcagttttgagcacgatgttctgcatcttccatctttcaacaacttccttctgcccacaagatacttaccaagatcatccattacatggcccgttctgactgctctaatcccattcactgcagctcaacaacattcctgtactcacaagctactcctgcccacaaggatgtctagtccttcttatccttctcgaatgccttgatactttatattgcttccccttgttctaaacattggtgagtaggagtcccatgtctaacaatgtgattgtgttacagaaaatgctaatctgaaaacacatgtttccaaagggtatatacccagagtagaatgagttaaagactgggttaggcaaattgtagtacatacaagtaagagtaaggagaattatgagtttcaaaggagggaagtgagaaaagtttgatagagagggagtgaggaccctgagaaaggagggaagaggataagtgagacaagtgtgaaaatgaaagagagcccagtactatgatgagatgctgtggcctgagaagagagacatgcattgagaatttctcagggatgaggatggccaaaagattctagagaactcgagtgcctttgattccattttacatggctcgtcttcactgttctgagttgtgagcctctctattactcctaaaccttctataaaaatctgttccaatggcactttgtgtttgtgcagagtagtgtccaagtcagaggtgatgcaggtgtaccaagagcagagctgttgtagggagaagacagtagccaccatcatctaaggggtgacagggaagcaggccacagtgtagactgaccacaggaaagtgagatgcacacagctaaacagacatgttagccagggtgttagattttctacaacctgagggattgtgtctcagggaagtttatttaacaacagaggaaaaggagactcaattcctgtaaggcttaaaaaattaggaatttccagttatagttatagcccatataagaaagtcacagaattgctatgaagtaaataaatacttctgaaaaagtgaatatacaatgataaatacacaaaatataaattaaaatggatatacttattgaaaagtattggtaaaatcatgtcagacttgagaaaagaattaacttcacaagatgactaatgattatttaaaaactggaatttattttccagatccttaatttacaaaaaaggtatattgtttccaatggctcagataaataatgacatggtttgattcaaactaggagaaagagagagagggaagtgtgtggaagaaaagggagaggtttattatcattgtcctagaattttcacaaactctaagctagaaattcaggaaactaaatcaaatttccattatatcttacataatagaatttatataataggcaggtaaaagtcatcaagcttgagatgtcacaattcaggacatattttaatgccaacagaaatcatttcagacataaagtgtatttccaaagcctaaaaaaaattctttcacacacagccccaacaactatatgtgagaacatttggtacttactgcagagtcaccagagttttatggaggctaacatttctcttggacttctatgctaaacagagtttaagaaagcagtgtgaaggaatatgtatgagagataatatatcatgattgctaaagcagaagctatatctctgaaatttgggagttcaaggattcctgaagagttgctaattaattttgatgtattacgataagttaggatatgctgcagttataaccccaaagttctcagtggtgcagcataaaaagattatttattactcatacaatgtcttcagtagatgtgggagactaggcaggactattactctccatgatgcttagattctatggcttttccatatcaacacacactcccatcatgagttgctttttaaacacattaatctgcaactcacactgtggttacatgactatactaactgtaacaaagcctgtacaaatgaagaaaacaaaataaaagatcaatgaatcaaaaagttggttttttgaaaagttaaataaaattgagaaacctttagccagtctaagaaaaaaaagagacaacatacaaataaataaaatccgaaatgaaaaaggatacattacaactgatagtacagaaattcaaaggatcattaatggctactatgagcaaccatatgccaaaaacaaaaagaagaaaatctggaaaaaatgaacaaattcctagacacatacaacctaccaagatggaaccaggaagaaatccaaaacttgaacagatcaataaagtaacaatatcaaagctgtaataaaaagtctcccagtaaagaaagcccaagacccagtggcttcactgctaagttctaccaaacatttaaaggagagctaatcaatcctactagaacttttccaaaaaagagaggaggagggaatacttccaaactctttctgcaaggccagtatcaccctgataccaaaaccagaaaaagacacatcaagaaagaaaactgcaggccaatattgttaataaatattgatgcaaaaatcctcaacaaaatactaacaaaccaaattcaacagtacattaaaaaaaatcattcgtgatgaccaagtgggatttatctctgggatgctaggatggttcagcatatgcagatcaatcaatgtgatacatcatatcaacagaatgaagaataaaaaccataggatcatttcaattgatgctaaaaaagcatttgataaaattcaacatcctgtcgtgataaaactccttaaaaaactgggtatagaaggaacacacctcaacataataaaagccatatttgacagacccacagctagtatcatactgaatggggaaaaactgaaagcctttcctctaagatgtgtaacatgacaaggatgtccactttcaccattctaattcaacatagtactggaaatcctggctagagcaatcagacaagataaagaaacaaagggcatctacattagaaaggaagaagtcaaattatccttgtttgctgatgatatgatcttacatttggaaatacctaaagactccaccagaaaactattagaagtgataaacaaattcagtaaagtagcaggatacaaaatcaacaaaaatcggtagcatttctatatgccaacagtgaacaatctgaaaaagaaataaagtaatcccatttacaatagctacaaataaaattaaatacctaggagttaaccaaagaaatgaaaactataaaacactgaagaaataaattgaagaggacaccaaaaaatggaaaaatattccatgttcatgggttggaagaattaatattgttaaagtatccatactacccatagcaatctatagattcaatgcaagccctatcaataccaacaacattcttcaaagaaatagaaaaaacaatatgagggagctagcagccaagatggccgaataggaacagctccggtctacagctcccagcgtgagcgacacagaagatgggtgatttctgcatttccatctgaggtacggggttcatctcactagggagtgccagacagtgggtgcaggacagtgggtgcagcgcactgtgtgcgagctgaagcagggcgaggcattgcctcactcgggcagcgcaaggggtcagggagttccctttccgagtcaaagaaaggggtgacagatggcacctggaaaatcgggtcactcccaccctaatactgtgcttttccaacgggcttaaaaaacggcgcaccaggagattatatcctgcacctgtctcggagggtcctacgcccacggagtctcgctgaatgctagcacagcagtctgagaccaaactgcaaggcggcaggcaggctggggaaggggcgcccgccattgcccaggcttgcttaggtaaacaaagcagctgggaagctcgaactgggtggagcccaccacagctcaaggaggcctgcctgcctctgcaggctccacctctgggggcagggcacagacaaacaaaaagacagcagtaacccctgcagacttaaatgtccctgtctgacagctttgaagagagcagtggttctcccagcacgcagctggagatctgagaacgggcagactgcctcctcaagtgggtcactgacccctgacccccaagcagcctaaatgggaggcaccccccagtaggggcagactgacacctcacacggccgggtacccctctgagacaaaaattccagagaaacgatcagacagcagcattcgtggttctgcagccaccgctgctgatacccaggcaaacagggtctggagtggacctctagcaaactccaacagacgtgcagctgagggtcctgtctgttagaaggaaaactaacaaacagaaagggcatccccaccaaaaacccatctgtacatcaccatcatcaaagaccaaaagtagataaaaccacaaagatggggaaaaaacagagcaggaaaactggaaactctaaaaagcagagcgcctctcctcctccaaaggaacgcagttcctcaccagcaacggaacaaagctggatggagaatgactttgacgagttgagagaagaaggcttcagacgatcaaactactctgagctacaggaggaaattcaaaccaaaggcaaagaagttaaaaactttgaaaaaaatttagacgaatgtatagctagaataaccaatacagagaagtgcttaaaggagctgatggagctgaaagccaaggctcgagaactacgcgaagaaagcagaagcctcaggacctgacacgatcaactggaagaaagggtatcagtgatggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgacagggagaatggaaccaagttggaaaacactctacaggatattatccaggagaacttccccaatctagcaaggcagaccaacattcagattcaggaaatacagagaacaccacaaagatactcctcaagaagagcaactccaagacacataattgtcagattcaccaaaattgaaatgaaggaaaaaatgttaagggcagccagagacaaaggttgggtcacccacaaagggaagcccatcagactaacagcggatctctcggcagaaactctacaagccagaagaaagtgggggccaatattcaacattcttaaagaaaagaattttcaacccagaatttcatatccagccaaagtaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatgcactaaatgctccaattaaaagacacagactggcaaactggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctcggataaaacagactttaaaccaacaaagatcaaaagagacaaagaaggccattacataatggtaaagggatcaattcaacaagaagagctgactatcctaaatatgtatacacccaatacaggagcacccagattcataaaggaagtcctgagtgacctacaaagagacttagactcccatataataatgggacactttaagacttcactgtcaacattagacagatcaacgagacagaaagttaacaaggatacccaggaattgaactcagctctgcaccaagcggacctaatagacatctacggaactctccaccccaaatcaacagaatatacattcttttcagcaccacaccttacctattccaaaattgaccacatagttggaagtaaagctctcctcagaaaatgtaaaagaacagaaattataacaaactgtctcttagaccacagtgcaatcaaactagaactcaggattaagaaactcattccaaaccgctcaactacatggaaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcaaaagtaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagactgctagcaagactaataaagaagaaaagagagaagaatcaaatagatgcaataaaaaatgataaaggggatatcaccactgatcccacagaaatacaaactaccatcagagaatactacaaacacctctacacaaataaactagaaaatctagaagaaatggataaattccttgacacatagaccctcccaagactaaaccaggaagaagttgagtctctgaatagaccaataacaggctctgaaattgtggcaataatcaatagcttaccaaccaaaaagagtccaggaccagaaggattcactgccgaattctaccagaggtacaaggaggaactggtaccattccttctgaaactattccaatcaacagaaaaagagggaatcctccctcactcattttatgaggccagcatcatcctgataccaaagccgggcagagatacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattgggtattgatgggatgtatctcaaaataataagagctatctatgacaaaccaacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctatttgcagatgacatgattgtatatctagaaaaccccatcgtctcagcccaaaatctccttaagctgataggcagcttcagcaaagtctcaggatacaaaatcaatgtacaaaaatcacaagcattcctatacactatacaccaataacagacaaacagaaagccaaatcatgagtgaactcccccattcacagttgctacaaagagaataaaacacttaggaatccaacttacaagggatgggaaggacctcttcaaggagagctacaaaccactactcaacgaaataaaagaggacacaaaaaaatggaagaacattccatgctcatggataggaagaatcaatatcctgaaaatggccatactgcccaaggtaatttatagattcaatgccatccccatcaagctaccaatgcctttcttcacagaattggaaaaaactactttaaagttcatatggaaccaaaaaagagcctgcattgccaagacaatcctaagccaaaagaacaaagctggaggcatcatgctacctgacttcaaactataccacaaggctacagtaaccaaaacagcatggtactggtaccaaaacagagatatagaccaatggaacagaacagaagcctcagaaataacatcacacatctacaaccatctgattttgacaaatctgacaaaaacaagaaatggggaaaagattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacacaggcatgggcaaggacttcatgactaaaacaccaaaagcaatgacaacaaaagccaaaattgacaaatgggatctaattaaactaaagagcttctgcacagcaaaagaaactaccatcagagtgaacaggcaacctacagaatgggagaaaatttctgcaatctactcatctaacaaagggctaatatccagaatctacaaagaaacaaatttacaagaaaaaatcaaacaaccccatcaaaaagtgggcaaaggatatgaacagacacttttcaaaagaagacatttatgcagccaacagacacatgaaaaaatgctcatcatcactggtcatcagagaaatgcaaatcaaaaccacaatgagataccatctcacaccagttagaatggcaatcattaaaaaatcaggaaacaaaggtgctggagaggatgtggagaaatatgaatgcttttacactgttggtgggaacgtaaactagttcaaccattgtggaagacagtgtggcgattcctcagggatctagaactagaaataccatttgacccagccatcccattactgggtatatacccaaaggattataaatcatgctactataaagacacatgcacacatatgattattgcggcactattcataatagcaaagacttggaaccaacccaaatgtccatcagtgatagactagattaagaaaatgtggcacatatatactatggaatactatgcagtcataaaagaggatgagttcatgtcctttgtaaggacatggatgaagctggaaaccatcattctcagcaaactatcacaaggacagaaaaccaaacactgcatgttctcactcatagatgggaattgaacaatgggaacagttggacacagggcagggaacaccacacaccagggcctgtcttggggtggggggcagggggagggatagcattaggagaaatacctaatgtaaatgacgagttactgggtgcagcaagccaacatggcacatgtatacatatgtaacaaacctgcacgttgtgcacatgtaccctagaacttaaagtataatttaaaaaaaagtgggggggaagaatcccaaataaaaaaagatgccataaaaggtaaaaaaaaaaagaaaagaaaagaaaagcttctacacagcaaaataactgaacagattgattagctgaatattgctaatcatcagataaatgcaaattaaaaccaccagccagaatggctattatttaaaaagtcacaaaataacagatgttggtgagaatgtgaagaaaagggaacacttatacactgttagtgggaaggtaaattagtacaacctctatggaaaacagtatggagatttctcaaacaactaaaaatagaagtacaattcgatccagcaaacccactactgagtgtctacccaaaggaaaagcaatcattttatcaaaaagatacccacagacatgtttatcacagcactgttcaccatagcaaagatatggaatcaacctgtctaagaacagatgactggataaagaaaatatggtacatatataccatggaatactactcagacataaaaaagaatgaaataatgtcttttgcagcaacatagatggaactggaggccattatcttaagtgaaataactcagaaacagaaagccaaatacttcaggttttcatttgtaagtgggagctaaataatgtgtacatatggacataaagtgtagaataacagacattggagactacaagaggtgggaggttgggaggtgagcgagggatgagaaattacttaatgtatacaatgtacactatttgggtgatggctatactaagagcccagacttcaccagtaggcaatatacccatgtatcaaaactgcatttgtatcctctaaatttatgtaaataaaaaagaattgaacaaataaaatgtacaaatataaaataaaacaaaataattttaaaaagaggatcagaaatcttggcaaatattagtaatgtctactacagatacaaagattatttttaaattttacttgtaggcaaagaaggaaaaataaaataaattgttatatagtaaaaataaaattaaaatgtttccaagtattttcaagtatcagaagttttttcccacctccctcccacttgtttcttgtttcagactcttgtgaccaaggaaaaaagaaataaaaaatagacttcaaacactttatttattttaatccaagccatgtcattaatgggggaatgagagctttatttaacctatcatagggtttctcaacctcgacattattgacattttgagctggatcattcttgggcactgtcctgtgcattgcaggatgtgttagcagcctttctggcctctacccaccagattccactccagttgtgaaaagcaaaagtgtcttcagacattatcaaatgctcctggcagagtgagaacattaattctgattgagaaccacttttctaagtttcctttgaccagtaaatcatctaaaaggatgaagatgatctaaaacatcaactggcccatatagaggtggagtagaccaaagatgaaagaaacaccttctcctagatctaccacttatttcccctgtgactttgggcaagtttctgaaccactctttaccttatctataaaaggagaataatgttacctagctcacaagcttattgtaagaattaaatgagacactacctactattttctctctgttttgggaaacatcctattatatgcccagttcctatatagacacagggagtctatttctgaactttccgttctcttctatttgtgtctctgcatatttctgtgagaattccccactgtttttattaaccattattattattagccctctattatccacaggtgacttgtctgagaaactcggccatttggaaagaggctggaaactgagaagtgaagaaaaaggcatgtagaagccctgcactaaaggtcagatacatttctcaccataaagccccccaaggttattaagatggtttataaattatttcctcctctgcccctacatcctcttgtgcctcgcatacaggtatagacacccaataaatgattgctgagaaacgaaatgaccaatttcagacataaggcaaacaagattatcattatcaggcttctccacatcaccaaagaagtcccaaattaggtaggatagggatagggaaggtgttaatacaatcagaactggtgtcaagatgtcagtagtaagaagtaacaggtctgacattaaaagagtaaattaaagggcagacattaatttaaaaataaaaactacatgctctggagagtaagcagccataaacaccacaataaccccctagctgcattacattgtcagcgcataataactgacattcctaataatgactctgacattttgaaaaaaatgctaatttctgttcagcatgttccatttaaaaaaaattcagggtagtgtataaggcatttgaaaaagatttccatcacagacttgtaaaatatgtgatttgcaatgcactttagggattacctaatctaattgttttctagatgaagaaagtcagttccggaaagatgaagtgcacttgcccaaggtcaggcaccagagagacagaaatggaataaaggccttagtttgccaactccacagcaactgctttttccactgctgcacatctgcacaaacataaatatatattttaaatttattacgagtaccaaatttaatatttggcaactcaacagggatagacttcaaatatttggaatttccctcactgagctattaataaaccggtcctcattgagcctttgtattgctcaaaaaaattagatctgatgggtgggtgtcaaaggagtgagaaagcataatgcttgactcaggtgaatttttagaagggagggtaagatttacatgtaagaagtcagagctatggaaagcagtagggagagtggtgccctgggaatggagggataggaaatggcaacccatgactgctcgtcaaagaaggtacggggtggggtggggcagatctcttgggctggacccagaagcatatctgagttggacccagaagcatatgtaggccttattaaaaaaaaaaaaaaaagagagagactctagatgtgaagaacattagaaaacactggcggggggttgggtggaagcctggatcatgttccaaaacattcattcaaacaaacaatttaataagcatgagttacttatgaagattgggggggatgttatagaaaatattaaaaattgaggcttccctggaaaatctaagttgaagggatgagagaataaggaaaatggtccaaactgctctagaagggcactatctggtagaaatataacgcatgccacacatataaagttttctaataaacccattaaaaaagcaaaaagcaacagttgacatttactttaatattttaactaattcagtatatccaaaatgctattatttcaatatgcaattgatattcaaaaattatggagacgttttacattattttactcgtacgaagtctttgaaatataatgtgcatgtcacacttaagcatatctcaatttgggtactaaattttcaacagaagcacttgatctgaacttagatatggtaaaatttgcaactgaaaaagtgaattcacatactcaagttgttccaaacacacttaaaagttttccaataattgcatcaaatatcaaaaaatcatcttccattaatattcaaatccacaccgacaaaactgcttcagttttttaaatttaaatgccaattaactaatagtaattcaaagttcagttccccagcccccctggacaaatttcaagagttgagtcatacaggtggctagtggttatgcattaggcagctcaggtctagaagatgggttctaggggtggagcagggttgtcccatgacataaggcccttggaacatagacccagaatgcacagaggtagactctgtatatgagctagtccacaaaacagagccactctatattatccaacacttggagagcatcaagataaaaatagatttctagagaggttaatatgcagcagaactgagaaaaaaaaacagggaagccaatgaacagtttattgtcataaataaaatgtgaagtaatgaggactcaaactggagctgagaaggagaaacgcaggggagccgaggatctgagaggcaattggatggaagaaccgacaagactgaagaagagataggatacagaaaaacagcccccagctaaagacctcagaggaacctggtttttgtttgattggttggttgggttttgtttttgtgtttgtttattctctattctcttttctacacatattttataggaaaaagtattataaccaaaggagtgaagtactgtgaagatctgtttcaaggaaaccactgcaaagagcaccccactcaatgtctgcctgaataggcaatctattacacagcaatgacaaagttctgccattttggatgtcaaaatatttctcagtttcattcatttgccttacgactaccctgatcaggccacatcttttacccggattgttgcagtagcatcctaacactgcctgcttagtattgctccaccccaacccattctccaaattgtagccggagtactctctccaaacacaaatcagatcatgtcacttccttgtttaaaacaagtcagaggcttcccattgtcccccaagtgaacccattaacatgattttgcaagaccttcatgatgcagcctttccttccttctccagccttacatttcaccatcccctgcctttctcaccactcaactaacctacccatccctcttccctagtcctatcctcctgattggttctctcttcctggaaaacactaatctctctctctttctctatctccatccctctgtctctgcctatgtctctcttctttctccttccccttctctctccaactctcacttcccagccttttcccttcttgttcctctgcctgaaataatctgttctttactggtatgcttcctacttccttatgttacagttgaaacccatgtcattgctttggtgataccccaagactgggttagagtcatgtcttatatactcccacaactactgaactttattgtattgtaatatccattgtattggtattataattgtccatgtcatttgttcttttttgttttccaactagaagataagctcattaaggacaaggactttgtaagagtttagctgataggagacacagaataaaaatgggttacataaataaatagaatgtaatacaatttaatatcaaaagtaactctgacttactaaatgcagagtagtggcaataaataattttgttagggcatcaatccaattagacctaaattttaccttcttaaagtttaaatctaaaaaagataactgagaaagatagatagcaatgatctcagctgtccagatctttataaaaaaaattgtatttttgttattaaaatgcattttattatagttatagatgttaacatgaggaaaagctggggggatggtatacaggaactctatgctatttttgcaactcattgaaagcaaatctaaaatgatcccaaatttaaaagctttttaaaatgattttggatgcattctctccttcttaggtatgtaatacccttcaaaaaaggaatttcatgaaaatgtgagggcaagagaatgaaaatctgaatgttttccaaaataaatattgatcatgggtctcagatatatattctgaatgcctaaaatattctcttcattgcattactagacatgttatgatgagtctggtctatacaacttttttttttgctataaagataaaagtaaatatagaaaattaagattgttttgccataaactgctttggttctcaaaaatgctttgattctcaaaattccataatgcctacaatggctaaaatactattcttagttaagaaactgccatatcaatttagttgaaacacactataattgtatcacagttcagtagtggattatgtgtcttaattacagaaaacccttaagagagagaaaaatcatatgaaaagtgaagccccatgctgagggtgtaagtcataaaagccagttaagcagggaaaagagtctatctaatttcatgttttaattatattttaaaatatttgttcagaaaatgccatcctctaacaattaaccctcagtcacacagctgacaaatagttaagacatatgacatgacatagaccctaacagagtaagacaaaacattcagtataatttatgacatatataacctagttatttaaacagatgattattctggttctcttttagtctgctacaaattcacaaggggcttttcttatcatctggggagtcctgttaagcccccagaactgaagccaataggcatcaagtgtgtattcattctaaagtcagctgctaacttagtgagaggttgccagactggttcagtaaccactacctaccctcaacttatttaggagagacccagagagacagaaaaatgaggagaggtgatttctcaaagtgagaaaaaatgagagcatcctggcattttgttttcttcctcatagggacattctctcctccttcaagccaggtcaaggggatagcaagaaaatcctttgaagagacgggagaaatccttgtcagaagggaagaagagcacctcactctgcagttggtgcttgctgagctgcacatattcacaggtttgccctgtctcaccagactagagtgcaagaggattctcaggaagacctgatagcaatcatagacctttaaggagcgccaagactagtgccagactgtcctttggagaggtctgagagctgccccctgagagctgggagagaaggaagcagtgcaagcaactgtacttcctgagattcaggggcataagggtgacaggtttctctgtaggccaaatagatgctgtgggaggtaggtagccaactctgcttgattgcctgatcctccactgatgccatgggggaaaatggaacagggctggggtagccttcacattatcactgtaagggattaaacacttgaatgttaatttcattttggcttgtggtcttaatcaactgccctcacaactggcagctcagctctctctagcttgcctgagctcctgacagaaactgaggccaatggaggttaaagaactggcctagtattcctaactagtaaatggtgcatcctagatttgaacactgcccattttctaaaaagtagtctttactttctaagaataatatacatgattagcgaagagtaattaaacccacaagattgagctctttcaagcagagttcacaaaatggtcaacttcagcagaagacttgttactcattgcaaataatacaaagggttccggtattaatttccaatctgacctctcctgaagccacgtatgtggttaagggaaataactttcttctggttctacaaaccctagaaaattcctattaactttatttctagatttgcttccctctaatggttctgaaaaatgttcgttgctctttttacctgaaaagaattctctcactattctgaaccatggtagttttttattttgaagatgggaatcacattatatttggtgttaactttatacctgatatattcagtagtttcagacatatagcctgaaaaatgattctactctgcagattaatatcgctatgctagtttgctttgggttaatgtttgcgtactatatttttgcctacccttttactttttttttttttttttttttgagacgagtttcgctcttgttgcccaggctggagtgcagtggcgcgatcttggctcactgcaacctcagccttccagtttcaagcgattctcctacctcagcctcccgagtagctgggattacaggcatgcaccaccacacccagctaattttttgtatttttaatagagatggggcttcaccatgctggccaggatggtctcaatcccttgacctcgtgatccgcccgccccggcctcccaaagtgctgggattgcaggcgtgagccactgtgcccagctacccttttactttttacctttctgtatcttactctttaaaatatgtctcttgaatgcagcacagacacatgaagaaatgcacaaataaaaccaacaaattgtttcttttacctggaatgttcagtcccttttcatttaatgtaattactgatatagttgaacttacagcgaccatcttactgtttgttttctatttggcctatctagttccttatttcctctttacttgccttcttttcaactaattatattttttctactttttccttacattgatgttttgttaataattatttgttaaggtaaatttactaaaacaaaatgcacagatttttaagatatagtttgataatttttgacaaatgtacacatttgggtaaccaccaccccaatcaagatatagaacatttctatcattccagaaagtttccatgaccccttctagttaacacctcccccagtcatacatttgttctagaacttcatataaatggatgtcatgctggacccctacacactccaataaggagagcaccaggtttgagaggccaaagaagagacccagagctagcaaatgagccatagggttttttgaggcaaacttacatacagggtggtccagtggcagcagactggacaggagaactgccactgcctacagaaagcatgcagtttatatagtgttttcacttaacaccctccccctaacaacccttgcccgaaaaccttcatttaatccaaaataaagggtttcaatcccttgtgcacccactttccacaggacaggggctggaggctcagatgttcctcatagataagaaatgaatctttgggttggccacactgggacctccaaacacacatttgggtttatctgccatacagagccattcttggggtacgcttaacttattgctgtcaggtgcatctatcatacacaagtatgtctaccatacaatggaaacataaagtatttactcttttacggttttttttacacattatgtttatgagattaatccatgtctttgttctatttctaactagtattccatggtaggaatataaattccacaacctatttattctgctattaaaggacatttaggttgtttccttcagaggctattacatataaaactatcacaaacattagtgtacaggtgtttctgtggacaaatattttcatttattttaagcaactacttaggagtgctaagtcacagaggtttctattaacttttggtgtttgacttacagatcacaaaacacatatttggcttatcacgtcataatacctattattttttcattttcctgatacttctagaacgtagtaacttaaaatctatttgctgtcctaaattctttttgagtgttgttatgcattttagttccgcaaataaagtcaagacatggcaattattgtcttgtacagaaattatttatatttacatactacatgtattttcatatgttgttcattacctcctgcatttccatgttctgtccaaatatttcttgtagaggaggactgctggaaaggaattcccttggtctttgtctgaaaatgtctttatcgtttccttatttttgaagcaaatttttgctaggcatagaattctaggctattttttataagcagttttaaagatattaataccactgcatttgggatttgtttctgacaagacatcagctgtcagttacattgttgcttctttgaaggcaatcttctccaaccactttaagatcttctcaatgactttgcctttgtttatctgattttccatgaagtgcgtgtgctttcttcttttttttcctacttggggttttgtgaacttgagtctctgggttgatgtcgttcatcagttttaaacaaattatcggttattaccttttcaaataatgctttagccttattctctttctccttttcctctggggcttcaattgtgtgtatgtctcacatgtctattatatgctagtctttttcccactttgttttccctctctgtgtttctgtttaagtattttatattgatctatatctcagtttactaattctggattctgctatgtgccctctccagctaaactcattcattgtttttaatttcagatattgcattttttagttccaaactttctgattcttatttaaacattccgatggttttcaattttccatcctttcatcttttgtcctctctattttgaacatatcatttaacatattataattatctgctaacattaatatctgtcatatctgtggatctgcatttttctcttgattttcattgtctttcatctttacatatctagatattattatattgtgtgccaggcactgtatatagaagaaccatagatgttccagataattttatcttccaccagagaggatttcccttttactccattaggcaataagagtgagtggttaatcaactcaatccaatcagaatttgtgcttaatcagaaatatcctgcaagtttagtaagattcaagctatctctggtatgttcatcttcctaaatcctgaaggctatacattgccttagccctggaagttaacagagacagttctgtccttcaaaagttttcagcttagctctttagcctcctacttcattcagtttcaaaacttggcaaatgtcttgaaagggaaaccagccatgtgttttaagtagagctcctccctggcagcactgtacaatttaaagaaatttcaatctgccttttagaagttttggggctagctctcccatttcttgtgtaaccacagaactatgaaaatattccaagatgaaaactgtttgtgcatttaagcctcctccatattttaatctgtcatgacagcaccatacagctgctaaaaggttgctgacttctgtccccaagcagaagccctttccttggactaagcctgtttcacagcctgtccctagagaaacaaagagtgtaccgttattaagttactttggaataattctcccttttctgtaattttagctcatctagaccttatttccacagctctccattgcctttaagatgatttctgtaatgtatccagttttgtctagtgggagagtatgcctgtagcaacctattttatttcactcttaagtgaaagtcattttttcaatgtaattttaatctgcatttcacttgagtgaagttgcacatgttaagagttcacttgcatttctttttctgttaactatttttaagtttccttgccgctttttctattgactcttttcattttcaagacattttctctgtattatcgagattagttctctgagacaggagtcacaaataatgtttttccagtgtgtatcttgtcttttaacttatgttgttgttttttaattgaagatgttttggctttttgtatgtgactgaatttcatggcttctgacttttgtgacatagattgatgagtcttccctactctaagttagtaagaaaattatcccttgctttcatctaatatttttgtttcttttttttacatttgaaattttgttctatttcaaattgatcatgctgataggcacatcccttcctttctccccagatggctacttagatttcctaagatcatcttttcctcactaaagtggaatgtcatcattatcatatgctaaattctcatgtgtatctgatcctatttctgaactttctattctattgtagcaggtgtctatttgcacactagaaacaaacttttattgatattatatattttaatatccagcacagtggatctctattccccacatgcttttctttttcagagttttcatagcttttctggcttgcaaatttttccacagaattttagaatcagcttgatttgtgccttagacagcttattggtatttttatcaggagtgagttaaatctgtaaactaacatagagagaattgacagtgacgtttagttttcctatccaaggatatgatatatattactattttaaagccattttttgaaatcttttagtattatttaaatggcttttttcattcagatcttacacatttcttgtgattagtacattttagttgttaatgtaattatatttgctttcttatatagtctcattttgaagacaacagattggaatgaacttttcaatacctgaaaatgagattgctcttcagtacctaaaagtaccaaagaagccacagtgatgaaccagaattactatctgagggtaaagaacgaaggctgctctcattgaggtcagcccatttaatacaaattgttttcacaaagtgggatagatttattgaaggatttcaaactattcttccaaaatcctctatataattaatccaaaataaaaacctgtgagtactccttgactactcctgctccttccactgaccatctcatggtttttaactaatgatgagcaccaaaatcacacttgtagctttaaaaaatacatatagctaggccttactcttgatgattctagttcagatataaagcaagtctaggaatacctccaagacattttgggttcagttctaaaccaccaaaacaaaacaaatatttcaataaagtgagccacatatttttttggtttcccagtacatatgaaagttatgtttaatgtttaaattatactttagtctactaagtgtataacagcattatgtctaaaaaccataatatatataatacattaatttaaaaatactttattcctaaaaaaggctaaccatcacctgggccttcagcgagttgtaattttttttgctagtcgaggatctttccgtgatgttgatggctgttgactgatcagggtggtggttgctgaatgttgaggtggctgtggcaatttcttaaaataagacaacaatgaagtttgccatgttgaatggctcttgctttcaggaaagatttctctgtagcatgtaatgccatttcattgcattttacccacagtagaacttctttcaaaattggagtcaatcctctcaacccctgctgctgctttatcaactaagtttatgtactaagtcctttgctgtcatttccataatgtttacagcaccttcaccaagagtagattccatctcaagaaactacttgctttgcttatccataagaaacaacccctcatccattcaaggttgatcatgagattgcagcaattcagtcacatcttcaggcttcacttctagtgctagttcttttgctatttccaccacatctgcagttacttcctccaccaagtcttcaatcccttaaagtcatccatgagggctggagtcaacttttcccaaactcctgttaaagtttatttttgttgttgttgttgttgagacagtctctgtcacccagactggaagtgcagtggagcaatcacagctcactgcagccctgtcctcccaggctcaagagatcctcccacctcagcctctcgagtagctgggaccacagatgtgcaccatcttacctgcctatttttatattttgtagatacagggtctccctatgttgcccaggctggtctcaaactcctggaaccaaggtattcctcctgccctggcctcccaaagtgttgggattacaggtgtgagctaccatacccagctgaatgttgacattttgacctcctcccatgaatcacaaatgttcttaatggcatctagaatgttgaattctttccagataattttcaatttacccagatgcatcagaggaatcattatctatggcagctatagccttacaagatgtatttgggtgtccaggaacattgtcaatgagcagtaatattttgccagaaatctttttgttctgagcagtagatctcaacagtgggcttaaaatattcaataaaccatgttgtaagaagatgtgctgtcacccaggcttgtggattcatttacagagcacaggaagaatagatttaacataattcttaacagtcctaggattttcagaatggtaaataagcattgtctttaagtcatcagctacattactccctaccaagagagtcagcctgtcctttgaagttttgaagccaggcattgacttctctctagctatgaacatcctagataacatcttcttcctgtagaagactgttttattaaaaatctgatgtttagtatggctacctttatttgtgaccttagatcttccagataacttgctgcagcttctatatcagtacttgctgcttcacctcacacttttgtgttatagagacggtttctttccttaaacatcatgaaccaaccttttctatcttccagcttttcttccaattccctcacctctctcagctctcacagaattgaagagagttagagagtgctctggttaggctttggcttaagggaatactgtaatagaagaatgttgatctatccaaatcactcaagcattctccataccaaagataaggacgtcttgctttcttagtatgttcactgaagtagcacttttaatttcaagaacgtttcccttgcattcatgggttggctaactgttgcaagaagcctagcttttagcttatcttggcttccaactgccttcctcactaagcttaatcatttccagcttctgatttcaagtgagagacatgcaactcttcctttcacctgaatactcaagaggccactgtaggcctcacttcaatattgatgtgtatcggggaataggaatgtctgatgagagggagagaaacagggtaacggccggtaggtagagtagtcagaacacacatgttgatcaattaagtttgccatcttatatgggtgtggtttgtggcaccccagaacaattacaatagtagtgtcaaagatcactgatcacagatcaccataacagacgtactaataatgaacaagtttgaaatattgcaggaattaccaaaatatgacacagagacacaacatgagcaccttatgtcagaaaaatggtgctggtagacttgtctgatgcagggttgtggagctttcaatttgtaaaaaatgtaatatatgtgaagcacaaaaaaacaaggtatgccagttatatacatgtctttgtgtacatgtacatacacacatatttagctccagtgattctggttccccaccctttaagaaccattaataaaagaaaaactaagtccaactgacaatatatcctaaatatctctgcaatacacttcatccttacctttgcaaatttaaatcaatacttcatcacctcacatctagaccactctagcaataccctcattccagaatctactttgcctcttactgtcctgcctccaaacagctgacatggtcacctatgtaaaaaagctgaccatgccacgtgccgacataaattccttcaagattccccatgtgcggtgcctaaatatttatccgctgatggatgcccatccatacctttccactagtgtgttgcacaatgagactgagaaaaataaagacaatgtgatttttccatgaaaccaaatgtattcactttaaattatctgtattctatgattacacatttagtatcactatattctttgttttatgaaatcatggtggcaggggtaacattttttaatgtcctgacctggcaaaacaaaaaggttgtgaactttatgttagtctccacagtgtttaaaatgacacttgccaatgtgatcaaaaattctgggaaccactgactgcagaatgaagtacaagctccttaatggaccctcatctctgacacaaagactagccccttactttcttaaaactgtaatacatttcattcattcatgttttcttgaaaaaattacactaatattagtttaccacccactatgtgcaaagcattatgttagatgggatacaaagatgatcaagacagaaaatgggctccgcctaaaaggaagttagagtactaggggttttaccttttggagtcaacaagccatgatttcaaattggtgttaactatatgacctgtctataattattattagctattaaattatacctgtgaacactgcaaagaaatgaatcaagagctgagaggtgagaaatgaatgggtataaaactaggtgaatgggaaagtaggattgaagagaaagcagtataagcaatggaaactgcctgtccagagtttgaggtaggaggcaaatcgctggtgcttgaactgaaaggatgtcagagactacagcccacagagatggggaacggaatcttagctagactcatgaggtaggctagatgacaccataccttgcttgccacatagggaatttgatcttcattctaaaagtaatgggaagtcattgaatgaacactgaaacagtggaaagatgatgaatagtttttcagcagtggatgatcagacttgtgctttgacaagacaactgtggcagcagtctgtagaacaaaaccggaaggaagcaagagtaaaaacaaggagacaagttgggaagctgctgaaatagtccaggttagaaataatggtagcatgaaatagggagtagcaacgaagatgaggaaaactcaaaaaaaattaaaagatatttaggagaacagactgaccactaacaatcatgtttacagtcccctggaaacatcatggtgtttcattttttgttgcctttagaatgacctaccctccttcttccaacatacacttgattttctaatttctaaaagtaatgaatgttgtactagtttcctagggctactgtaataaaataccaaaaactgggtggcttaaaacaacagaaatttattgttcctcagttctggaggctaaaagtctgaaatcaaggtgttggcagagccaggctccctctgaaacctttcttacctcttcctaccttctggtgatttgcaggcaatatttggcttgcagctacataactccagcccctgccttgtcatgagcattttccctgtgtctctgtattaacgtggccatcttcttaaaaggacaccgtgagtcactggaatgcagcccaccctactccagtatgacctcatctcaaccacatctgcaacaaccctatttctaaacaaggccacattctgaagtaccaggagttagaacctcagcatatctttttggggggacataattcaacccataaataaatgcctacacaaaaaactgtagtagtagcaaacagtaaaatgtgaagtctccctctctatcttcacgcctaagccaattaatacagggtattcaactggccatagatattagttcaggattgaatgtgtgaatgaatgtggggcagtaagacatgagggaagattttcctttggaaaagaaggttcctcactcttccataaagctctcttctggatggagtggtgtgcagatgtgtatcttggaagtgtttcagcccttccataacatgtggggggccaactttaggaggaagctgacaatctccttaatatcctgctaagctgctgaatcaaactgactcaagcttgaatgctttccactggttacaacaaccattatatgtctttcatgtgtaaatttgttttgagttgggttttcttttagtgtaagtcttaatgaataaaggatattaggcattgtacaatcatcatcttcccattgcttctgcgttcagagtaatttctcatttaggaattaaagaaaacatatccttccttccacaatgattatttacataaggcatgaacaataacctaaatggtaaaatgtaaaaaaagaaaaagattaagttcatgtatcttttcattttcctttcatcaccaaagatgctggaacacagatgatgcagggaaatacttttgtacaaaatttctatcaatgaaagcacaacaccagcaaagatggattaccttgtatttatccattgaaagaacacatcggatggtgaggactttttggaatgacaacaaagctctatttgaatacttgaattttccccaaaacaaaagccctgactttgaagagggttacttattaccttgagtctcaaagtgtggcccatgaaccagcagaatctgcatcgactgagagcttgttagaaatgcagtctcaggcaccaccctagacttacggaatcacaaagtagagttcaacaagatctccaggtgatagtatgtatgttaaagtttgagaagcactagcttactacattgttaagacaatgatgctactaaaaatgaaaaatctgtgaagccctgcgccctgaaatggtcaagctgattgtacagcagtggctcttaaccctggctgtacattagaatcacctggggaggctgggtgtggggggggttcacacctgcaatctcagctaaaatcccaactttgggaggccaaagtgggcgcatcgcctgagcccaggagttccagaccagcctgggcagcatggtgaaacctcgtctcttaaaaaaaaataaaaataaaaaccactatttatatatgtacacacaaaaattagctgggtgtggtggtgggcacatgtggttccagctactcaggggtgctgaggtgggaggatcacttgtgcctgggaggtagaggctgcagtgagctgagattgtgccagtgcactccagcctgggaaacagagtgagaccctgtctcaaacaaaaacaaaaacgacaacaaaaaaatcacctggggagcttttaaactgatgccaaggctcaaggcaaaacccccctaaaccacatggatcaagatctttctttgaggtggggcataagatcagaaaaacattttaagaagcccttgggtgattttttttttaattaaaatactgagttttatttcacatgtatatttctgtctccccaccatttccatgtctgaccaccgctactactatgtcatatcataacattccatacatacttaaaacaagaaagggtggagttccatctttaaaaactaaacagacatgttggacaacacattcttcacaatggaacctggacaacatttatcaaacacggaagggaaagttctcactctgcattataaaaaggacagccagatatcaactgttatggaaatgaaataagatggaaaatttttaataaattgtttaaactattttcttaaagagacttcctccactgccagagatcttgaatagcctcctggtcagtcacccagaagcaattcttcacataactgatgaacttggcttccctttgggaagagaaccacctttttctatgcttgcttgcatttttgctttaacgtcttctacagaactaggtccctttggtgttttaggagttttttcctgttttttgaaggattcttgtcctttttatcttggtgttgatgatggttttgagtcttttccattctgatttgacttgtgtgcatttttggctgtagtatcttgtatagatttcttcactggtgctttttcttcagtttcctcatcatcaaaatcatcatcatcatcatcatcttcatcagcaacaagttttacctttttctgtggaaacttgctaccacttccagggaccaactgctttccagatatacttaagagtttcacattctcctcctcttcatcttctgactctgcatcttcctccacagctactaagtgctgtccactaatatgcactggccctgaatcacacttcaactgtaagagcgctggtggtgttatttcaaagcccccaagggaaagctttggctgtacagacattttcaaagttgccagtgttaactttaattggactgcctttgtaattcattgcctcttcttcaacaatgtgcagttcatcctttgcaccagtccctaaacagaccgttcttaaagataactggtctcattttcatcattatccaccttaaagtgatcatctttattggcctttagttcacaaccgaaaagttagttctggggcctcagggggctcatgtccatgtccatcgaatcttccatcaggtggctacatgcacttaggtgggagagaaggtggacagagataaacgaccccagctcaagagaagagccgcgcaggacagaatcacacctgggcgggtgattcttatatacaactgtggctgagaattattagtgtagagcagcagttctcaaacttgagtgtgtatcagaataacctagagggcttgttaagatacagattaccatgcccaactctcaatttctgatttagcaggtttcgggtagggcccaagaattagcatttctaataaattctcagatgttactgatgctgttcctccaggaccacactttgagaaccactgatgtagagaaaaaaaagtgactgaactggaaactcaaaaggctgcccagggtctctcaaaggcaaaataattcattacctcacacccgttaggatggccactatcaaaagaacagaaaataacaagtgttaggaaggatgcagagaaattggaatccttgtacactgttggtgggaatgtaaaatagtgcagttattattaaaaatagtacagaggtttctcaaaaaattgaaaataaaattaccatatgatctagcaatctcacttctgtgtatatatccaaaagaactgaaaataggatctcaaacaattatttgcacacccacgtttattgcagtattattcacaacagccaagaagtggaagcaacctagatgtctaacagatggacagataaacaaaatgtgatatatgtatacaatggaatactatgcagctttaaacagaaggaaatagtgtcacaagctatgacacgaatgaacctcaaggacattatgctaagtaaaataagccaggtacaaaaatataaatactctatgattccactcacatgaagtatctaaagtagtcaaaatcatagaaagtagaaaggtggttgccaagagctggtggaagagagagaggaaattaacgctcaatgggtatagagtttcagttttgcaagatgaaaaagttctagagatctgctatacaacaacatgaatatatttaacactattgaactatatgcttaaaaattgttaggatgataaatgtaatgttttttcaactacaacaaataaatagggcaaaataattgaggtaatcgatttttaaaagctatttgctttaatgtacatgcatatgttatttaaatttttacaacaaatcttatttctaaaaagctttaaagataattattttacagttccgcaataaaataaaccaatttttcaaccaagaaatacttcaaaatcatgatttaaatattttagacccctttttgctattcaaagtgctttggtttgaacttttttctctgtgtagacatttttctctgagattctctctgaatgatgaggtaaaacaccattatattaaaataccactttaatcttacaaccgcccccaacatgaaatccttagcttttgtcagaaccccaaagagtcctcttatccaaaattaagaactgctctcagaggatatccctactgggtatagtgccctataagggtgttcccatggaacttcagtaaaactttgtattaattacctcaatgtcacctacaactctctgccactgtctcttccattaagactgcaagctttctgaaaaccaacaagagtcttaaatttatctggcacctagatgtgcatgagaatgtgttcaatgaaacctctatagacacatgattgaataaaagatctctatattcccttctactttgtacactattgataatttgcaagaggtgaaatgttttctataggcatatcatttggaatgattagatcaggcaaaaggtacaaatagaaaacagaattctacctccttttcttctcaagtgctgtagtactcatagcgaataaagatgtaagttttcctggctagacaccttgcacctttccctggaatcccaagccctcaactgcagcgatcaccagccactgacaaacacttcagagattctcagggcctagacatgtttcaaagagaaactacataaagggctatttagagaactgacactttcattttaaaagtccctaaaacatgaaccagcaatggtaatgcaataattctggagactggtggttctaacaaagaaaactgagaggaaatagggaacaggcacacaggtatttagacataattggagggaagtagtcaagagataaaactcagctggggccatcaaccaactctaataacttgctcattacaggatttaggatgatgtggcccacattctccctgacaattcaattatattaacagatttatacttttatagaattgtgtattatgtgcaacttttccttttcaacaataaatgcattttggtaatataaaactgtcaagacatgatagtgttttattacaaactgactttatacacagaatagcatagtggtgaaagagcaaaggttctgtagctggactggatgattagaatcctggctctgttccttaccccttaccagctatgtgactttggatatattatttaacctgtctcagtctcagtttctttatcgataaacagagttagttaatagtatacatcttataacatcattgcctaatataactttctgtgattttggaaatgttctctgcagtgatcaaatggtagccactagccttatgtgactgaacagcttaaatgtgactaggatcaactaaggaactgaatgtataaccttattctattttaattgatttaaacataaatagtcctatatgactcatagctactatcctgggaagcacagttttatagggttgtaaggatcacatgggctacacattcagatcagtgtctggcacacaataatcaataaatattcactatttatattatccaccatgccatagaaaattggtatgcaagtgtgggctataattttaacacttttcctaaatcttgtggataattctttttcctactatttatatttactggctaattccccttccagctggcactggcttcaggaaacacctgactagcctacacaccaagccctatccaccattcctgggcataacacatgtgctgcatgttgagtttttcttaagattttgcagactattaagaacacatttggtcctggtctccttcagattctaccaccaccatcacccctgacccccatcacacccccaatgtttttactacttttaccagaatctttcaagtattaaagcatattgatttcctattgggataatttgtaagatgatttgattattgtacttgacataaccaaattgagtcattctaaatcttaaaacatctcatcaggcttacaaaaaaacctactaaaattatcatcaccttgttttttaatgaggttagaatgaagttagaaagtttgtcttttgattcctagtatatactaaaaggcaaccactcatgttttagtacatatgttatcattggaaaggttataagctctaattaataataacgtgcatctctttttatatagcaatactattgtatttcctaaacagtcccatgacattaaatcagttgtttctagcagaaagattcctagaacaatataaattgataaagatttccttctcttcctactggagaggatatagctgagaatatgagaatggctgtcaggagaaatgagaactgaggctgggcacagtggctcatgcctgtaatcccagcactttgggaggaggtcgaggagggcggatcacctgaggtcaggagttcaagatgagcctggccaacatggtgaaaccccatctctactaaaaatacaaaacttaggcggccatagtgacatgcacctgtagtcccggctacttgggaagctaaggcaggagaatcacttgaacccagaaagcggaggctgcagagctgagatcacgccactgcactctagcctgggcaagagaataagaccctgtctcaaaaacaaaaacaacaacaacaacaacaaaaaaaacggaaagaaagaaagaaatgagaactgaaagtctgaattcagatatctaagaaacacactagacagatatggcccttacatttataattttatattctaaaatatgaaatattgagaaacaagttaaataatctgacatatccctctacccaatgaggatggcataataaatcaactggcctcatgtaataccagagagaagctaaggaataaagaaaagaagataaaaaaataattaaagcatctattttcaggtatatactactatcaagtgtataataaattgaattataaactcaaaaaggaaaaaaagcaagccactgcccagaaataaaaggggcatatgggggtggtgagtggatggttctttactactcttttaaaggtaaaagcatcctgttttgtaataaactgtttctatcctgggattccccttgctttattctctggcattctttttcccatttttaacagttagaaacaattttaactacaagtaatggaaaccttgagttctgttacaagggattttttttttttttgagacagagtctcactctgtcacccaggctggagtgcagtgcagtggcgcgatctcggctcactgcaaccgccgcctccagggttcaagcgattctcctgccttagcctcccaagtagctgggactacaggcatgtgccaccacacctggctaatttttaatttttagtacagacaaggtttcaccatgttggccaggctggtctcgaactcctgacctcaggtgatcggcccacctcagcctcccccagagtgctgggattacaggcgtgagccactgctcccggccaaggaattttttttttagtaattggcagtccaggaaaagggtgagatttagatttgattctgaggtacaacaataaaaaatttgcattccactgtgtcaatttcattctaaggcttgattgccttgtgattataaggtaactctcaactttttaaataagggccacctacttccagcctgacagtcttttcctcaccaaagaaccaagcccttcccctcagtctgattagacccaatttaggtcttgtgtccaccccagaccaataacagctgccagggaaaggtcttgcactaactggcttagattagtcaggattaacctctggaactagggatgagattcacctccccaatcacatgaactatgggaaaggaagttccctggacaaaacgagagtttcagtaagaaaaaaagtgaaatagatgtggaaaaggtaatcaatagactgcacttctttctcactcctgactgacctgctatctagtgttaaatattttgactgattactaatagcatgctttactgaccatagcactgcttgtacatttagtggtaagtggctgctgctgtggggaaatgaataatttaagttaaggatgctacagaaactttctagctgaacctaaggccattatgagccagagttatgcacacaggtacggttgtccagcatagttgctcacaggtgtagcaaagcaaaaaatctgaatagtcaaagcatggtaggtgtctaatttactgcccttactaaagttcaggacctgaatagtgtgacaccctactgaataaaaaggcaaggcaggatcattgaaataaggccctagaaagtgaccagaccattagcattgcaaagatattcatcatagtaggatcttacaggacagggctattttgttgaggcagtaaagcaatgcaagtaaccaatatagaaagtccaaaaatggaaaacaacaaacccttgaagaattaagaatagtgtttatgtatcagtattctttccattgcaccacactgtctttagcagaagcctaaaattcttcagatggcttacacatgaaagatctttcactcccaaattcttagaatggaaagtaacatctttgtaatttagaagacaaggaagaaaatggaatcctctcaatttctgatattgtccaagttttaggcaaaaaggaaaaagaaagaaaggaaaaagaaagcaaagttttacacaggtttctagccaagagagttgaagtttttgtttctactggggagagcaggtagagatgtatgttaataacaccttttcctttctaacactagaaacaattgagtagtcaattctacatggtataaagagatgctctgaggacaataggagagtcacttgtgtactattagaattcttgaagggtctacagtttttgaaataatttgcaacaagagtacaggatcaaggtgttttcatgcatctccttagctacattccaaaacaaaattcattttcaatttggcagagtggatttgggaggactgtgtttttgaggggagtctcagagtcgtgaccagggcagtggtcaataacatatgcttgtagatgcaaagacacaactgaatcatgaaagtggcaagagtgtcatttcttcaacttcggcttttctagtttgtagtaagttaaaaaaaatactggagtacaaaattcacttgtaagttatttggcatatctgtatcttttggttgcattggtaatttaaaaataagcaatatgctatttttagtatcttaacttccctacacataaactattacaattaaatcctgtttagttttttttttcctaagcaactctactaaaatgactgtttagttttttcaccatctctactttacaatttacttcctgtattttatatttggttgttctttcagaacatgtcatgggcagtttcaacagatagcacatgacacatattctttccagatttctacgattaatcctgaatttattccatttccatatgcagaaagtctgaaatattttccattgacatttcatagggatagagctgtagagttctatctcaatttgcaatggattactaggaaaggaggtcccttattatatggaccatcataaaaaccaagacaagaaactaataacctatattctctaaaaaccatgtgcatcacaagatcattaggtataagcatttctaaggcatgagagaattagcacttcacagccacaagcacgagatgccacattctataatcatctttatttctctcaactgagatggaaacctgcatctcacttaaggattttagagcaaaaaggatcaggaatatttattttggcccatatccttttgcgtctttttctttctcctgacgttctcttattaatccagcattcttatttttcaaagaaaagactagcttgaatttttatccctttgaaatgtatctcactggaccccttataaatcacttcttaactgaagtgaattttcatttatttttaaatttctcagtccctaaggagtgccatattctttatgttactttagttagaattttaaattttaattttgcctagagttggaatttcagatagcttaaaagcgttttcattttttttctttaaacagtggcctgtaaggtatacttagccttttgaaagagagatgcttttctgaaaaatgccttacaattttcacattcttatagacttacataatttcagggcagctttgtaacaacattcaaattgacaagggtttcaaaacctttcattttaatggtctcgcccagacaatctgccatttaaatttctgtaggagaaatactgatatttacagaaacttgtggatcctgacaaccttgcttaatttatctatttgaagttgatttttacatgctaggttttactaagcagaaagcaagaaaaaaatgaagtttttaaaagatttagaccaaaatactattatgccatttcggtcttcacttaagtaactctaagacgggatttctcaacctctgcattactgacattttgggctggataattctttgttgtagggggctgtcttgtgcatagtaggatgtttagcagcatctctggtctcctctatccactagatgcccatagcacccctgcctcaccccttcctgaccccacaacttctgacaaccaaaaaaaaatatctccagacatagccaaatgccccttggggtagaggagagggagataaaatggccctagttgagaaccactgctgtttattttgtgcatcatcaaaactaaagtttctactacagtaagcctcggtgtttatttttacaaaggaggcatatagcaagtagaaccaaaatcttatatggtggtgaaaacatattttaaaatatgatcaaattgaaattataattataaattactcagtttctgtgcagcaaagtctgatttcaactgaacctcagctactttcaaagttatttctctgtaaagggcaccactcacttttaggttcgtttgcaacattttcttcttttctctctgaagttcttttctgtagggatggatattttcccttctgtctgataaagcagccgcgacgacactactctttcctttgctcacttcacacctctgcataaaattgctttcatgtttagctatggcagaagaaagagaactaagggtgactagttccttctccaaagtaaatgccatattatcaattaggaaattctcacttcctgattttagatttttgaggaaacagtttatagggagaattctgatgagattatgaaggcactggaacataactgtttgattcctaaaataaaaaaacaaacaaaatattacaaaaattaggacagcacaaagcagtcatgtacaatatactgcagtaatcaattaatattcatttataaacaccataatgataaacagaaccaattatgtacgtgagcattgataaaattcagactacagcaatcaaatatacatattccatatcgaatcagttaatattaatcagattgtttccaattaaaattttttttgctgagtaataaggtcaatataatatttttttaaattttactgtggaggagaggtaacgggaaatctcaaaataattactaggcactaaaaaaagccaaaaacaaatataaaattaaaacagagatcttcagtttctaaatgaagccgatgcgttcattcatgctaggccatggctctgtattattgccatggcaataatacaaaacacatgcggatcgctgttgaaccacacattgatcacactcatacacactcacttctctggaccaattacaatttaatatgcattacctggaatagattattaaaatcccttcgaatggtgttctctgtttccaagtgaagagtgtcccatagaaacttcccggtctttcacaaaagtacacttctggaaattctttgattatttcacatttcatatgttctaagagccacaccttcattgaattcagggcatagccgggtgatgtgatttgaaaacaagatttatggaatgctgcaagaagtgcaaaaagatcttccatgtgctctacaaaaaaagtcacaagctctatcattaaactctgcccattatcagataaacagaattcttaaaattttctaattcaattaaatatataatctaaaagtgccaacaaaattacctataggtttcttctttggaaatgtcagtaggtacttcccagttgaaagatcttctagacttaaaaaaactctgccacacacaacataacgatctttaggacagttaccactttctctctccataatttgtagcagtacagtgcaacaaaatttactgaatgttaaaagtggtgaaagagatgttacagcagtaattatctgtacacactctttcttagatgggtgttcacaaacaaagctttcctctttcttgctatcaggggtcaacgtgaccctttttgcttccaatcctatttcacatggcatcaagtatggtgctgggaaaggatttgtactcaacttaatcaccctattttgacactttagaagccgaaatctggagtcatgggcttgatccattaacaatgataaagtcacatcattcagggacctgtaaaaaacccagactttggtttaatctaaaagctcattctttaaaatcaaattgatgattaaatgtcatacaaacaacagtaaaaaatgtttattctttcctttcctagaaaacatcatttcaaatgtaaaatatatcaaaaagttaagagtaaaagccaaacacatttttaaaggtcctgtgatagcacttctcaaaaggcaagcaaaaacactgtaactatgctaggttttaggaaagtaaaatttttaagatagaggaatggtattaggaatgatagtaagagaaattaaagtaagacaaaaatttttttaagataaaggaatggcaaaataatgccaggattttatctttcaggttggtcttttttttctcctctttttaaacaagaaaaaacctcctcattattttttaagagtttattttggtgatacgttagaatgcaaacagctctaaactaaaaattgtatttttcgttcctctaaacgacttgaataaaatctttttcagtcagaatattgttcatccctcagcaattctttccatatctacatttataataatttacaaatatatacaggcttactgtagcacattccagcattgtcaaagtttatcaagtaaaacaggtaagaatggtgacatgaccaaagaaagaacttgaatgtagaaatttaatactgaaaactcctttaatacaggaatttgaccatatgtctaatgagttacactaaagatttaaaaagaactcaaaaatcttaatttgcactaattgaactattgttttgttgggaatgctgttttatgaacactacatatatactgtagagtaattatgtagtaggtgcaacagagaattgggattatcaatagcggagacagaagatacagaaagaagatacatcatgatgttaagtaaaaaccttgaagtttttacatcatggtgataagtaaaaacctgaagtccttaatctgaattggacgtatcagcatggacttaccaaaaccacaacagaccaaactaacaaaacacatatttcctacctctgcttactaaaaaggcccagaaacaacaacccactgaggataaataagcacctcttgcactcaaattctgatttctaaattacaaactatacttgagggtctaactaaataattgatgagaagaggtttctctttatagaagtattccagctaataaataaagaagcagtaatagaattagaataccaccatgttataaaatctaatgaaacaatggaactaagtaatgagcatcaatagctgctaatatcacaaaatgaaactgatcacactttacatacctcccagtggaagaaaacaatactattaagtattctgttaacaaaaattcaggcattattctgacccagtctctagatctaaccatcaatttagaggaaatacaggagacagagaaacatgttaagcaatatcacaggaagtaatcagcaaaatccagtctatagaacttcacagggtaaactgcctggcttctataaaatatactttgcatgaaaaaaaaaaaagacagaaaaaggatacctacagattacaaaggacttagagataacagtcaagtccaatttacagtccttatctggctcacgatttgaaaaaatatttttaaattcagaaatgggaaatttgaccatttactgggggaattactgataattttgggggggtaattatataagttcttattttttagatacatacactggaattgttacagatgaaataatataatgcctttgagtgcttcaaaataatctgggggatgggggtgaggagtgcatggaggtatagatgaaacaagattagcaatgagttgataattactggagcagagtgacgggcagaagagttcaccacactattctccttgtatgtttcaaatgttctatatataaaaacatttttaagtaattctatttagcatatgaaaaaaagaaaagacagaaaatagagaataaaaaattaccaggcagatctaaaaaagaaagaataaaatttatgataatacaaataataataaaacttagaaactcaatgactggattaaatagctgactagaaagaactgaagataaaattagtgaaaagaatatagatcagaagaaattatccaggtgaatagaaaatatgaaagagatgttgagacatagagtatggaatgagaagatctaacagaggactaactgaagttccagaaggagacagatactagagaaagtaaggaagcatcagtatcttgagaattaagaactaagaattgtttgaattgccagaagaaaacaaaacagtttgaggaagctcaacaatctaaaggaggaaaaaaaaaaaaagaaatctgcacttaatcatgtcattgtcaaatatttagaaaaagaataacagaatacatccaaataaagtaaaaggaaataataagggatcagaaatgaacagggaatacacaattgaagatcaacaaaaaatttaattatttgaaaagatctaataaaatggatgaaactctggcaagatcaaggaaaaagaagacacaaataagatttggaataaaaagacactgacaaacactaacaacacagtgataaatatctaaagaggatcttaggaacaacttatgctaataaatgtaataattaatagaaaaatataagcaaaatgtattcaagaataaataaaaatgtgaataatcctgtaactattaaagaaattgaatcagtagttaaaagtcacctcacaaagaaatgccagatttctactgcattccaggcgactacaaccaaatatcaaagagtaggtaattgtagggagaccccctgaaactattgctatggaataaaagatgaaatgctcctgattattgtaaatacaaaattgcatgcaggattgcataaagacaatgccaggttggactgccagaacgagccaacagcgcgtgatgtgcttccccctccagagagcctatgaatggacgtgcagtcagggaggtttcacatcaccaagattcctatcccagaaaagcagatgttcatagctctgggaatggaatgcgacccttgtagagagcctataaatggacgcacagggggcgcctgtccatatggataagatagggctataaacaccctcatcttgccacggctcttctaggcctctttagggttaaggcatactcccttctgagaatttctggtctaaccggttgtctagcttcacgtcctgtttccatggattgttagtaaccagcttttgttgcaattgttactgctgattaatatcttgctaatcataggttatcgaaagattgtgtttctgttttaaggctctgttagaaattactgacacacacactatattgtaaattcttatctctgtatactgtacttctacatacaaaaatgtactgtacttctacatacaaatgttatgttaaagaattacttcatccccacgtgaccatctcacctcataatcaaacgaccctaaatccctcactaacctacccccgccctcactaaccttaataataaatgctggtatatccagtgcattgttggcagtgtgggaccagaaagcagtgacccccccggacccagctttcactatcttgtgtgtgtgtgttatttctcaacctgccgatctgcctaggaacaaagagagagccccgttgcattgcgggctgctggccagatcccgcaataggtaattccaaatttacacaaactgctccagagaacaggaaaaaaggaaatattcctcaattcatttataaactagtatagccttgatactaaaatcaggcaagtatcattcaagaaaatttcaagccaatttcactcatgaatttagatgcaaatattcttgaccaaaggatagcaaaccaaatccagtgacaaactgtttatcacaagaatgcaagactgattttataagacaaaattgattaatatagagtaccacattaaagaagagagaagaaaaacccagatgatcaaccagcccaaaacagcttagaaattcactgaaacaaaacaataaatccatatctcaaacccactagataagtagtctggctcccttactgtgttaagctgctcaaatatactgccatcacctattacaaggcactacctggtttctctgcgtacccgtggttcaaattcaatgtagttactgtaatgcctgtatttagcctgttttggctaaaaagctctttgttagactgcagatatagatggcatgcacaatacttctctatccatgatttcaacatcccaaaagagaatatcgtctgttatcagagggagagatactttgttatttaacgaaatttttacctattcactttggtcaatagtctctaagtatccctaatacctctaaatattttgattagaaagttctgtatgctgtttgattatcttcaccgtgagactatagcatcttaatttcataaacctcatcctcttcatattattaactcaatgcatttgtgtaaaagagatacttctagagctgtgctggccaagagagtagctattagatacatgtggctattaagcactagaaatgtggctagttggaattgtgatgtgttatacatgtaaaatacacaccaaatttttaaaactttgtatgaaaaaataaatgcaaaatatcttattaataatttttatactaattacatgttaaaataatgttttggatatattgggttaaataaaacatatcattaaaatggccaggcatggtggctcatgcctgtagtcccagcattttgggaggccaaggtgggtggatcacttgaggtcaggagtttgagaccaacctggccaacacggcaaaactccgtgtctactaaaaatacaaaaactagccgggcatgatggtgcgtgcctgtaatcccagctactggggatgctgaggcataagaattgcttgatcccaggaggtggaggttgcagtgagccgagatcatcccactgcactccatcctgggcaacagagtgagactctgtctcaaaaaaaacagtaataataatttcccttgcttctatttacatttttaaatatggcctctagaacatttaaaattgcacgtggcttacattaatttctattggacagtactgttctggagcatcaagacagtgttatcatgttggaatttacttacagcttcaaagaagatgtagttttcactccaacaaccaagctatcatctattacacgataccatatcttctctactagctgttctgaatcttgaaaattgtctgataacttttcatctaagatatggacagaattttcttcttcaccacaaagaggaacaagacattccttctaaaaaaaaaagtttaaataactgattataaaatacgtaccgtctgtagcaaaactaaaaaaaaaaaaaagttaagtgtgcttttggctagggcttatggcccaaacatttaaaaacaaataacatatcatattatagattatacacaatttactaaaatgaaatgtataaaatatataaaattccctatctattcagatcaagaggcatggcatgactggggtatggcaagatggggtatccaacaaagagccaaaagggaggtaaacctggagtccattttgaaaaaaaaaagtctgataatatgtaccccagttatactgaaaataatccagtctgtattttatcagtgacttgcactaagcctataactgtaaacttttgtatgaataaaactgattaaactatctttagactacttatagcttattgctaaaattttattcttaaagtccaagccatattcatttccacacacatgtggatatataacattcgaaagagtagtaataagaataatagtaacgataataataatatacaacatctattgagtgtttactttatgccaggcactgttccaaatgccatttgtgtatcaattcatttaacccacacaataaccctagtgccctaggtctgtggtattatcatctacattttacagattagaaaaatgaggtacagggaagttatgtaacttgcccagggtcacacagttagcaagtagcaaggctgggatttgaactgaagccaactcgttccagagcccatgctcttccttaactattaccctatactgcctctccatgtggtaattactaaagatagaggcattcactcaataggagactaaatatgttcccaggaatctgacactactgccagtagctgcgagttctgaagcaggctattcatctgaaacctggggaaatttttactacctgccgccaggtttgcttttaaaactaacaatgtaaagagccaaaaatggggccttgcacatagtggtttcaatatattaatttctaaacaacccttcccctttctaaaattggcaaaatcattgaggtgaggaaaggaaatggtgaaacaattttaacaatgactttcatgaggtttcccaggaaattagaacagtaatatagaaatgcaacacaatgtttttttgttacgttttattacattaacaagatcatattttggacccaaacccttacatggctaagactgaaatacaaacacaaagcatagcccatgacaagaatggtcaatccagaaggaagtcagagctaggcactacagtgacttgagggaataaaatgcaacattagttcagctcttactgatttactatagtgttgctgtgctgtgcctttctctgtatgaaattaatgtgcataaatattatttttatgaagtttcagcagtttttgctaacttcctacattaatgtactgacataagttaccacataagagacccaaggaggttctttttttttttttttgagacggagtttcgctcttgtcacccaggctggagtgcaatggcgcgatctcagctcactgcaacctccgcctcccaggttcaagttattctcctacctcaacctcccaagtagctgggattacaggcacgagccaccatgcccagctaatttttgtatttttagtagagacagggtctcaccatgttggccaggactgtctcaatctcttgacctcgtgatccgcccgtctcggcctcccaaagtgctgggattacaggcatgagccaccacgcccggccctgaggaggatcttatgatgatcagccacaaggaaaaagagagtaaaattatgaaaagcagatagaaggactaaaaaaacccatagcagtgtaggaacatttgctagaggaaaaaataaccttagaaacaaacaatccaacagactaaaagaacaatcattatcctaataataaaattatctcatcaccaatacaaagttaaataatactcagtatattctatttaagtcagtaaatacataattcacttatgagtaatttctatccaaacaatacaaataaaaaagtttaatggttaaatctgtaaacaaaaggacttgttccccaaggttcctgataactgaaattttaatatgctacagaattacctataaattgataaaatattggctccttaatcaaatatttttcaatgtcataaaagtccaccattataacctctgctacttttcttcttgatccactgagcagcattttctaatatattctaatattccaatttaaataacttttcaatagcttatagattttcaattcataaaatgataaaatggtcacatgattacttttacctcctctgcacttgacgtattatcatcttttccttgaactaggtttattaaagctttgtaagattttgaaataattttttccttaagcaacagatgctgccgtaattcccgaaaagaagaaaaacaaacctgtaaagtagaaagaaaaatagtggcaagaaacatgatttcaaatgaaaccagacataccaataattcaggaaatactttctccaaatgtgcttatcaattcatttttctatagaaaataaaatacttctcagagcaaaacagttttgtttatagattttaagtctctaagtttaaaaaatgtatcttctttcaaaagaaaatataaaaaataactgcaacatagagcttatgtatcaaattgagagagtggcaatatattagcatgtttcactagtgagttattaagtaacttcgaatcaatgtaaataaaaatcaaggcctacaaatacactcaccccacacaaaataactttttctttttgaaatagtttctgcttcaaaaacaaggcatccacataagcaaagacagcataatgaatagaaaatatcacttttaatcagatactgctcgaaattttctgttcatgtaaccttcatagcaaaatttttaaataaaattaaaattataacagcccccaaactatgtttatttttgtgctaataaactcagtgctagagtctactgaaaactactgaaaaaaataacaatttggctctgaactgggcatacagcaatccattccttttatgataccagataactagatttcagcactaaggataaaacattcacagaatatagtttgctactgaaaatttaaagagtcatgtcattgaactgatagaagttgtttcatttcaggtggatatctgaggctgtttaagtattcatctggcttttaataaaacatatttttctagatttatgcaacaaaatgcatcattatttgggattcttttcttttaaattacatttcaaagcaagtaaattctttttattttaatcaacaaatagaaactggagagtgaagactgaattattcctatatgttaccttattgcacaaagtatgtaaagtgtctagctaatattttaaaacttcttatgttgacctagttctgtgggatgcacatgattcacactccatcactcagtaattcgtgacagggggaggcagatgtacccatcaaaggtatgtagccacaactgagctactggaggggtggggagtagaagaaaaaactatgtgggcagattgaaatgcaccctcgaaaattgtcagtgttcactcttccttcctccttaacatgccccttactccaggacaatatagtgattgagtagagtagttaaataatcttggctgtgaagttttgctataaaactacaaaaataaattagacacatggtaagaaatttaaacaatgtgaaagtacacctcaccttctcttcctagatgcccaatcccgtttgcaaaaccaatagattgtgtaccttcccagaacttttccatgtgcatattaaggaatgctttttcctttgcacaaacaaaaacccacccaaaaccaaatacaggagcatatcgtactgcacgacactgaaccttgcttttttgttcattattgtgatctctatcatacgtgcagaagaatgcacagtacaaaataacattttacagactaataatgaagccgacacccatgtaattccactcaaatcaaaaagtagcattccaggagctgcccaggggccctccacaatcataattgccctttctcccctggagtcaatactaccctggccttttaagataatttccttgcctgtcttcaaattttacaacctttgtatgaattcttaaggagtattttaagttttttgtgtgttttgcttctgaaccttttataaatggaatcactctgcatgtatcaggctttagagttgcccatgttatcactagtagctgtagttcattccttccgttgctttacagtattccatcatatgactacccacgatttacttctccactctccaattgatgggtatttgggttatgctcagttgtgcagtgttataaacaatgctgctatgaacatctgtgtacatgtgtacaagattctctaaggtcctggtctccccatctccccttccagtaactgattagaatacaaatttcaggggagaaagaacagtgaaatggactctagttctagctctgcaagtcacgtaacctttctggctatttgttacgtcatgtgcaaaatggtgcaaaggtaggcttgttcatctctaaaaggccttccagcatttagaactttattacctacattgaaagctactgttaaaatatggatacttgaaacaaaatggatattcaactatctcttatccaccacctccattcctcccttccttcccttaatgttgtttaaagcctttcatattttccctgtctctgtgctacattttggataatttttctcatatattcggggtcactaatttgctctgtatctctttcatctctttaactcttaaagtcatctattgagttttttatttcagtgtgtttttgcttgaaagagatgctgtttggttattttctgtgaataattactcacgatgccttttttctttatgtgcttagttattctgtggacagctcattttctttgaaaaattacttgtgagatttatgagggctaggatgaatgtgtgtttccagacaggattttctgtttgtttctgtcagatgcctggggcaccaccaatttaagttcaatacacatgctcccagggcaaaagtagcatcagtgttctccttatctctctgggttccagccttgaaagtttgatttgataatttattcttagagtgtcagctttttgaagcttctaagaatgtttttaaaggagacttcatctatcattttcagttttaatcaggagagttggtcctgcttcataaattaagcctttcataaagtcatgctttcataaattaaagtactttggcatcatttctaaatcagtataaaaatatacactattctttttgacagctacatagtattccatagttcaggcacatcacaatttacttatcatactcctaatgatgtatgtttagatttggaccaatattgtagtttataaatactacataaacattcttgtaaaatcatcttcatccttagaagagatttctagaagtgaaactgcaagagtaaaaagacataagtaattcatattttagcaactataataacttttcctctgagaaggttgggtcactcactatacattcacaaaaatactatagaagaatgtacttttatattaagaaaattaatattttgtcaggtattacaatttcttttttcacaatttgtcttattacatttactttgttcagggtacaaaaattttgaatagatcaatgtcttcattcatggttctgtctgttatgatgtttatctattgttcaaattcatgtctaatatgtgttcaataagcatttattaaagtgaactcactctaataatgaaatagttgcaaaataattttaaaacaacctgcaaagtataaatatttaccacctggccctttccagaaaaagttttccaaccctaggcaaagaagaaaaagttcaataacacagcaagaaaagagacaaatccaaaagagaggatacaactagcgtggcctcctctttagcataatttttaaaagggggaagggggaattattctacataaaaagaccaataagagatataatcaaatgcgagtaaaaactttgatagattggatcctggaaaaaacagttataaaaacatttttgtgataactaaatatatttgaatatggacaagatagcaaataagattaagggatcattaacaattttctaactttgataatggtattatagttgcatgaggagaatatccttatttttaggagattcctgctgaaatacctatgagtgaaatataacatgtgcaacttttaaatggttctacaaaaatatatacacacatacacacacaaacacaaacacatgaggccaataagatttttaaaagtaacaagaattgaatgtattggggatacagagataatcactgtattcctggaatgtttctgtatatttgaaaatgctataaacaaaaaaggcagcttacaaaagaacatacatcttataatcacatttctatgtaatgcgtatattcatttaaaaatctgcaagaatatacagggcaaagtgttaaaattggttattgcaaaatagtggaatcacagacaatcattaggttttttttattttgttttgttttgacatttctttgcaaagcctcagtattttacagggaatgttcattaccttggtacatttgggaaaaaaaataaaaactcttttgtggagctttttatggaaaatatgagagtaaactgttcatgtctggaatgcattatgatttatcatattcgctgctactctaaaaagatactgtggtatactgatcccagaaagaatgtgttttcaaaagtgagctgcttctattttgtctcatgaggcttattaaatctatatagtcttactacaaaaaaggtatgtttagatgatacatttataagtagtatcataatatttgtacagaggtgccaaaaagataaagatcctttgaaataccatttttacccaagcaccaagttgcttatactttaaggacctttctttcaatgttctttccttcatttagaataacactaatcgaaaagcaaaagaagcaaacagacactaactttcagtcctgtttctagaggtggaaccaccaggtaacgattctcttgtttgtcttcaaataagtcatcttcattgcaatctgatggttcactctaataaataaataaataaataaatacactaagactgaaattttgcaacaattgaaaattcacaaaactaacaaaatacaattaaagtatatccagtcagaacagtttccctagtgtgtataaaatacacactattttataaaaggcaaactataggccagatgcagtggctcacgcctgtaatcccagcactttgggaggccaaggtgggcagatcacctgaggtcaggagttccagaccagcctgcccacaacatggtgaaaccctgtctctactaaaaatacaaaaaattagccaggcatagtggcgcgcacctgtaatcccagctacttgggaggctgaggcaggagaatcgtttgaacccagggggcggaggttgcagtgagctgacattgcaccactgcactccagcctgggcatgacagagcaagactctgtctccaaaaaaaaaaaaataaacaaaggcaaactatatattttccccatcatcttcttgtaactagaaaaaaattattatgattcctactactaccacctaacatttatatactgctttacaaagtatcagctggttagctttctttttaaagagtaaacatttttccatttatttatttaagagacagtgtcttgctctgacacccaggttgaagtgcaacataataatcatagctcactgcagccttgaattcctgggctctcattagctttttaaaaaatcctaaaatcccataactggagaaaattaaaattatgctaattttacaaatgaaaaaactgaggcttagagagattttgtattgatctgaaacttcaggggcataatttcccttatgtccaatatctcaagatattgtgagctgttacttcctttactaaagcaattttgcttcattttattccttatttaatccaatattatatttattggtataaaatgtgattttcagaagcaaaaataaagttaatttatagtactgctgtcacttaagtgaccaccaaatgtactacaattcaaatttatatcaaaagcatggtcaatttgtataacatttgttgaaaggagattcaatgtatatatttaaaagattcaatctatatatttttaaagttcaaaattttaagtataaaaccaccaatatttaaatgataggtcaaagcttttgagcacttaaattttctaaaatggttcttaaaataccatataataagtaaatagaacttaccgaatagtttatttttccaagatccgttattttaaatgaagtcaggcagtctgagttcaaggagtccttaaaaagtaggagtacttgttcagttccacttccaataaagtcatctatcagtactaagctaagtttttcccatttagcagcaacctaaaagaaagggagcattataggaggagtagacaagaaaaaatcgaatgtgaaataaataaattaagtccttttgtttcatgtagttgtcatttgtaaaactcaatcttataaatgagtaatgaaaatagtaaaaactaaaataaaataaagatattaggggatgaggaaatataagagttataaaaactttataaatagcaaggtacttagatttaatattttattcaggtttgtccagggactgtcacattcttgatttctatatcaaaattttattgtaatctatttataagttctaacacttttcatgactaacctttggaaattctaacatttatcatgagtcaaactctagtgaagattccttctctcgcacagctaatttaaggatgaccttcattcccattaagtcttagtgtatatgtatttatgatcagacaaattacccaaggaattcagttgcattctgttgcatacctgacagctgcagtactgtcaggtaaccagacagtactagtagacaccttaagagctcttaatggaaaataacctataatagagtcaagatgagcttaaaaccttaaaccctgatgtgggtgtggaggggaatacagctagtatcgggtacacaggtgaggggtcctaaaagtgggacagccagaaccatcctagcctcacggaatgatttggtcagtttatatcagaacctgagacctcaagtttaaaatagaggacaacttcttaatggtacatatagctgaaagcctcaagattggtcccagggtaaactaacaccatgaggatcaaatcccccttttccctgagacaaaaaatctaaaaccccttctcagaattccagcagcacagatacatcatctagatgatacaggaaggtagctcacattagagcaagaatgaaagtaaggctcttcaacccacatacccaaatatgaatcttcccctataaggctaattgccaaagttgattcttcacttgtgcagagagacagcttttctgtaaacccatatcctccctttctcccaccagtatcatggagtataatggactatgggaaaagacattagtaataagaatgtgtttggcaggcaaacagcacagaactatgtatgtatgcatgtgtacacacacatatttgcaatctatagctctagaatagtgccatccaatagaaaggtaagtgagccccaaatataaggcatataattttaaattttctggtagcagtaaaaagatgaaattttaatatatctaacacaatatatctaaaatattgtcattttaattcaatgtaatcattaaaaaattaagagatgttaccatttctattcatctttgaaatttgatggttgacatttacaacatgttttaattcagactagccacatttcaaaagttgaataactacatctggatagtagctaccatatcagacagcacagcaccagaatacattaacctctatcaacaacacaccaatagctatgcttcaggtatacttgacaatgacctcaattttattgacagatggattttttttttttgagacagggtcccattccgttgccctggctggagtgcagtggcacaattacagctcactacagccttgaactcctgggctctaacaatcttcccacctcggcctcccaagtagctgggactacaggcatatgccaccacgcccagctaattttttaattttttgtacagatgggggtctcactatgttgcccaggccggtctcaaactctaggtctcaagcaattctcctaccttggcctcccaaagcactgggattacaaacgtgggccactacacccggccaatgacctcaattttgaaatgcctgccacatagattcttgtcaaaacttgcagagacaattcctacccaagagagaaagcctaagaagaaaaaagttaatcatgtattcctttagattcagctctgtttcaagtcctattaccacattaaacatcatgcctcgggcttttatgaagtgttgatctgggaaaacactaaccttgttttcattatttactctaatttatgcttgtttgtattttacctatctttgtaagctggcttaattccttcttggaatgaggtaataaaagaatagatggatggatggatccatagccaacccaaaggaaaactgcttctattgctttctattttgggggaaaactgctatcaaagacccaccttattatttaataaggtattcaccttattactcaaaaccttttacaaaataccacaaacagtaaattcttctcagaacttaatgttagaaaaaaatcttttcccttgtagtatgttcccttcagttgtaaaacccatcatatttacttttttgccttaactgttaaaactaaaggtaattgttcaagtgtagttacttctcttaacctgagtttttggcataattatttctactcccactttatttctagattcttagctcttatttctgtttttttaaattaatttttttttttgcagacagatcttgctctgtcaaccagctggagtgcagcggggcgatctcagctcactgcaacctccacctcccaggttcaagccattctcatgcctcagcctcctgagtagctgggactacaggcatgcgccatgttggccaagctgctcttgaactcctggcttcaagtgatctgcctgcctcggcagtctgaaatgctgggattacaggcatgagccattgtgcccagccttatttctgtttttaaagtaactgaatattttaccctaaactaatatttcccttttttttttttaagaagttgagtataaatgtaacaccaagatagaagcaggacctgaatacgcccaaagtggcagggttagaggcaactttgaagcacttacttgtagatatcagggtgaattccagagcttttaaaacagggcatttgagagcaggttagaagtacagaattcctgaagcaccttagggggtaagtcagtagggacttaggtaagtaacgtgtggaaaagatagtggtccattgtagagagagtgcactagaatacaacttcgggtcagggaagcagcaattataggtccacctacagggaatgatgcagtctcctgccttgggtaacatgttagtggcaaagctttacagggtccaagcaggggacccacttcaagagagtgacgattgcaattaatgacacataaaggaattgttttttccttatctaggtgaataggggatcttgagtaagtgtaagtaactgatgacagccctggcttttgtctaacagtaatataacagagtaatagctactactaactgagttcctcctatgtgtcaagctctgtgcaagacactttacaatgtcatttgacttaattctcccctctcagagtcagaatgatcccaaatttcataaaggaggaaaatgagttcacaagaattacattccttaaggtaacactggtaagtggctcagttgggattcaaacccagggtacgtgtgttctttctattatattaccttgactacagtaaaacactatagggtataccagatgtttttcccctaccatttctttaaaggaaaagagaatggaaaaagacaattccaaataactttcaaataaatgtataatgcgcttttaaaagattgctttcaagataaaataggatagctttcaaattattttccttttgcattctctatgtattatagaggatacatacgtattacagaaattcaaaataatccctattaatataaaagtacttggtaaggcaaagcctgattcataattccaacttgacattcctccccccacacaaacaataatgattcacatttaaaaatgaatttcaaactttctaaaacatttaacaatattccacatagaggtgataatataatgataaaaattttcattgagcttctaattaaatggatagggcacacaaaataaggcaatatctgcttttctctcctaagtagcacaaaaactaaagttgtatagtgtactacttttggaagagacatttctaactagtaatgataatttgtcttaattcataaacacttcaaatcacataactgaatacattttcaaccaggaggatgcaacattacccaaaaatacagagtcagagaaatattattggtggagacacccagttacaaaactctaatttcctattggttttctgtgcctttttacctgttacttaacactcaataccagtgaatattttagaacaatttccaaacttaaaaaagtgaatacttgctcaaaggtcagttctgcatttcaaaatataacataataaaaatctctgagtaagtttttagaaaaagtaatgcttaccacttgtctatggagaacaattatttgtctctccagatttcaaggaatttctctatatttcactttcagaaatgaatcagagacaacaagtaaatttaaatagataattataaatgtttaaaaagttggccgggcatggtgactcacgcctgtaatcccagcactttgggaggccgaggcaggcggaccacttgaagccaggagtttgaaaccagcctggccaacatggtaaaaccccatctctactaaaaatataaaaattagccaggtgtggtagcacatgcctgtaatcccagctactcgggaggctgaggcaggagaaccgcttgaacctgggaggtagaggctgcagtgagccgagatcacgccactgcactccaacctggatgacaaagcgagactctgtctcaaaaaaaatataaaaaaataaaaataaaaagatgaaaaactgatttgaattttccaggaaggcttatctatctagtcaaatcactaataatcttattgtaagtgaaaatgcacatctactatcatattaataaaaattagaaagttataatagaaaaataaatacataattctagttacatatgtatttacacatttccaaacaactcaaaggctttatgactcaaaatggcaagacaaaaaaaacaccatcaggttgtactcagataaccttaagaaaaaagaacaatgtaatatttatcatttcatgtacagaactgaaaattgacttagacaataagactccagaatgaactctatgaactatacaaatgtttaaaaggtctgagaccaccaactgaattattattacaataagtgttgtacctgaaagctctctttccatacagcacaagcattattggatataaaggatacaacgaaaaagaggtttcctccacctgaatccataagttgaactgcacaaggatctccaaatggaagctggcacacatttttaggagttccattctgaaatgaaatcagctgattctttcgagtaagggcaatgagagatattcttaactggtttttgatgatctcagttgcacaaatatgtacataagtcaccacactgctgtaagcaggaggaataatgtatatatcacttaatacttcttgactttcaagagaatatacacaaaatttggtattccaaattgcataatctgattttgaaggctcttgagtacattcttcctcagataaacaacattcctttagtcccaataaaaccatacctaaattttcaatctcccctgcccactgaatagaggaaaagttacctgacacactaacaactttgccagtttgagaagagataaagaagaatgctttgacatgcctccataaaattaaagggccattaaggacccttaggccatccttcatctcatagcctagtttaaaactcaaacgcatttcaaatttattagtactgtgaaggattagtaaaaaatattcaaaaacattattctttttatttttttctatcacaatgtaagggaggttaattccagttctgaaatctgacacacagttgcaacacatgatttttaaatgagagttttcttcctttatggtaaaaaatccagtggacttctgaacaaatacttttgttcctctgtcaaataccattcttctgacatgtaatatgggtgtttttgtaggctctttatctgcaaaatttcctttagacaactggaaaacaaggacttccccattataacacaagagcctttcttgttcgttagatgacattgcttgtttgctagtcattccacaatatcaagtctttgtgctgatctaattttcaaatgcaaattgattccagttgatgtttctaaacctaaaaaagaaatgaggaaaaactgccatgaagtaggaagggttgaaaagaaaacacgtttctgttagagaactacaacataggtaactacacattttattaagtaaacattttaagctttttatactattttgacaatatcatacttataaaaaaaattctaaatattatttctgtagacgctttaaaaaagtttgctaagaattcaaataaccatatcaaaaaagataactgaatgtgtcaacggcatatatttaaagctttagatgctctattaaaagtgacttcagatatttgttctggctcagaaaattgcttaagggttatacttctctgtttcaaacctaacaactctaatgtggtttcccactctctgccttagcccctttagaatgacaattcaattaggggtttacttgtcttgcaactcactctccccaaatacgttgattttcaattatacttctcccacagcccaggcaattgggcttctgctttctagagacaggagcctatacaggctctaagacaaaaaagaaaccccaggaataaaaataggagatgctgtaacaaggctttaaaaaatctccataggattaataaaaataaatcttagtttacaaaggcaatgcatttgtatgcatttgtatgacccaacaaagtcactattcttattcaaattagaaaaaatagaggattaacataatttattacaatgaacacaagaattaaataatatcaatcattcaagcttattatatggcaggtacaatacatgcattatttaattctaataactattgtcttaaaataagtacccttattattctaccttttaagcaagaaagccttattttaaagaagataagaaaattttccaaggttacaacactaatccacagttaacagaaatcagcaatggtgctagtttggaaaaggggccttctgactctggagtctacacttttaactaccactctgccctggcatgcattcccttattctgaacaaactcattgtaagaaaggtaacttgagagaattagtaaaataaaggataaaagaatatcctcaatattgaacacatgtataaaaaaaagttgttgatatctctttattcagtcttctatgaactgcatacaagaaatcctagccaaagcaattaggcaagagaaagaaataaaagacatccaaattggaaaggagaatgcaaaactgtccttgtttgcagatgccataatcttatactgagaaaaccctaaagactccaccaaaaaactgttagaactaataaattcagtaaagtcacaggatacaaaatcaacatacaaaaatcagcagcatttctatttgctaaaaagcgaactatctgaaaaagaaatcaagaaaacaattccatttacaaaagctacaaaaaaaaataagataactagaaataaagttaaccaaaaaggtcaatgatctctacaatgaaaactataatatactgatgaaaaaaattaagatgacacaaactaatggaaagatcccatgctcatggattggtagaattaatactgttaaaatggccatactacccaaagcaatctatagacttagtgcaatgtctagcaaaatatcaatgacattcttcacagaaatagaaaaaacaatcctgaaattcatatgggaccacaaaagacccctaatagccaaagcaatactgagcaaaaagaatgaacctaaaagcatcatactacctgacttcaaaatatactataaagctacagtaactgaaacagcatggtaccgacataaaaacagacacatggacaaatggaacacaatggagaggccataaataaattcatgcaccaacaaccaactaatttttgacaaaggtgccaagaaccacacattggggaaaggacagtctgttcaataaatggtggtgctgggaaactggatatccatatgcagagaccagactcctacctctcaccatataaaaaatcaactcaaaatggattaaaggcttaaatgtaaacctgaaattattacactaccagaacaaaacataggggaaacattttatgacattgggctgggcaaggatttttttaaataagatctcaaaagcacagtcaacaaaagcaaaaagagacaaatgagattacatcaaattgaaaagcttttgcccagccaaaaaaaaaaaaaaagtaaagagacaacctacaaaatgtaagaaaacatttgcaaactatacatctgacaggggattaatatcagaatatataaagaacagcaatatcccaatattttaaatggacaaaataacttaatagacatatctcaaaagaagacacacaaatggtcaaaaggtacacacacaaaaaaaatgctcaatatcactaatcatcagggagacacaaatcaaaaccacaatgagataccacctaatttcagtttgaatggctattattaaaaagacaaaggataacaaaggttggcaagcacgtggagaaaaaggaacacttacacactgctggtaggaaggtaaattagtatagccactatggaaaacagtatggaagttcctcaaaaaactaaaaatagtactaccatatgatccagaatcccactactgggtctatatccaaaggaatgaaatcaatgtcaaagagatgtctgcacccccatgtttattcagcactatttacaatagccaaaatatggaatcaacccaagtgtccaacaatgaatcaatggattaaaaaatttggtgtatataccaatttttggtgcatagcgtggaatactattaatacagccacaaaattaaatgaaatcctgtcatttgtaacaacatgggtggacttggaagacatcatgttaagtgaaataagccaatcacaaaaagacaaataccgcatgatctcactaatagctggaatctaaaattttttttaaaagagttgctatcatagaagcagagagtagaatactggttatcagagactggggaaaggagagaggatgggaggatggggaggggttgctcaaagggtacaaagctacaattagataagaggaatatgttctagtgtcctattgcacagtagggtaaagatagttaacactaaagtgtaatttattacttattacaaaataactagatgtttttgaatgttcttaccaggaagaaaggatacattcatgagggaaggatacactaaatactctgacttgaccattatacaatatatgtatgtatcaaaacatcaaattgcactctctagatatatacaattacaatgtgtcaataaaaacaggtaaataagaaaaaaagaagtcattggcttactggtttgttgttaggcaattaacagaaagatctgggacaataggcatcacaaagtagtttcagcttcatcagtaaagaagatagggtaggtaaatcaaaggtctggcttgtacttatgaaactatggtttagagaaaataaacatattagttatattccatcaaaatgtatgaataataatgtatttaccaaaggtcccatgtcaggtttcctagatttctagaaaggaaaagcatgaaaattacacattctgaggtaaagctctaagaattcatcatcttttactacctattcaaagtttttcagatttcttaatatcaaaaacaaaaatcacctctgtatgaattttattattttaatgttaaatatcacaactaatgtttaatcagtacaatgctctggttcacttaccaataacttaagtgtgataggagtaaggaaaacctgattataaaatggtcagaatttatgaaagttaggctccttacattctgttctttaaatgtcatcatcaagttccctaagttagaaacatctatcttccaactctctgttccagttgccactactatagttcaggctgtgatctctcaggctgaggtaaaagcttcttaattagtcttccttaatctaatctatcttccctccaatatatcaactcatttatgctatttaatacatcagttaattgttctaaaacacacacttgatcctgtcactgtccaccccctaatccaaaagcttacatgccccttgcctttctcaatagacctgtgattcttgaattactacctggaaaaatagatgctaaacactgtgaattgaacatatgaatggtgtagagaaaaaaagcttgcaaatcattgctatgaagcttagcatggcattcaaaactctgttgtataatcctaattcgacctgctttcaatacgatctccaggcagaaagcaaacttattctcatgaacttaaactgatctaaaaacataaatgactatttatgactattgagtgaaaagtttttgcaagacttattgaatttacatatatgtgcatatccactatattttatactgatgcaacatgttttcaatctcatttgtttttaatgtttgctatttattatatctaagtaatactcaatcattaaaatttaattcattgctaaaatgaattttaacttttttcccagctttattgaggtgtaactgctaagacagtagatattaagtattgctgctgcaacatctatttttaaagttcttgggatatgttcataaaacctgcaggccatgaaataactggcatttaaaaaaaatagaaacatatctggaaacaaatcaaactaaggttcaatttacaggttcttagtccaattataagcaacccctcactattttaaactctgcttatcagggccccaggtttactattctagcctatgggctatttgactttttacttattaacattataacagtggctgcagaagatacagaagtaactaggggtggcggtgcggggcagggtggcggtgcggggcggggcgtggagaccagaaagtagattatttataaaatactacataattaatttgagcttttcctgttctatattaccatacatcaaagttgactatctattttatacataaaattaaaacagatgtgtgtgtatactagaaaaatgataatatatacaagcatatgctaacataaaaatagtaggctggcaataaaattatcatcctcatctactctttactgccccccctcttaataaatatgttgttcattctttttaaatgctcataaatcattttggccctataaatgtgacaattctttaaataaactatcagtgtggttccagattatcctagaagagcagatgacatccaaaaagtctaagaaaccatattaactgtgaccaagagaaagtatccttgggaaaaaagtaaaattaagacactcaactaaaatggcacctaataatactgaacataattttatgaagataataatgatagatgttgtttttccaagacatatgacattgttaaccaaagtaaattaactttcctacaaaatagggccactgttaaaagtttttttctccctacataagttatttattgggtcctatacagaattgatctcacctttttcaacattatctaatatgcctgaaatgtgagtaaatgcgggagaatcgtgatcaactaaattagaggatttgggaagattacgctaaagaagatttttatgtcatattaaggacttataaatttctcatataagtaatgataacccactgaaagacttcaaaaacagaaatcacaggactgtacttttgagttatgaagatcctggtgacagtgttaaaggtgtgagtgagatcagactggaaaaagagctaacaattagaagaaaattatgagtacttaaataaaagggagagatgactctgaaggtaatttggcagtcaactgaaatgcatatacccagtagtttcatttgtagatataaacccagagacataatcccacatatgaatgaatacattgctctagaagctcactgtgctgatatttgcaatataaaaaaagtaaaaacctcaatgaacaccaataggggaatgagtatagatggactatcaaacaagagttaaaaggaatgaattagatctatctatctatatatgtgtgtgtgtgtgtgtgtatatatatatataatcatggttaaatttcaaaaataaaatgaattaaaaattaagttgcagacaaatgtacactgcagcatattatttatgtaaaacaaataaaacagcattatatatgttctatttacctacaatgactacagtccctgagtgctttctcaagaaatagtgccatgtactattttttttttttttcctgaagaaacagtgccaggtactgctctaagcactttggattaactcgtttcttcctcacaacatccttatgacataggcactgttactatcccattttatagatggagaaactgaggcaaggagtttcaggatcttctcaaaggcttgcagataagaagtgacagagccaggattcaaacccaggcagtatgatccaaaataaaaaaatgtaaaactgtaaacatttcatgccaaattctgaatgctgttgattctggacaaggaagtgtccaggataggtgagtagaggtagaaggagactttagttatatctgaaatatcttttaaggatgtagtcaaacaacgtttaaacaatgtgttcattttttcccataaaaaatgtaaatatatttaaaagtctaggacaaaagatgctaacatgccattctgtcatggatgactacggttgatggaaatatgggggactattcttacaacttgtttgtagttttcagtatctttcaactttaaaaaaggcaatattgtatgcgcaactattttctttcaattgtttttaactgacgaataaaatttgttccagtccctttaaatctaaatctttctcaaccttgacactattgacattttgggctggataactgttgtgaattttcatgtacactggaggatgtttggcagcttccctggtctctatccactagtagccagtgagcatctcttttgcccccggcccctagcagtggtgactaaaaatgtctccagaggttgccaaaggtcccctgggtggtaaaaccgccccccccacacacacccccccacccccccggctgaacacaactaccttaataagccgaaacacgctttttttaactttatataattatttgagattaaagatttcagagatattttgctcattaagcatctcacactccaagttggaaggatactgaagggatgaaaaaaacttcaagcgaatgtagcacttaaaatccaattatcattgcaaggaatgacagacccaggtctcgggatgcccgcttccttccctctctcccgcaatgcggggacaaggggaggaaatccagccccatcgccccctctgcgaagtcctgggaagggaagactcgccagccccatcctacctcaacgcagcggcaacataccggaggccccacgtcgatacggtatccatctgctccaaacctcccgccagcgcgctgcatcctgggaggccgggcggaggctgcgtcgaacgcagaggaggcggagcctagaagccagccaggagaggtggccaagggaggctgaggaggcggggccctggggagtgttgtgaaagcagagagcccgcgagctctctagggcggagctccgcgggggaagcgccggcgatctcgcggctggcgggggcg

SEQ ID NO: 115 - DNA, 218677 bp, Homo Sapiens
ttaggtgcaaactgaagttttatttagaatgaaaaaatagacaacaaattacagattttaaagagctaaaaaattccacagatgtcacggagtccaggggaataacagcctggttggaggggcgctctccgcctcttctgtatttttggctctctctgagggtagtggttttaccagcatgctttatcaaaaactaaactatcagggagagtctacaaaaactcctgctagagtaaggtcagattccagaccctgtcgcacctctgaagaccttggtccagttccttccagggtggcttcacgccttgccatccctgcctccctgcggctgcccctgtgcccaggccccgccaacgccgtcaaggccccctcggccacgccgcgtccccgcccagcatctcggatgccattccttcccggtggcacctgcccaggctttgccgaaatcgaaggcaacaagagggggaggtgggcttaagagtgcctgcccggccgccacctgtcttggaggtggagggaatggccgaggggtggctcccccagctccccacctttgagcatctctcaggctgggaaagggcaaagggccacatgaagccagcaggcacttcagtgccacgtccccagagggacagtcctcccacccaggaacccctggctgcccagaaagcaccaccggcaaggccgcctccaccgcacccgtgagaggactcggcagctgtgaaggaactgggagattctgcagatgggccgaggtcagggcttccaggctaggaagaagtcttccagatgcctagcttcaccagtcccaggagaaggaaggaaggggcatgggcagaggcctggcaggggaggaggaagaggccaaccctgtacacaggaccacaggacagggtggaggactgtcccaggagtccctccacaacaggaggcctggtcccagtggcccctctctctaggggttccctgctgccaccatgtccacagaggagtcacagcttccatggcccagccacaagttctggcttaaagtcagaacaggagagaggccctcaactccagtgaagcatgcagctcctttttcaaccccaacacctctgacgaagcatgtttgttatatgaaggcaaggatcatgatggcacgaagcatgttatatgaaggcaatgaccatgagcacgaagcatgttatatgaaggcaatgaccatgatggcagctgccaccaaaatactttaccagcacacccttctgactgcagcatttctcagaagaaaggctcaggtgaaaagttcctggaattttccagatcttcagtggatctattagcattgccacataccaaaataaggaatttccctaaaggttaacttctaatccagcaaaactttgctcatacctcaaaacggagccaagactcagactaatacacacaaatcaaaatggacaaaagcaagtcttgactcacttgacaaacagaatagacacaaaagaatgtacaaccaatacaattccagaatgtccctgaaaggaaaaagcaccctgtactgacatgaaataaatgttaaccttgagattacactaacaatgcctttttttaagagatggtctcgctctgttgcccaggctggagtgcagtgtcatgatctcggctcactacaactcccacctcccgggttcaagagatcctcatgcctcagcctcttgaatagctgggattacagatgcatgccattgcaccccgataatttttgtatttttagtagagatagggtattgccatgttagccaggcagtctggaactcctgggctgaagtaatccccctgccttggcctcccaaagtgctgggatcacaggtgtgagccactgcacccagccaggccaattctttatcaggaatttccaattcccatttccatttaacaagagaactaactaactgaattaatcctgccttctaatgtttctggaacacatcctctaccttcgcctgccggctcctctgatgtcccaagggccttttggtagcagttagcatcatttagcaaatacagagtggaaagagtgtgccggaggcccgggcttgggtgtgctgtctgctcctgtggcctgtcaggcaggtccagggagacacaagggaagcctgagggaccctgactccccttgaagaatttctccatacagcaagacagtgtggctttatcccagatccctgactcctaaaaagagtctaaaaagagctaagttctctctaaattctttaatggttcatgaccaaattcttggttctaagactttgaatttttaaataatagatgtgcagcttgacttgggtaaaaactagaaacctgttctcccacccaggcctttgctttagtaattatcaagctgacggtctggccgggcgggcaccaggagtaccgaaggctcacttgagtcattagtgaacatgtctgactgagtctgggctgagggacctggctctgcattttgtaaaatagatactagcagattgtcccaagatgtgtacagctcattctcacagcccagcgagggcacttactccacaaatgcgtggccacaggtcatcacctgtcctgtggccctggcgagcctgatccctcacgccgggcacccacacggcctgcgtgccttctagacttgagttcgcagctctttaaggagctctcgggccagtttttctgatctagggctttcaatgccaagacgattccatctgtacaaggtctggtcaagaaagccaatgatctcgtgagttatctcagcagtgtgagccatctgcaatcaggacagaagagaaggcaaattaaaacactttccagacagatttgtcctttgtccagggacggaccataaccacccagtccctgaaagaagccctatccagcatttccatcagttccaaagtaaagcatcaggggctctagtttgcaaggtgattagcatagcaagtctgtctccaaggctggctacacagtgagcggtgccatttcctaacgagcctcctcgcattgagctcagctgccaacagccttagactcataaaggccacaaacaagcgctgcttgcaatcagaagtgcttctcagaatgccagtcacaagttgtgggatgatccactgtggggaacaaaggcaaatgagcatgctgtggcttgactttctgcaaaaggctcacacgaacatgagaattggaaaataccacctgttttcacagaaacagcccctggcatccctgggctagcaaccggacctacttgctttttaataggcctctaaggttttaacacctgattcttgcgggagagcaggagacacagcctcaaggcattcgtacttgttggtgcctgtaagtattttcctaaaaacttcggttaagaaaaaagggaagggtgagaatcttacaatttagctgtgtggggaatttatggttctttaagcacaagcagtattaagaaggcttaagtttttgaaagagtaaccgatatattcacttagtgtgtgtcagtttatacagaacccgcaaatgtttaattagccagagcagcccaaggtcagcttcctctggaagggttgggccgttctgggagggtgaacaactgccttggttttcccaggactattctggttttactgcctcaggtccgacagcccaggacacccttcagaactgggccttccacctcctgaccaccactaaagggagcctcttgtcgcatgcgcactgtgtgaatggcagcgtggggacgcagagctaagagtaaacgacgtggtgtggaccatgacgttcgctctcctcggccccccctggcagcacacagggcctgcagccggcctgcaacgagcccgccagggtcagtgcagccagcacgggggctccggctgtagcccaggcacgtgccagtgtgtccctgggcgtctgtattgctatcacttggtttttactcagaaatgacaggcacatagtgctgatggccttcggtagatgcagcctgtccttcatcaaggaaacaatgtgagcctgctgtggacccctttcagttaatataccacccagaccctgagcgggaggactgtcccccgctcaggggctggccatgcccatgctgatgggcttggccatgtctgaagaaaggccgagttgtcattacaaatccaaccttgcatcttccttacacaccaacactcctgggtgggccccttcccagctctctagtcacatgcaaaaattcgcagccctgcagccgcctggaaaacctgcctccctgctggccttggctggtgcaccaagagtgggttcaattcattttgagttcaacgactacagaattgaactctgcatctcggaatctagctaacttttgctgttgttgctgtggcccagcagcaggaggcaggagaaggagaagtgtgaatccaggacaggacaggaggtggagccccaggggtggactccatgcagtcctctgctctgtgccggcctcctgcaggcacaagtgagggagcaagtggacggctggggcaaggcagaggagtgcctggcgagaggccaggagccagagaggcaggagaaccgcagggacgttgggcagggcctcatggatggcgttctggggaaaatcggagggccgaggtcagagaagaggattccgggacagccggggagtgggcctccaggtgcctggagaagagcccactgcgcagagctcactgcagaggccacacaggaggcaggctgtgggcagatggggctgcaggaccagtgcgtcctttaggtcagatggagccactcgctcaagccatctccaagagggtgcaagggctctgaagagagatagtggcctttgccttgagctggcactgctctccaaatctggatgccaagatagagggcagagcctgggaccagctgggaggtggctgcgctcgtgctaggtcctgagggtggagagacccaagctgtaggagggaaaggccgtcccaccaaagcaaccatctggccaccacctgctcgtgggccaagcagacccggctctttccaaggtgctgtcggcagaggaactgacaaaggccaggagaggcaggggtggtgggagggatccttccccagaggccctccctgccacgcggccaccgcagcgaaggcttctcattaggaagactgacgtgtcaataaagatggtttcaaaacatccgaaaggacagcccccaggaggtgctttcaccacgatgggtgcccagatggccagcatccgtccctgacagagtcagtgcatgagcgccacactggcgtctgctctgggaatgggcttctgctgtgtgtgtcttctctgtggcggaactgacttgggggatgtgatgacaaagcactggggccctctgtgctcctgagggttcccgtgtggatccgcagcaggggctgaaccacgtgtcaggagggactgccccacacaggatgcaggctggcccttgcagcatctggcttactcccagcaatgtctctgggcccagtcttgagggcgatctgctttgaatgtggactgaaagtttcctccgagtagatggaaacatggcatcaggataactgaagcagagacctgggtgtctctagggtgcttgctctgggtgattttctctcacaccctgtcggcagggctggagtcaccaaactcccacgctgacccctgctgctaagccttctccactcacacgggccacagggttggggaggaagtgcctgagctggaattgtccttgtcacagggcagggctgaccatctccccactgcccctccccagccccccataagcaccttcccactgtttctgtgagttcgactttttagatcccacccataggtgagagcatgcatttgtctctcgcgtctggcttatttcgctcagtgtaaagccctctaggttgggccgcattgttgcaggtgtgcattttataagagtacacaatagattctcgaaagcattctcgctgtgctggggccgggcccaaagaggtggcacctggcatgtggcagccagtcgtctttagccctgggccaccctcatgactcggattcgtcttagctgagacaccagcacctgggaggcacagcctgggcccactccacaggactgtcctaccaggatggagacaatctcctggccctggttcttggcaggtgggtcatgttacggggactttctgtacatggacattcacgtttcagtcaggcccggcctggacgggagcaggaggggcctctggggactgggaatattcctctcgagttggctgctggctgcacaggtgttgttggtttgtgaaattcatcaagctgtgtattttctgtatgtatatgtcaacaaaagtacaaataaaataaaaaataaaacaaaactcccagagccagcatgctggtgctttttctgagatgagtatttttttaaattgtggtaaaatatacataaaatgtgctgttttacccatttgtgtaatttggtggcatgcagtatgtttacagtgttgcacagccatcagcactggccgtctcctgcccctttccatgatccccacactgactccccaccctctgccttgggaaactctagcacttcctctccctggacttgactcttccaggtgcctcacctaagtgactcatacaacatcctcgtttctggcttatttcaacagcacagtgtcttccaggttcattcatgttgtagcactgtcagaacctctttccatcttcaggctgaacagtactctcttgtgggtacagatcacacggtgcattgcttgtccctctacaggcgtttaggccatctctgcctgctggctgctgagaatagtgctgccctgagcactgggccagatggccctccagcccctgctttcggctctctgggttatagacctaggagaactgcctgccacatggtaattccaagtttggctgtttgaggaaccaccccattcttctccacagtagctgcacgacgttaatgtccccaccgggaagcatatgagtgttccggttcccacgcatcctcacgggcgtttcttttctctccttgctgacagccatcctgatggctgtgcagtgcatctcgctgcactttgcctttccctgaccactcatgccctttctgtgagcatctccccacatgcctactggccatttgtacatcttctttggagaaatgtctgttcaagtcctttgcccatttttgaattgggttgtttatctttttgttgttgagttataagaattccttatgtattctgaatactaaactctaatcatatatattatttccagatatttttctcccattctgtgaattgtgttttcactttcttgacagtatcatttgatgcacaaaagcttttaattttcataaagtccaatttatctattgttttctttcattgctgtgcctttggtatcatatccaagaaatcattgccaaatctaatgtcacaaagagtgctcacttttgacttggaccgttttttacccctcaagtcaagtgggcttcaggaaggatttctttgtaataaaccaatttttttaaagattaacagaattctttgcactgttgcagtgaatagcattgtggttgctttgcgagcccattctcatcgtggccttacttctttccatgaggaggaggagagcagcacactgcgatggaaagaaatgtacgtagggggacaggagacctggcttctaccgcaggctttggcagcaagccgtgggcccaggagatggcatctcctgtctctgagcctctgttttctcttctatgacataaaggtgctggaaggggcaggctctggggtccatcccagctgtcaacctccttgaccatttatctgtgctgggcagcatcctggtacacacactgtgcagaggccagaccctcggacaggtaacccacctctcgcctggagcagaaatgagtactaggatgctggaccacagggagacttaccagggtgatgacatcccaggcgatcgtgtggcctccaggagcccagagcaggaagttgaggagaaggtgcctgatcagctgttgtgcaggagctctgaggtctgtgtctgtgccctgtcctgctaccgtctgcaggtcctgggctgagaggctgctgcttctggacattgccaggaggtggcccagcacggccttcacctggacctgggcaatagtatttcacaggggagaggttaggaagaggcaggacagacatacttctaggatttatttatttgctttgaaacaacccccagaaacgggtaagcactggcccctgagagagggagctaggcagcggccgaatttacactcgatttcacacaaacccaaatgggcggaatggaaatttcttgactttctttcgtcttgctcaccaagcagtcagggcaccatgccaggaactgacctttttttgtataaaaggaaacagagaaaagttctcaacagaatgtagtcagatttttatattgtgggaaaaagaacaaaaggctccttgaagactcgcctatcacagccacaaatcaattaaagccccacgcagtcagacctccgccgagccagtgttcccatacgaatgtaggcttgcctttgcttcttgctatattgggggtcagggcggggggtcggggggaacacacacacatgcacgcacgtgtacacaagcacggtcatacacacatgcatgcacacacaagaacacatttgttttagatgccggaacaatctgttcatacgtgtttaatgctcaagcagaggccacaagtctgtggaacccacataataatggtaattataagtctgcaggttgcttttgcataaaaaatactcattccatgctgagatgtttctgcttgctacaagaatggtacacccagtcgtgacttggaaaacaaagcaaagcaaaaaccgaaagcccatagctccaaatgccacatggaactcgtgaacagctatgttccatcacttctgaaagaatacttaggcctattctgagaattcccatgaccgattttatggattttgtgtgaggcgttttttttccctggaagtcaaggcctcattcaatgaagtctgtcataaactccagtacactgggtgtgttgtgtgagctcctctgaccacaatacaagaccgtgagaaactgcaccatcgggctcttccacggggagcggcagcgctccagcagggcaggcctcactctccccacctcgcccctcagccggcccagcctgccgggtctgatggtgtctacgggagcccaaggccattctgccatctaactgggtctgcaaaaatgtcagggtttaggaggctatgcctttatatctgttttttctcttgacccacaaccgactttctgcccttgtccaataatccctaagatggggtctatcttcctttatgtctggcccagactgtctttcccttcagaggccgtccatgctcatgggcttccacttgaacaccgataactaactttaaacatgtcctaagtttttcaggagaaagataaaagctttcttttctttttaaagtattttttatcctgcattataaagacatatatgcttactatggaaaatttgaaaagagaaaaagaagaaccattaaaatgatctataactctaccatccaaaaagactcactgttaataattcggtttatatacttcttgtcttttttctacgcactgagaccataccactcactacacataatgccttgtatctttcatttttctctccataatgtactataagcagttcagttcactgtatctatagaacatgctcttcaagacctttttttttttttggagacagagccttgctctgtcacccaggctggaatgcagtggtgcaatctctactcactgcaacctctgcctcctgagctcaagcgatccttccatctatctcagcctcccgagtagctgggactacaggcacacattaccatacctggctaatttctttatttatttttttgtagagacaggggtctatgttgcccaggctggtctcaaactcatggattcaagtgatacggccacctcggccttccaaagtgctgagattacaggcatgaaccaccacacccgtccaagagcatgatttttcatggtatgtaacagaatgctattccatggttaggatataccacactttatttggccagtagccttactattgaaagttcaggccatttcccattgttgtatttatgaacaatgctgtgctgaatattcttatacataagcctttgcatggatctctattccccagggtaattcctagaagtggaaccacagggttaaagggtatgaacccttgcctgatttttttttttcctttttttctctaggcatcattgtaccttactgattcttaagggtatctaaacgacttttttttattttgttgtgatctgattcagttgttggcaaaaggagatgaactctggctgctggtggaaagggtggcttgcccatgagtgggacaggccttctcacaggcaggacacatcctgggcggggacacgcttggtctttgcacccatgttcttcacctcaaggacatccacagaggcagtgacgccaggcccagcacacgatgcggggatacgccaccagctgatttaattgtgcctttttaagtaaatgcacaaatgcagagatactgctaatttcaattcaatcacatacgaatcatgctttctaacacagttcacagtttgtctctcaagcctcccaacagaccatcaagggattaaagctcacaaaacccaggaaaacaagaggtacgtatcattcattaaactaaaatccccttcccaggacgccacatacaccaatgcctcaggcaggcaccagcaaggaaggggctctggagtcaccaacatgagcactggattgaactgccaggcagatgggcacctgtgacagaatggggggaagggaaatggatgcctgccactgccccactcacattgagccaatacgttctcatccaaaatcctaggcatcccctgagggagaactacgcaagggttttattttttcataaaaaaggaccaagttagctagtagaagatgtgccaatgtagaactttctagaaattaagtgttattgaataatttatttctttatacttcaaaagtgattctctgtcagtaaccttttgactgtgatggaattgaacacatatctaccaacttagcttattcagaatcaaataagacagaatataaaagggctttaaaaaccatatgtgccccgtacatcttattactgttaaaaacatcaaccaggattttccttagcttaacgtgatcttttaaaggggaagaaataaaaagctttctttttaatcagacagcaatcctcaaatacatacgtgggttataattttttcacaaagctttatttctgatccaaaataaattatcaccaaatttcaactttttaaaatctaaaactatttttctttcctatgccatgcaagcctttaaacaaaatacgcagacatctttattagtctgtgtgttttcaaacaacagaaaatgccaaagccaagagaagcagggctctatacaaaatgagccttgtcctctttaactactaagatcagcatagagcactggcagttgaagttttaagaacctagcaaatcaatgcttgcaagggaggtgccaatgcctttaatcaaagcattgcttcctgtaattattatattccacataaaataacaactgtctttgccacagacagttatccagtcccatacttagctgctctgttatttaggaaatgaccaacttctttttcagaagcaaagtggttaatatcatctgattactttagtaagagatgtaaataaagccagtaatgtgaggatctgttgactgatccaagaaaggagacagtcaagatggaagcaagccctggccgggctgctggggagcgagacagggccctggctgtggccaggctctgctgccggcacacccctcagaacagcccgcctctgcagggcacgccttggaggacgcgaccctggggcagatatggcagctgagcaataacagatcaaatgaccttggggaagaagggtcttcgttttgcaggagaatgggctggcagcgtctcgtctctggccacctcggtggggacaggagaacgcctctgaccacaaggctggagatcaccatgcctgcaggttgccatgacatatgccatctgtgggcagagctcaggtgtcatggaagccaagcccacaacagagcccctctctgcaagctcctctcagccccccagagcccaccccaaacacatgcagtggggcctgctacccaccatagtctgtgctctctgctgcctcccatcacgggggccgtagtagaaggccaagagccacagcagggccgtggggggttcggctgccgacatcagtaattgctctgccaccatctcagcccatcctccgaagtgaatgaacaggaaccagctctcaaagggacctccgcaggacctggaacagaggcagaacacatggcagttgacaacctaaattcttcttcctttgggtttttaaagcaactttaacgtttgccaacggttggcttaaattgtacttatccactgaagtgcaacctgcaaggaatacaatttagattcagaaagcctgtccaaacgccactctgcaccatcacaggacatcgaaagagtgcctctcaggacccccgtgaggcctgaggcctttggacatcggagtctttaatccaggtacgttcagtgaggacaggcactgaagaaggaagactgcggccatgaccaacaggaatgtggcaggatgtggcggcacacctccctgccttctgagatggggagaaagaggtggagggtaggacgcaggcagaaacatgggctatttcccttctgacaagacgcaaagttcaggtggatatttcagcaactacgaatttttaatgagctgctgtcatcatgggtgcatcaatgccagaaagttgaagtgtttgtgaagctatcccctcgccacactggcaaatgggagttgcaatacttgttttaagggtagaatttgcttgagataagggcctactaattgtgtgcagtgccggtctcagcaggtgaacatctcccttggagaggatggaacagaccagcctgagatcacattagatgagaacattccttctggactggggcagtggctggaacaggagtgttcctggcccctttgttggatcttcctgcatgttcctctgcctggcccatggaattcccaagctctaagcactgtcctcgcctccctggacactgctgtcctcctgccccagtcctccctgagaacaagtggttaaatgttctacatttgagcaacagagacatgtccctctttcccaggacatggtcagagctgatgctctggaggccacgttggctgtgggctgggttaggctgtaccagagtgaggaggggactctgccatgcctcttccctgcaggcaccatgtcagggtagacagatgcacagagcagtgaggctccctcatgctcccagctcccaggttggcagcgtgactggatcaggatcagagaccggtctggtccttccctctgtcttccaccagtagctgaatgcacaagcagtcccatgtggccacctgaaaggtatctcatggctccaaggtctggattgaagtgggagccccacgaggtctaagtcctgttctgcagcaccacatgcgccctttctggttgctgttttattccagtcttcacgcatttgacatcacacattctgagtgatggtggagagggtgggtagagagaagagaaaaacacccagggcacccactgcacaacatgtctcaatcacagggtgggctgtttatgccacctgcatctacgtcctgtccccgagttaagattcttcaaggtccagctctgtgtaacaccaggacaaccagggagggtgtgtggggggccgactggccactgcaggctattcatgtggccaaccccgcagcctccattggctgcaggccttttttgtctggtctctgtcggtaagaatcatggtgaggaaggagtgagcagctggcacccaagccatcaatcacggagctggacataggtgtgtcacccattgtctgtgtcaactcggtgtgagactacagagaattccaggagtgaaaagtggcaaaaggaacaaataagatagtcttagtaggctagcagggacaatgaataaaattatactctgaaagaggaagccaaagagtgttatgatacaaggaatttagcaaggcataaatgtgaatgctttcaagaaaatcacacacataagagggtacctaacactactgttaagaaattaacaagccaggcacagcggtccacacctgtaatcccagcacgacgggaggccaaggcaggaggattacttgagcccatgaatttgaagcaatacagcaagacctctacaaaaaaaaaaatttttttttttttttggagacggagtcttactgtcacccaggctggagtgcagtggcacgatcttggctcactgcaagctccacctcctgggttcatgccattctcctgcctcagcctcccgagtagctgggactacaggcacccgccaccacgcccggctaattttttgtatttttagtagagatggtgtttcaccgtgttagccaggatggtctcgatctcctgaccttgtgatctgcctgcctcagcctccccaagtgctgggattacaggtgtgagccaccgcgcccggccacaaaaaaatttaaacattagctaggtgtggtggtacacgcctgtagtcccagctactcaggagtctgagtgggaggatcacctaagcgcaggaatttgaggctacagtgagatgtgatcattccactgcactccagcctgaaagacagagcaagaccttatctctaaaaatttaaaacaaaccaaccaacccagaatttatattagaatagattttctcattttagagagatttattagagagaaggaaaagcaagcatttaacattccaccctactgtgtaggagtttcaaatctccttccctagagaggtagagggaagaccacaggacccaaacaagtgccctttcccttctgtgcggccagggaggggttcccagcaggtgggtgctgctttttccaaggcctcttctttttattgttatgcctgtatatttcaaaatctaaaaccagacgttaatgtagaaaacatttcgatacaggtattggcacatgcatacatgcgcatgcctattcatcctgacctgctccaagccatccgtgcagccatgcgcttcctccacttctcacttcaccatggtgctcacctgtttggtgatggtcccagaccagtaatgccttcctctgtcagccctgctcaaagggcagatgaggatctagggaaaccatgtgtgaagtagatttgggagtggtcagtgtttgctcacccatgagtctggtcttcaactgcttctctgagcagttcagaaatatgcttcagtgtctggagccagtgtccccgagggatatctgcgggtggagagagatacgtcagagggcaactgaggaaatgtcaagcccatgaggaaccacctgcagggatgacctgaagagtctttgggagacgccctttacttctggttcacggaacccaatactgttctcatgcttttcccagccagtacctatctcttaagcctggggaagtaagatctgtccatgtcacacagagttgaacatcaaagaatctaatcttttaattttagttttgtggggttttaagacacgatcttgcttggtcagaggctggagtgcagtggtacgatcctggttcactgcagccccaacctcctgggctcaagcgatcttcctacctcagcctccccagtagctgggactacaggggtgcaccaccatgcccagctatttttaaaatttttttgtagagatgaggtttcactatgtttctcagacttgtctcaaattcctgggctcaagtgatcctcccgccttggcctcccaaagtgctggaattacaggcattaatcaccacgcttgccctcaagtaattttaaattcaggtacatggaagtagctagagattgcataagcagcccccgctgagactgggaaatgccgggttgcggatgccctaggtttcttcttttctacctacacactcctccatcactaatgtgttgatttcaaaatagacggagactgtagtaaagcagccaataaggaattaggaatagactgcctgactgctttcctagggctgtgatgaattcacaatatgatttcaggtttacagtggaaaaaaaggccaggaaagaaaataagtgagcattatgcaaacaaatgtcttttcttgagtgagctgctctggtttcacagtcatcctgtggttttaaatacagctgagcagcacgtatctgcagttctgtgcagcatctgcaaaagttttcacatagtgatagatgctataatcgaacacacaaggaaggtaaggcgagtgatggacaaactgctgctactccacaaggccagcgcctccctcctctgaactcccgcggcccttggtgcacagccttttgaaggtatttttcgtttcttccttttactagctatttagatgtttatttcgcatttcctccacttgtagtgtctacacagtcagggctcgtaagtgatcctcttttacacccctctcccggccttcacaatgggtatgaaataaatttctgataaacagaagatcatgccactaaaaaacacttcttcaatctgtgaccataacactgtttcccaaagtaatatacagacagctcttctaggaactagcacaagaggttcttgtacttctgcccgaagccacctatttatatttggacataaatctacaagttacacaaacggaaaggtaaagggttgggcccatgcccatgcaccacctcaccgtttatttactatttccaaactgagacactaacaactccagtacattttctggagctcactcagcgtcccctgttggctgactttaggctttgctgatctgacctaagcgtaaggtgaaccctgggagagtgaattcctcatttttctgtcttgttaataaagttttcccaagagttttcataaaactgtcacccagagatcccacccctagctccagcatctgagaagacagtgttaggggatcaccctgggcaagaacctacatcttctcgaaaaaggaagaggaatttaggttttgtaaaatgctctgaaactttgaatcatttgcatttctcaaacagatctactcactcaagtctcagaaaaaaggcaggcccaaaatggcataaaaaggaaatgtgactggctcgttcccttctgtctcctctcctcccatgctccaataaggcccctttctggctggcgcagtctgtgcccatgtcaggactgccttccatcaggtttcaggcctcagagggaaaggatgcccttattctctatttccgaaatgtctcctaagcgtgagctcacagccacattcctggatcaacaccagtcgaatgaaggctggaaccatcacttccccagctggatagcctttggaaggctggcaaaggatatcaggagaggctgtggatgaagcaccttactgaactctctcaaaatccttcccttagcttggttaggggaaacttcccctgcatttcctcagcttcatccatcattttgtcttttcttctgcaacaaggctgcacagagtagaaagaatgaaaagcaaacgaatgtactgttttattctgactcagccaagtcttagcctgttcctggcatctggtggatctggttggcaccagaagagcctgtgttatctggaggcagactagcaacacctaccagaggccattgtttttttgtttgttttcttcttttggtaagtgatcacaactgggaagccaagcagactctcatatcaaaatccacagaatgtgggatcctgggggcttaaagggatcttagaaataaccagttctgtctccctcatgctgtagataagggcctgatgaggaggtcataatttgacaatgctcttcccaggaaatcattctgatgtgggcaaagtcaaccctaactcaccttgagggtcttgcagcagcaccatggcaagagatggagaagtgtaaggaaagtaggtcttgagtgcaaaccgcagctgccacaggatggaaaatccaaagagcatgaacattaagattgaaacggggtcaggaaaatacaaaactctgagtcctctgcccaaaaaagacccaccagtactaacatggtcagaacactttcttaaacatttattttttgaaaaataagctcccaataacctcatattttccagaataattaacctttttaaagtcaccttctgggacttaaaaatttatgctcttgatgtctttatgagttctacttcacatgaacccaattatacaaataaatcttctgttttggaaagacttgccaaagccgttgtgagatgttaggtatttcagcatttttttttttttttttgaaacggagttttgctcttgctgcccaggctggagtgcaatggcgcgatctcagctcaccgcaacctctggctcccgggttcaagcgattctcctccctgtctcccaagtatctgggattacaggcatgcgccaccaagcactactaattttgtactttttagtagagacagagtttctccatgttggtcaggctggtctcgaactcccgacctcaggtgatctggccgcctcggcctcccaaagtactgggattacagtgagccaccatgcccggcttgtttttgtttttttattgagatggagtctccttctgttgcgcaggctggagtgcagaggcacaatctcagctcactgcaacctccacctcccgggtccaaatgattctcctgcctcagcctcctgagtagccgggattacaggcacatgccaccacacctggctaatttttgcatttttagtggagatggggtttcaccatgttggccaggctggtcttgaactccttagcttaagtgatccacctgcctcggcctcccaaagtgctggggttatagtcatgagccactgagcctggctcagcatggtttttaaaataacaacaaaagtgtaaaactgtgctcgcatttcgagggccaaagagctacagctatctatgcccccaaggggcacagaagcttttttaaaaattgaggtaaaatctataacgcatggagtgcatgggctttaagtatatgaggttttggtaaatgtgcaaatccatgtgaccaccaccccagtgaagacacatttctatcacgccaaaaagtccccttccaattcttaacaatcattccctccaccccaccctggcaaccaatgttttgattttgacaagagagattagttttgcttattcttgaattttgtgtaaagggaacataaagtatgttttcttttgtgtctggcttcttgggctcaacatattttcttaaagattaagccacgttattgtgtgcgagtagatcattctgtttttattgctcagaagtagtctgaattgtatgaatatgccatagtctgtttagccattctcctcttgatgtgcatttgggctgcttccagtttggggctgtcatgaataaagctgtagttaacatgcatacatatgtcttttcatggacatgtgtttctgtttctcctggggatgccatcggaatggaactgctgggtcacagatagatgcttgtttaacatcgtaaggccatatggttttccggtgttgtaccatcttacgcccaccagcaatgtatgtgaattccagttgctccacatactccccagcatttcatccattctagtggctgggaacataaccctatgtatgcttgctttcctacctgtttcactctgcactttcctgatggcaaatgacgctgaacagttttcatgtgcttactgccaacttatgtatcttttttgaaagtatatattcaagtcttttgtccattttaaaaactggtttcttaggcagttataagagctcttcatatattctcgacacaagtcctctgttgtatacatatattacaaatattttctcctagctaacggcttgctttttcagttccttctttcttccttttctttttttttttttttaattgagatggagtcttgctctgttgccaagctggagtgcagtggtgtgatcttggctccctgcaacctccacctcccaggttcaagcgattctcctgcctcagcctcccaaatagctgggactaaaggcacatgccactatgcccagctaatttttgtatttttagtagagacggggtttcactatgttggccaggatggtcttgatctcttgaactcgtgatccacccacctcagccttgcaaagtgctaggattacaggcatgagccaccgtgcctggcctgctttttcagtttcttaatgatatctatcaaagaatagaaattttacattcctttcttattttttgagatatggtttcactctgttgcccaagctggagtgcagtggcatgatcacagctcactgaagccttgatctcccaggctcaagtgatcctcccacctcagcctcccgagtagctaggacaacaggtgtgtgccaccacgttcagctaaattttgtattttttgtagaaaaggggtcttactttgttgcccaggctggtctccatctcctgggctcaagagatcctcctgccttggggctcccaacgagctgggattacaggagtgagctatgcccccagcctaaaagttttaaattctgatgaggtctaatttatccattttttcctatggttagtgcttctgagaaatcttagatcacctcagtgtcaaacagatacattatcctatgctctctctaggggctttatctttctaacatttctgttgaagcccatgatcctctcaaattaactgttgtgtgctttacaaggtaatgtttgaggttcatttttctacatatggacatccagttattccagcatcatttgttgaaaacgttcctttccccattgaattgtcttggcatctctgtcaaaaatcagttggccacatatgtatgggtctatatctggactcaattctgatctatctatggctgtctttttgccaatacctcactgtcttgattacaatggcttttaaaatcttttttttttttttttaagacagcatctcgccctgtcttccaggctggagtgcagtggtgtgatcatggctcactgcagcctccacgttctgggctcaagcaatcctcccacttcaccccccgagtagccgggactacaggcatgcatcaccatgcccagctaattttttatttatttacttttttgtagagactggggtcccactatgttgcccaggctggtcttgaactcaactcctggactcaagcaatcctcccaccttggcctcctaaagtgctgggattacaggcatgagccgccgtgcccagccaggtcttcattttttttgttcaatctgacgtttctgcctttttattagaatatttaacttccatttaattgctgaaattaatgtcattgttggtagttttgggtttaggtctatcttttgacattggttttcttttttcccctcaatttttttgttcctttggcagcttacacttctattttttggcaccttaagtcaatcagattgtgccaagttctggccctctcctggccccacactgcctgccttccaacctcacatgagggcagctggggggaggcaggagacctctctgtgtgatgtccctttaaagggctgatggcctccagtttctgtccactttttcaggtgctctgtagtgccttcaaatagatttttaaaaatactttgcctggagtttatcatttttatctgtgggagatgatttaatctagctcattaccagatgctgtcatggctgcaaccagaaactgacctgactggctgtactgagccacagtgcaggcttagaaaaagtggcttgtcacacccatttcaatttctgcctactgtctgatagggcatattgatggagctgactgtgtcctccaaacagaacagggacaagaggaaagggtaagaagagacagaagcactgacatgagtgcttctgatgataggagagaatgtggatttatgggatcactcataaactgttgcaggaagtgcagatgagcaccaacacttttgaaatgagtctggcaggatctatgaaagttgaacttttgtattccaaatacacttccactcctaagtatctatcccagagtgtccagagcaacattgtttgtaataaaaaacaaaacctggaagcatctcaagtgcctaccagcaggaggatggctacactgccatacgttttcacaatggactatgcataacagtacttccccacagccacacatggcaacgtcaagaagtctctgctgagtggaaaagcaagtctcaaaagattgcacagagtatgctgctcctgtttgttttatatagtgcaaaaacaaccaaaactaaacaaaacattgtttaggcagtcatatatatgtgatcaaactactttcagaaagagcaaagggataataaacataaaattcatttttttttttttttttgagatggagtctcgctctgtcgcccaggctggagtgcagtggcgcaatctcagctcactgcaagctccgcctcccgggttcatgccattatcctgcctcagcctcctgagtagctgggactataagcgcccaccaccatgcccggcgaatttttttgtatttttagtagagacagggtttcaccgtgttagccaggatggtctcgatctcctgaccttgtgatctgcctgcctcgacctcccaaagtgctgggattacaggtgtgagccaccacgcctggcacataaaattcaaaccagaggttacctggagggagagaggcagggaggagcacgtggatagacatatattcagattattagatatcaggtttacagatactcattttattaagaaggaattaatgaataaaacacagagagaaaagagggtcacgcatctaccaaatatgacatgaagggttttgattagctaaaaatggacagtcaagaaggcagagggtcaaaagatgtagatggccatcagttaaaaagacaggcactcaggtccagctctaggaagagaaataaactaacagatacctatgcaggcattggcaaagcaaagagactttcctttcctttgttgagctgaaggcgagggtggtgaattcctgtttgtttttggatccctgccttgcctcacaccaggacccagtgtgtggtcccacgtccttagatacgtatgcctggtcagggtactagtctcaattaaaagcaactgcaacatcagtcccaatccatagtgcccacggccaacatagaggctgagggtgaagctaagaagaaaaagaggcgcgagctaaccctaaagagcacagtggcactcctccgtggcctctgctccaacccaggtgtgctccgcgaggccacaggtgagactccccagaggcccgttcctaatggggtctacaaagaatgcacaagggaggctcagagacatttacagttaggctcaaaataaccgtgagggccagctgtgccttccagccgagccacctccaaaattctaggtgggaccatggatagcgcagcttgctacagcccagctaacttctccagggaaagtgagggtgggaaaaaataaatcacaaatatttactgttggccaggcacagtggctcaagcctggaatccaagcaccttgggagggcaaggtgggaggatcccttgaacccagctgtttgagaccagcctgagcaacagagagactctatctctacaaaaaaaaatttaaaaattagctgggcgtggtggcttgaacctgtggtcccaactacttgggaggctgaggtggggggatcgcttgagcccacgaagccaaaggctgcagtgagccatgatcataccactgcactccagccttggtggcagagtaagagcctgtctcaaaaaataaaataaaataaaaatatatttattgttgctttaaaaagcagaaacaggctgggtgtggtggctcacacctgtaaccccagcactttgggaggccaaggtgggaagattgcttgagcctcagaggttgagaccagcccgggcaacatggtgaaaccccatctctaataaaaatacaaaaattagtgcttcctccagtccgtgcctccaatatgatgaaaaaaagaaggaacaacggtcgtaccaaaaagggccgcggccacgtgcagcctatttgcgacacgaactgtgcccaatgtgtgcccaaggacaaggctattaacaaattcatcattggaaacacagtggaggctgcagcagtcagggacatttctgaagcgagcgtctttgatgcctatgtgcttcccaagctgtatttgaagctacattactgtctgagttgtgcaattcacagcaaagtagtcaggaatcgatcttgtgaagcccacaaggactgaacacccctactccaatttagacctgcggatgctgccccacaacccccaccaaagcccacgtaaggagttgagtccttaaagtctgaagacggactattctcttgagaaaaataaaatggaaattgtacttaattaaaaaatacaaaaagtagccatgagtggtgacatgcacctgtggtcccagctacacgcaggggctgaagtgtgaggatcacctgagcttggggggttgagactgcagtaaactgagatcacatcactgcactccagcctgggtgacagagtaaaaccttgtctcaaaaaaaaaaaaaaaaaaaaaaaaaagtagaaatatcggctaaaacctgagagatctatttgacgttggcggggggtgtgatctggtggagccaagcattgtagttctcctctcggaagtcaaactgcggagagcttcacaggggccgtgacatactctacagatgagatgcactggaccagcaccactctcgacaggcaatgtgtcccataaacattacttctgtggccgttagaaatcaaggccaaatatatatgctgaaaggtgaaagctcgctggtagcaaaggtccctgtttcacgaggtccctctaattggtcattgactcttggcagctgttgcccagcctctgctgctggggacgtggagcacaatcttctgcagggtgcgggcctggcctttggtttactgactgtgtctaacacacacctcccgctcactgcccttcctcactccccttctagttagtcaagcctttcccagtcactcttaccacctcctttcctggaagccaattcacatttgggtctctgataagaatgaagatgctaataattaagaatgtccaggagtgctttgtaataagtgccctttcctattcatcacatgccatatagaccccagggtgcctcctgctgacctgggaggctcagatgcagccagggggcagtgtcctgctcggcagacagtgcacaacacagggccaagaagagccgtcctccagggccatgcatgctggcatgacagagttctcagacataatagtagacagatgcttctgggtatcagggcacggggcagacagatcttgatttatgttaagttaaaatggcttaacctttgttggggcactcattaggaacctttctttgtgagcaaaacagtccatcaaaattattgaaaataaagtgctcttgtccaaaatactctcaacagcgtcttattctctgggatgaatgagtaatatatgtgatataacaaacctgcttgcttgctttctccagagcttctacaaagcactgcgtaaacacctgaatagtggctatgatttccagggccccatcggtttccaggagtgcacacctgaacaatgcaaagtcagatcagaacacgtttaacaagtaatccggcaaacatgaaaacctgcactgtataagggaaaagtagaaacactttttttgtgccataagcttcagcagtatctcaactcatcagatttcagtccttgtgtgaaaacaggataaatttgtcgctccctgttatattttctttaaaattgcaacgtgcagagctctctttcttggttcttaaattattaagcaatgcaaatcccttccacacaggcttgcatactctgtacaaatatttttgtattgtatgcctggacacgcaacatcaacattttgctttcacaagtggagacgaagctgctcaaagggtaaaatggcctcgtccatccacccagcaaagtaggaaaataatgtgtgtgtacctggtttcgcttccatgcattattgtacaattaatttttctttatgtttgtttaagcaaaacaaaacaaaacaaacaaaaaaactctcaaattttgctagctttaaacccccaacactgttctgactactggtgagttattgtcacagtaaaaattcctttccccaaagtctgcagtctgccctgcagcctctgctgctgtgtgttaggtgggaggggctagagagagagctgatatgggctcccctggaagaggggctgggacactcccaggtgacaagctccccaggggcgtccagtcttagtactccatggttagtactcccactaacttagtactccatggttaaaactcccactaactgccagccacatctcagcttcatggctgtgagctcctcgtctcttgccgtctgtaaatctaatgcatttcccaagaagtactcatattttcaaaataaaaatgtaatgtgttgtaagagaacatgcatggtgtattttgcctttcagaagagttctgttaagaatgacttttatttttcttggctttctttagctttaaagtcttttaaaaatattggtcagccctcacatggtgaagggagtatattgctaccctttattctgagctgagaaaaatcctacatgaatatttcatgatattaatgcctaactcaattctgtgtttctattattagaatcttaaaaggctaaagaaaataaagttatcttaattcttaggcactggcctttaaatttacactgatttttgagtttttacctctaattaccaaaaagctcagaggaacaggagggaatcagaaactctaatttccccatgatacagccagagactaccacaacattttctgattcatgcttggaaatggaaccttttttacatcaattactagaagaaacagtgtaacgtttacctgaacatctcatcaacaacccggaatatggcagggtggcaggctgcttgaggctgtaaaaggagaagaccatgagaatgtgaaatatcacaagcactttctcagaaacttgctattatcagccaaaggagttactgggaactgctgatgtccagaaaactggcatactccttttggttagaagaacgaaccactgctgtactgaaaacgccccacatacaagtgcatacggtggtctccctgggcaggggttacaggcagcttattcctctgtatactcctgtatgtcccacattttctataaaagctcaggcgatccataatacagaatcagtaagtattagagaaactttaaacatccctctgcccgcatgccgtggagcctgcctgtactgccagttctactgaagtgtgcctgtgtgacctcctcaaatggctagatgtgcctcgaggtcaggcccgtgcctgcagcctgtttattcggtaatgggtacataacaatttagaattattattggcaaaccagtgaccactaccacgctggactaaatcacatcacatcttaatgcacttaacagcttgcgttaagatgaaaagggggttcatgaagaagaataaaagttatctaatttctccttgaatatttcggtgatgggttctgattatttgagtctgcagaagctggcctccggtagccctgggagctggggggagcttcactggcccagtccctggttccctatctttttggccagagctcaaagtatgagatgatgccagatgaaaatgcccatttgtgttccaaaacagatcctttatagcagggtccgtaactttctcggcaccaggtaccggtttcttggaaggcaatgtttccacagaccgggagggggagatggttttgggatgaaacggttgctcctcagatcatcagaggacaacccgattccaggcatgcgcagtcaggatggggctctggttccgtgggaagcgaagcgcggggctctgacaggggcaggtgcgggcgggaaggctaggggctcctctccgctgtgcgcccagggggcggggacccctgcttcacagcagcattcacatgttagtggatcaggcgctattggaaattcaagtcagagtgcatttgatatgactagctttgggaaacactgttcacaggcccccgtcggcaagaaaaaaggaggcgctctgctccggccgtgccctggatcacactgaggcaggaccgcgcctcctcgcggcctccccgatgacattgagcccgcgccatctagcgtccactggtcagcactgctggacccgccgggctccaggcaggagctctgccactttttcaggacaggataaatctccttttaattatttcaagatttctaatttgcaagttaaaatgtcctactctttaaataatctatgctccctcatccttcactgatgtgcatttttatctaaaaggaaccaacttgatattcttacagataaattcattatctatgcaagaaaataatttggcaggaccaccgttcaagagaggagaggcaggttatttcgtggcttcgaacttaggcatgtcagttaatctcctgatgcccagtctcactgtaaataataaaagttattaagaggtcaccggatataagcacggaaaatataaaagtttctatgtattcataatgaaaaaataaaacaagggaaaagcaaccgtatgtcttgaagaaatgtgattcatctaagtttgccagagcaattttcaaagtttgtacaacaacatgcctattgaataagagtgtttaagatcaaatagcactgttatgtgcccacaggcagacagataagagcttggaaatgcgttgatagaaagtaagatgaaacttgaaaatggtaaaattaaatttcttttttctaaatggtcaaactatcccagagccattctataggtttgatgctagtagagaatcattcaatactaattatagggatttccaaacagcaaagaaaatgatgatcagatgtagattagggctactatgaaaaccactgggggagcaaggaagacagctcttactcagtttgttagaagagagtgagagcttagatctgctcctcttctgtgcgctgttttctagcaaaatcgctcaatccaatgttttaaatgcctgctggctgtgtggaatctgcttgttcttccccatacagatggactctcctcttagatttctttctttccaaatatttcagacccttggctactctcagcctgcttccacaacccattttagcttttaaaacaggtaagaggccaggaggcaggggaacctgcagaaacagcaacggcagagattttgatttgaaaaccagtctccttttttttttttttgagacagggtctcattctgttgccaggctggagtgcagtggtgatcttggctcactgcaacctccaactcctgggttcaaaagattctcctgccttagcctcctgagtagctgggattacaggcacgtgccaccacacctggctaatttttgtatttttagtagagatggggtttcaccgtgttggccaggatggtctcgatctcctgacctcactgaaaaaaaagaaaaccagtctcccttgctacccctacagctgtgaactgctccttctcatctgcacccctcaccgatggcttttaaaatgacactctttatactttttgagcacataatttcagggtcagtgagtcccctcatgaggactagagtactacaggtcaggcatatgtcccagcgacatcaaatcacaaaagcaatcttaagctgcttttcttatcaagataatcttccaaatagaattaaggttttaatacacgcttctttggaagccgtatcttcccccctaaatctctgtagcatcttcatgagtgatgacgcaggcatctaacctctgatcctgttttatttgtaaggtggggcactccggtaacacaccagaggtcacgctgcaagccagggctctgaagccccatgactgcggccattatcttttctataaaagcggggaaataaaataaaccttttgtggtttccatctgtttgtttttctccatcctaccaaaatctgttccttctcaagctctctcttctccatctggcctaacaatttccacaggcagatcatttcaactcgaggggagctatgtcagcaggaggtcttcaataacatgagtcttgtccttccctccttatctcccccctcaggcttttcactgaatgcccaggatgactagggagcgaagatggagagctctgggttctgccctccctcttgtatagacccgattgttctgctgggtgtgcatccccttgggctaacaagagctttccctctgatctcccctcatggctacccagaattgcattgtttatctcccctccacctagaaagaaagcccatcttcatccctcaaaacacaagggaagacaaagtcaacatggaatcaacacacaataaccatggtctcagtgcctgttttggaagagaggcaagggagaggccaacttgtcactctgcaccatgaactgtgcaaattacacaggctcttgtgcccggtccttgatgtttacttaagctgttattttcataccaactcaccaatgattattacaagccacttgccacttgaaagaggcctgagaacaagaagaacagaattctcaggaagaagcatttctttctgtcatttgctgattctgtgtgtgtgtgtgtgtgagagagagagagagagagagagaatagggaaaaggagagggacagaaaacaaaccaaaaagggaaattatactatgatttaaggtaactcacagacaaaagcaaatcccttttagaaaaaataaaaaggcagtgaaggaacagaaaaaattatcaagtgctttccatctatcacctttcatagatatattcgccttaaaaataaagaaggaaatagcagatgacagagaagctgaagttcattaagcctggaatagattctttcctggtattttcatgtacttgcatgtagcttaaatatttacttaggaaatgggtcatttaaagaatcagctgatgggcagcttcccctccagtttacccagcagccggacaatcccgtcccaccgtgtagctgtttccgagccactgttctctccacagtgggaagcccttgttgttaatatgtgcatattcactacaaaatacctttcttcttaaaaagaagattctccataagagtcatttcaccagtgaactcctctattgaagtgaaaaatgatttggcttgagaaaaacctatttatacaaaaccttcacatctatcatgtacaatgaggcacctttataaatatgtattttttattatgccatttgcttcttttctattttcaaaatactaaacataagactctaaatatcccttttacattttcagatctattttgttttaaaacattcaggttccttttaacaaatttgagctcggaaaaattattctttctttttaatctttaccagatgttgtttatacacaaacaattttttcagtactccataatgcaattattgtttaattagtgataaatctgtcattcctgggcttaagaacttaacaagtaccaaatgtacttttgcgtcttaaatttacatgtgctcttctctgtgtttggacacagaggatccccagcaccccctcccctgcctgaagtccttctagccttgcccagtggcctctatccaattagcccgggtagcccaagctggaagaaagctcctcagccccctgctgcttcacagctcagcctgagtggcaatgacccctacgtccacccctgctttgtttttgggtttttccctctctcccttcatctctggccacaaggtctgcatccccaactgcaattccattgcaaggaaactcgcaacgtgggcctctttcttcacagagactatgctggaggatctggtgcccccctgaggctaattctggaaagtgcaactccagtccaagatgcagaacctcccagcttttagccatacacatcagccagcactactggactactgctaaattatctacttcagctcttgttcaattacatgcaccacattaaagagctcaaaaggaagtgccgaaaagactgaaaaagcaggaaaagaaaaccctggcatgttagtgaaaagctacttaagcacagcaaactgacaatatcacccaggatgtagagtgaactcttcagcacaatattttaccaaggaggagctgcatactgggagtctgtgtaaaggaagtttctttttctttctgaagtgctacaattgctacctggagaatgagggaaaaaaacacaacctatcccatattgaggaggatactgaggtatctagatgctttttattcttaagttcttattagataaagtaatcttttgaattaagccataaagatttttaggtaggagagaaaatgaagcatattctgatatcaaatcttagcagaaacaactctgcctcctgggcgcctcctctgctcctttcttttggggacaagtctgcctgggaaggtgaggctagctcctctggacccagctgcgggcgggctctgccagcaaatgggagggcatgagaatcgggtaccttccggccctggcatgcagcttgccagccaagcacagtgccaccctgacaccctgcagacacttttcattccaatgtggaatccaaagaatagctttctgggctccacaaacaaaattgtaactggaaaacataacatccttctaatttggggccagccttgggaaaccgaacaatgccaagaaggctgcataattaacaagtggctttcactgctgtcggtgacatcggtttttaaggtcaggtctgaagctatggattatggtcttcccgtgcccatgctgtcaaggaaaacacaagaccatctgcttttgaaaagtttcagtctgtacagtaaatgacaatctagggctaatacctcacttgatgtaggagctaccaaccgtggcagacagcatgactcgacagcagtccagtccaccgcacggaagccaaaggggaagcctcaaaagtgaacgggttttgaaaacttttcttttattttagatgttaaatacatacatagtcatttggaactcaggtaataagagactaatccctcattattcatggtcttaatggaaaatatcagacctgcgagtccaagaggccaaagaacatttgggaaggtcatttcactttgtacaacctgtaccacacttttatcttttgtttttgttacattttggtaactatagaatttccaggactcattctgcatagtcccaagagagagaaatataattaacagtgctctatataaaacacaagttatgtagaccatcacactttaattactctcagaatccaactctaatgtaataggcatcaggtttcctctggagcacagcgcagcagtctcgtgctatctgagtcttagagatctctctgatacttctgtacagtcctgtcactgcaccaagatactgcactgcgataaatgaatcagatgatgcaattaggaagcaggctcttcaggttacccctgcaatcacttagccacgtcacaggcctattgcggcctgcctggctttctggcactgcaggcccaggatgctgaggagaacagcccacaccaatcaggggcttccagccatcgtctgtattgtaattacgtccttgaaccatgaggcacagagaggtcacatcctgccaatgccacaataaattaaaccaaataacaccctctagaatccccctttagccataatggaagctctgaatttctgcacacatgatcccgataaaagcttttgtaagtcaactgacttcaaagctgtgtgactcgtgggagattactgtaaactacaaactggagactgagcattatacagttatgtgcaatgggacggcctgcgttctctgtcttgcatctgctgtgctcaccacagtgctgctcaggcatgagggccacaggcaaaaaggacatggagaaggttcagggaagaatccaaggattaaggaaaggctggaaaaaaggcaatgggactagaatttttcaatagggagaagacttaaggaaaatgtcataagcaccctggaagcaagcatatagcccagttactatcattttgccactgaaaagggaccagagaaactgaaatcctagtatgcacatgtaagttagtaatagatttagcagacaataaaggtaatttatgaccttgaatcaccaggaatgggctgtcagagggcttctgaaagtcatgatttattttgaattgtactgcaaccattttaaaataaggtgcattcctatttcttgccttaatatatgactcttccggatggtaaggttaggtagtaattatccttaagaaatctgtttgggctctctcagtcttaatatacacgtcttcctttctcttctatcgtggtaaactttcaagtcaggtgggatccgtgtgtgcagcctgaggtacaggtgagagcagcgtggctgtcagcacctgcaaccctatgcacatcgccctgggaggccaaggggaagggtgaaaggggccatgaaacaaggggagaaacgggatcgcggaggaaggcaactgattccattaggattcccttagacagtctccaactagaaagagaaagaaagaacacagaagtcccaactgaactaaacaagttgaaggcctctaggaggtaggggttctatgagctcaggaaaagtgggcacagccaacctcagggacttcctcagtctcagctcaagggcgagggtgaacactccctccttcccagtgtcccggccactaactaaagaccggaccgttcactgtggctcttggaactcactttctccacttgcaggaagcaggaagaagtggaaggcaatctctgtgccacatccctgcagattacgaaagctaaagggaaaaagggcagagttcactggagctcctggaagacagaggctgcgggaccatggcacctgcaggtttctgaatcattttttcagggtgccttggtctttattcctgtccttacaaaatgtgctccaatcccacagagctgcctcccacaaaggaatatgactggcgagtcagtggtggcgagggccactgagagcccagggtgccagacactgggccaggaggtggatgtccacgtgggctggagtccccagctgcacagtcctgagcgggaagggagccaggcgccaccgcgcaggggagggtgaaggcaggtggcctcacaccaaaagaaaacttacagaagtcttagctggttctgctgctttaaccatttttctggggttttgtgtctcttatttcatctttcctctagtgaagagctacaagtttattttttgaatgtttttaattgattcttcctcttacccatatgttcatttccaaaaacttattttccatgctgaaataagaaatactgtttttaaaaagtctgttgtgcaaatgtcaattcttgtgaacatgtgatatacggcatatcaatcaagtaaacctcagatctctccctgcatgctccaaggatgcagaaaagccccctatgttagtgatttcaaaaataaaatgtaaatacacgattatatataaaggttccaattgctcttttgtttacatccccccctttcattctctgactaaaagaaatgattccaagcatctccttcaaggatttttcccttcatcaaaacccagtacgtaccagcgatgaatcttttataaagcattcgatccttctcagacaatttctctcactggagattagcttttcaaaaagatgcagcattgctttttcaaggctgggaaggtgccgaagccagaggcagactacagctgacatggggagagaaatcttcttcctttcagaaagaaataaacaaaattttaaacagaaatggctcactgaaaaaagaagattaaaaaaagttcaaaatgcaatcactaatccaatttgtgagacttctcatcatggtcacagcagtggctaataatttatagaatcagtgaatatttaccaagtgctcatttgcaaaataatgtgaatatgcttccacttcaactcaccttaagaaatcagaaatgctcaggaaaaaaattgctttcaaaaagaataagcaaatgtctagtgatggaagaaagagggagcgataaaaaacgggatggaaaaggcctcgtgatgcccagtccctaactgaagaaataggcatgttcaaacacgcgtaatcatgcctcacaatagggatgcggacctgggtttcggtcccagcgccactgcctactaactgtatgatctcagagaagttaacctcagtttattcatctgtaaaatgggcctatctccttcacagtgttcttgtaatgcaacaacacacgtacagtgattagcacagtgcttggcacataaatatccaataactaattataatcggttgcttgaaagttgaaaatatttctaacaatttcaaggccagatgcagtggctcacacctataatcccaacactttgagagactgaggtagaaggatcacttgagcccaggagttcaagaccagcctggtcaaatagtgaggccctgcttctacaaaaaaaaattttttttttaaattagcctggcatggtgatagcacacctgtaatcccagctacttgggaggctgaggcaggaggatcgctagagcccaggaggctgtgttcacgtcactgcactccaacctgggcaaaagagcaagaccctgtctcaaaagaaaaaaatccaatttcatatatggtagttatggcctagttgatgcactggaccttaagtgtgatactggataggttagcaggactgggaatcaaagattcctttaaaaaaaaaaaaagatgcaaagtcgtgctctctcacccaggctagagtgcaatggtgtgatcaaagttccctgtaacctcaaactcctaggctcatgtgatcctcctgcatcagtctccccagtagctgggactacaggtgcacgtcaccacatctggctattttttttcttgtaaagatgggggtcttgctattttgcccagtttggtcttgaactcctggcctcaaacaatcttcctgccttggcctcccaaaatgttgggaatacaggcctgagccccactactccccagacacaaccattttgtgtagctacatttgtttctaaaggaacatatattaaggtcctcttgtgtcagtgaattggggctccacttcccctccctggagggagcatgaggggcacatgtctgtctctgagccccaactgctggctctgggatacagtagagctgcccccgagagccacctgccctttacctgcacatcccagacagtgggtgcttcccagtgggtgcttttcaaacttgatgtctattcattaatctccctcctgtcttgccccaagaaaaacaaggctactgctattaataaggaaaactaaagtgggggcgtaagcctcccaccgacccaacaaccccttcaaggcctgtcccttcaccatgacttttgggccacttctctgcagagctggtgtgaagcccagcaactgggtccagggacaggaagggacatggggagagcagttcctagaggtttcactttttctgcttgcttggtgtagctcctgcagaccttgtccagggttgaccgtggggcaagagcagcagggaagaggctgaagacccggggagactgcggaggagctggcagaaggcagggggaagggagaagggagggagggtacattcacctcagagcctcctgatctcacgctcacaccctgagcttcaatttgtccaggacccaccggcaggccccgttcctcatctccccacctcccacacctggcaaagccctgccatggtgccacaccccctcaatactggacatgccatttcctcagatgaaaagaagagaagaaatgatttctggaggatttactaagagatcagtttgaggtgtgtggatttggagtgtctgaggcacaaccaagcagagatattcaataggtccttgaatatccaaggtggaagctccgggagaggaattggctgaaggtacacatttgggtgtcagaaccccaagggaggaagctctgagtgtggaggcaggcaggggaggaggagcagctgcagatggcaggaggcacagaagcagaggacgcgtcatcagagcacgagaagatacaaaggggcgaatgaaccctgagtgtgccgggcaggccctggatggcagcacatggcagagagaggagaggagtggaggtgaagccaggactgcagacaggacttcagaggactggcggtaacgggagtgatcccaggcggcggcccagaggtggggcctagtgtgctcctgaaaggctgccaacgggcaaggcgcagaggagtgggaaaggctgaaaagcagtggctggaatgatgctgtttcgcttgcacttgaatcctcattaacagccctacaaaacaggtacaaaattatcccctccccgcacagaagaggcagccgaggtcagagaggaccaggactcgcagctggtaacacttgaagccagggcggctgaggttggagtgagtacaggaccacgttggctctgaggaggggtgcaagaagccaggcctgggctcagcagaacagtgggcagctttactgggtgggccagacgccgtgcctgtgcttatgccccttgtgaagaggaaaggcttttccatccaggtggtcagccaattctagccacatcaatggagccctggagaggggttcctgtccagtaatcatggggaagcagaacacccctgggtgtggagagggtgctcgtagcttccatcatggagccaggaagctctgaataggagagttcgcctctcagtggctcctcccttctcaagcagcagtgctggctttgaccagctttcctcatgccttatcttttttcaggatccatgtaacacgaatctgtatgtcactggaaaggcgtttcactgcagtgagaggtcttctgccagtaccacatcctggccgagagccatggcacggtgtttgtcattcatcctgccaggtggtggtggggaagctgctgcagcactcaggccaggccgccaggagcagcagcaaattcacatgaaccaatgaagaaccgacccatcctgcttagcatagtcactcaagcacacgagtcacactccagtcagtaaagtgcgtgatgcgcccattctagtttgaaaacgatgtgtgttaatagctgtctttttattagagccttgattcagagcacaccctactaattgctgtgagtgattatgtttatggacctgtgtttaatatttggatagattttgctctaaaacctcagtgacttaactctttgtaatcacccctgaatgaaggaatcgccgaagcagtatcatcttgatatgcttgcttaacagaatttggccgagccaacatatttgtgttctacctggtggtctgaaccaggctggctttaaataaaaaggcaaatcacagaaaaagaactgcaaatggccgataaaaatgtgcagctctcccatctaattaacagtaaaggaagggaaacgcaccgacgtggtctcagtttcaccctctccgtgtaggcgctgaggagagtgacaacacccagtgctggggtaggcagagggtgcgtctcctcacaggcaggcaggcactggcttcacatggccagtcatgtggtgccactgaagaaaatgcaagacacacagccccgtgttaatcatcgtactgctgtcaatttgcctggcagaaatagaaacatcagtttgaggatatttactgcaatccttatatatgataaggacaaaactataaacactgcagtgtgcacccacggggatggcggaacagagtgtgggcctcgtgccacggagtatgcccctatttcaaatgagctggatctgtgtcctgcgaggggtatttaagacacgctggttaaaaagcaggctctggagtgatgtggctatggtgtaatgctgcttttgttttgacaatgagcagacaatggctttatatggactttatgtttaacaagcataaggtatggctaccagaattactgcaggatgaggaggaggaggtaatgaacattttctgtatatgccttgtgctgtattgtttgacctgacaaaatgaatatatatatatttatatatatatatatataaatatatatattcattcattctgtggaaaatttaaagggacaataaagtaaaaaagaaaaaaatgtttttagggaaactaaaaaatttcattctgttcaatacgttagtgacagaaacgctaaggttgtcctttttcttctctataatggttccatccatcctgcctggaattgaccaaaatcatgaattcaagaaaacagagtaagataaaaacttgactcccccaaatccctacctaataattgggagagttttctgtatcatagttatgttttaggaaatggggtggacatttagaatttatgtgtaatacattactattttctcctttaaaataatgagcagtaggcttccagtcagggctccacctagaaatctgatttacagtgacagcgtctgccatgagccagggaagcctggacaggacgctctcccctgtccaacagactcttccaaaagacacctccttgagatttagaaaactctactttgtttcccccaaatactcagtttagtgaggcagttgtgttttctcatcctttacaaaaagaggtagcaggtaaagaaattggtccaactgcttactaaataattttggctccaaatatttttatagctacaaaaaaacaaaacaaaacaaaacaaaaccagaatgcagaattaaattcttcacaagaaaggttcttgatgagggaggcccatctgagaggttgtgttctaaagctgtctgagcagtagaggggaggccagggcttcctcagccaagacaaaggtgcactggcaacagtccaccttttcaaaccagaaagagatcaaggctgtttgggttgccagacaaactcacaaaacttggatttaactgttatggagaattgcttacttccaaggaactgaaaagaacactgtttgatcctaaagttgtatttaggtgacagcctgatctaagcaatgcatcataattcagacaaaagttgccatcattatcatctgcatgtacagagcagctcacttctcaaaaggcagccaccaacaagcagaagaaatgtgcaaacccaaacacaccagaatgtctggcaattacacgtcaatataagcagattttttattagaaaagtaaagttttctgtgactcaatttgtgaccatatcttattaaggttaaaaaaacaggatgtggctgggcacagtgtctcaggcctgtagtctcagcactttgggaggtcaaggagggtggtttgcttgagtccaggagttcaagaccagcctgggcaatatggcaaaacccagtctctaccagaaatacaaaataattagcaaggcatggtggcacatgcctgtagtcccagccactcgggaggctgaggtcaaagaatcacctgagcctgggaggtcgaggctacagtgagacatgactgtaccactgcactctagcctgggtgacagagtgagaccctgtctcaaaaaaaaaaaaaaaaaaaaaaaaaaaaggatgtgaggaagtctctcagtttccatcatggataaacaatattaatagaaatgggagttttagttactgctaattctttgccacctttctgtccttggtattatgctgacttttctttgtttaaacactcacctatatgatttgacaacatttaaatctggattttccttatctaagttgaaaaaaacataaacccaacatcttgattgtaggtcggccctttcttctaatttacgttttcatttccagaggtctcattttcctgatttgtaaaatggctacagcgatgctgagggtattcaaaagaatctgtggctcctcaagagtaattctagttaggctccttttttggggtaacttgatatgcaagagcataacagacgagtaaactactaatacataagttagtcaagaagcataaattaggttcttctgatagataatgaattgttttcttattaagcattgttggaagccatattagctctttcagcaatgggaattaagcttacatctggttttagttcagtgattgttagggggaaaaatatgagtttgcaaaaacctaatactacacattgtcaaaaataatacaattactagagtcaataatggtaatagtaatatgttaacagtttgtggggttttttttttttttttttttttttgaggcagagttttgctcttgtcgcccaggctggagtgcaatggcacgatctcggctcactacaacctctgcctcccgggttcaagcaattctcctgcctcagcctcctgagtagctgggactacaggcacctgccatcacacccagctaatttttgtatttttagtagagatgggattttaccacgttggccaggctggtcttaaattcctgacctcaggtgatccacctgcctcagccttccaaagtgctgggattacaggtgtgagccaccgtgcccggccaccaacagtttttattttttagagccagggtcttgctacattgcccaggctggacttgaactcctggcctcaagtgattctcctgctttggcctcctgagtagctgggattacaggtgtgtgccactgtgcctgtctttttatttttattttttaaagcctacagcacccgctaatccccaggcccaacccccctcagcttctgagatcaggcaagactgggcacatttagggtggagtggctgtagacgctaatggttacggggtatttactgtggatacgaggcactgtgctaagaatattacagtcattcaacccatttaaatcttagtgtaagtatttgtcctagtttgtaagtttatttctgttatcccactatacttataaaagggatctcttttaactctcagaagtggcatggtctagattttaaatcatatggccaccctatttaacactcagagccaccccgagctgcgagtgttagagtggtcagagactcgtatgtcagtcactcccactacttagaagctgtttttactcacagagcacttctcacactcactgtgtggattttcttcctccacacaaaccaatgctcccaactctctagacaccaactgggtgtccagtgattcaattctgacaccatctggcattagcacacaccccacaggttaagggctcagtcccacaagactgcccccacttcagatgccaatcacaggtctaggcctctcattcttctgaccaactagctataaaatcagaggttccaatgatcctctcttcaggtttgataatttgctagaatggctcacagaactcaggaagacactttacttgccattaccaatttattctgaaagatacaattcaggaacagccacatggaagagatgcatggggccaggcctgggggaaagttctgagcttccaggccctctccaggcacgtcaccttcccagcacctggatgtgaccaccaatctggaagctatttgaaccccacagtttaggttttttatggaggtctcacaatgtaagcacgactgattaaatcgctggccagtagtgatcaggtcgaactctgggggtcaggtgtggttggttcctttggctaccagcccccatcccgaggctatctgggggcccaccaggagtcacttcattagcctacactcaggtgtggtgaaaagggacttatgaataataaaagatgctcttctcacctcatcactcaggaaatttcaagggttttaggagcctggatgaagaccaaatgcacatttcttattatatcacgagatcaccgtcatgccttcattctttttttcacttgttcagtgtctcattcattcaggcatatagaacaaattctccatccagtcttcaagcttctcagtatttttgaagcagtggattcggatgacctcagaggacatgtcatgctgtattacttatactccagacttacaaaaggacctcagcagcccgcccaggaaggttttatgccgtctttagcctgcaggtgcctatgacggcagccccagggacagacatgaaaagttgacatttaggccaagaaatttaaaagttcctctaggttatctaaaccataaagaggggcaagcatctgctgtttaaaagacaggcagaccactgctgaaaatatatgactgcatttggaagccaagaccaaagacaccagccaattgtcaaacagatgaaattccactggtgtactgtggtaagcaaatagttggaaggctaaacacgggttagagtgcattggtcaaagaaagcatgtggtttccaaatgaccacgcagcacatctggggagggggggctgggcgcggctggtaatttgcactgattgattggatcagcctcgctgtgtcaacatgtggctgggatgttccgcctacgggaaagtgtccatggagaggctccagctcttacgccactgcttggggaacttgctgagctgaagccacaggatttggacacactgaagaccacccagcacttctggacagtctgtcccttatggattagcagacataactttccaaaccaaataaattttatgagttgttgagggagaacatgctatcacaagcaaaattacaagcaagggagtgtgggcctgcttggggagccgctgccctcagcgtccctctgagcactgtgctagagcaggagtagctgttctctgggcacgtcgcctggccagtgatttctcaaacagcttttggggtttcacagaagaccaggagtattcacttccagattccctttaattcagctcttgctgaaagagtaaggctagacacgggggtggctgagaccatattctcctgtgaaatatattcctagatgaatcaagaagggagctgccacagtgaaaggcaagagcattttagttaaatattctttgtaagtattttgaaaaatcgccgtggagagtaaaaatgccagttggtgtgatcagtggtggggccgtgaagcgtgtgctccattgcgggtgttgggcactgtaaggaaagaatcgagcgccgcgccgcacgttcacaacgccctttactcagtatctcacataaggaccaaacataacgctcggactcctcagaaagctcactccacttactgggtgaattttgacagaaggtttaagagtaggtagaaaaaaggccattttatttttttagccatgaaacctgcattttgaccatttttcgaatcaagtgacttaatcttctaattctctttttaaatctcactttcacaaaatcctggattataacctttcatataaactgaaattaaaatatgtatcctaatttttaagagttatagatttaaaaaatggaaatactctgaactgtaagaacaacggtggttttgagcctgttttgttttccaaacgcaacaaacaacacaatgaaaatctatttgaagatggaggagaagatccatttatgacagtgaaaacattgaaaacacaaatacaacaaaacattaggaacaagaaatgtgtaaatccaatgtgtgaaaaatatatacaacactcccttcagatcacaaaagcttaacaaatggtaaaacgtatgtgttcttgaacaggcggacagacagccttaacatcatgaaaacgccagctctctcgataatctatatacttacaggagtcttcccccaacaacactgggtgtcttccctgcaactagaaaaattggtttcaaagtttatgtggaatataagacaagcaatgatagcaaaacaaactaataacaaccctagtaaagaagagaaatcaaagggaatgatccttattttgtattgaacacagttgatgccagcactaaagcagtgatactgccgcacgcacatgcaagagaccagagaaccagaacagaaggtaacaaaacaggcctgactatgtgagaactgagaatgtgacaagggaaccacctaagcccacaggactgtgctccagaggcacgcaccctttatcacactcaagagggcggacatgctttaccaccggagaacggggaaaacaaccgtattatttcaacaaataatttcaaaacaaaaaacaaagagggattgaaagagacttaaaagaaccataaaccaaaggcaatgtgtagatctgaactctgattctttatttttttttatttgaactctgattctaacaaaccaactggaagaaaaattctaagacaatcaggataatttaattcctgactagatatgtgatgatgataaggaactaatgtcaattttaagatgtaataatggtattgtagttttgtttttttaaaatgcattgtatagcaaggaagggtctacatatgtaacaattctccaatttctcactgaaagtatttaaataaagaattgggcctgtcacagtggctcatgcctataatcccaacattttgggaggccaagacaggcagactccttgagcccaggagttcaagaccagcctaggcaacatggtgaaatgccgtctctaccgaaaatacaaaaaattagccaggcatggtagcacacacctgtggtcccagctactcaggaggctgaggtgggaggatcgcctgagcctgggagtttgagactacagtgagccaagactgcaccactgcactccagcctatgtgacagagtgagaccccatctcaaaaaaaaaaaaaaaaaaaaaaaaattgaaaacgtaaatagtattaataaaatgatttaaaaaccacagtattcttaacaaaatgtcaagtttataagcagtaagtatcattttaaaatcacattgcatgtataccttgaattcggaaatgtgaatgctttggatctcattatctgagacggagagggctctgcaaattataccacacagtggattcacagtgttttcaaacactgcagacagagccactcgtaacttggagtcatgactacagcagtagtcagaggccatgcaacaattttcaaagtggggttcaaagaactgtttccagagagggagggaagaactgagatgcgttaaaagaaaaaatcattatttaaaaaattcttacatttttcttgggcctacgtggaaacataagaagaaataagtacactttgttgggttttgtagtaatatatattttttaattttgaaaacttttctaatttttaaattttatctaagttattttagataattttattagatatatatttgtatgtatatatacagtgtatattttacttatatattttaatatatattttagattattattttggaattttacaatattctatttgaaaagtaacatttatttatgatgtattttcttgcatttaagaatggatcactggctttaaaaatgaggattaaaagattcaatttctcatcctacagatgtttcatcaagaaaagatgaaactggctggcgcagtggctcacgcctgtaatcccagcactttgggaggccgaggtgggtggatcacctgaggtcgggatttcgagaccagcctgaccaacatggaaaaccctgtctctactaaaaacacaaaattagctgggcgtgatggtgcatgcctgtaatcccagctactcgggaggctgaggcaggagaatcacttgaacccggaaggcagaggttgcggtgagccgagattgcaccactgtactccagcctgggcaacaagagtgaaactctgtctcaaaaaagaaaagaaaagaaaagatgaaactgacacatcagagaattctctgactcatgagatggagacatctgctacagagaaagtgggctaaactgtaaataaagacaaaaaatgtgaggaaagttatttttcccttgcctttacagatgttaatgatttaccttattgtgtcttatgcaacaatattttgaatactgttatggtgcaagttaactgccacatcagtttgagaccaatcattcagagtctgaagaaaaaaaatttaaatgcagatgtgataaattaatatgtcaccaagagaactgtacttctgccttacaatagaatctctggacttactgtattgcttgtacttgtctggtatcagcaccaacttaagcacagaagctcttttatatgaaagttggccacacacccaagtggtagggaaatacttaaagtactgaataactattttgaatctcctggtttttcctggaataaccgtgttgacatttgcactgatagcgcaaaagcaacagtgggtaacacagctgtgtctcagtgggaatcagagccgagacagccctcacgctactcttcaccaccacacacacacagtcgaaacactgcattttcacatatgaatgtctgatgaagcagtttaacatactgactttattaaactgttgccctcaaggatacttttaaaaaagaattctgtacggtgaaaaggaaagtgtgcataaagcacttctgcttcataacaaaaaaagacggttgcctggagaaaagcactccacttgtacacctgcacaactctttcagcagtgggctcacttgaccactttttgtcatggaaattgacctgaaagaatgactagcagacaggcagtggtcagtcacattttaggattaggcacatactttctcaataattagcaaagtgactcagtcccctaaggaaaatgactgacagtgtttgtagcccatgataaattttagcttttaagcagaaattagaatcttggaaaatctatgtccaccaacataagcttgacagcttcccaatacttaaagtcatttctgatgagctccatggtggcagtaatgactataggttttgatactgcatatgaaatatgtcaatgtttggaagatatacataactcaatgaatgaagattttccaaatgaaccatgcataatgctacaaaattatgtgtgttggcaaaaaagatccattgaaagtgcaagacagaccaatgggtttctaatgtaacagagtatggaaagttaactgacataatttcagattccacattgcaactaccctttaaaaaatgaccattttcaaattttggtgagctatcaaagcagaattatccacaatgatctgcaatggctactagaatattcccgcctttcccaattactatctatgtggggctggattttcttcatacacttcaaccaaaacaacacgtcccaccagaagcagatatgagaattcagcagtcttagggtagaaaatgagacttgcaaaaatgtaaaaacaatgctgcttttgtcaaacatttttttttttgccttggaaaagagcattgcttttcataaaaataagctatttgtgttaacgtgtaataaaattatttttattttttaagtaacaaacacatttttaaaaatttagtttcaaatatgataaatattaataagggtttaacagatttttaaaactcttgggaatgtatgaacacaaagaaggaaacaatagtcgctggggcctacctgagcaacggtaggagggagaggagcagaaaaggtaactactggggactgagcttaatacctgggtgatgaaataatatgtacaacaaaaccctatgacatgtgtttacctatgtaacaaaccttcacatgtacccccaaacctaaaataaaagttaaaaataaaaaaataaaatgttttgggatcctcagtaattttttttttttttgagatggagtctcgctctgttgcccaggctggagtgcagtggcacaatctcggctcactgcaatctccgcctcccaggtggaagcgatcctcctgactcagcccccctagtagctgggattagaggcacacaccaccatgcttgactaatttttgcatttttagtagagacagggtttcaccatgttggccaggctggtctcaaactcctgacctcaggtgatccacccgccttggcctcccaaagtgctgggattacaggtgtgagccaccacacctggccgggatactcagtaatttttaagagtataaagggtactgagacaaaaacgtttggacactgctgtcgtacagtctttccaacacaccacagccttctaagaaaaggaaaaacgacgcaggatgacaggaaacatttgccacttacagcaaaatggcctcgtttacagcctcaaagaactctggctggaggatttcctgaggttcacgtccatgacagatgaggagagcctccaccagggggtcaacatctgtcagggtaataagtgggacacaaactcgtgacagggacgccactcgctcgggagccattctatggaagaaataagaaataatcactcaaatctaagagccatgcataattaaggacatataaaaaccttcatgctaaaaaggtcaaagacagatcacctgttttgcctctaaataaagagaatgactctaacaccatcgatgaacacttctcttttatccaattctttaggaagaaatcttttagctaccattgctgtttcagtgtcattcatggtcaggactttgttctttatattcacaggcacttaatatgtccaaaacacaactcctgaattcccttcccagtgttccctttccccagtgctatcttgtttgctcaggcccaaatcctgattcctccctttctctcaggcccctcatctgatccatcagtgaatactagcaacacatctgacctcttctgaacacctccatcactgtcctcctaagtggagagtaactcaccaccacctctagcctgggtgacagagtagcctctggatttcttgtttctgcactcactcctatagtttaacatcagaacagttccagcacccctttaaaaattccgatcacaacacttgtctgctcaaagctttgcaatggcttctcacctcatgtagagaataagcaatgtctttcactagccagcaagtccttccatggtgggtccccatctgtttcactgacttaatctccttccactcttacctttgtcttttctgcctctgactgccccaaataaagtcctgctgttcactctgcctgaaatacatgattagctccctggttgcagctcaaatgtccctttgttaagtgaggtcttctctgatcatcccatgtcactatactgtctaccatgtgtggcaatttaaatgcaaatgaattaaaatgaaataaaattaaaaatccagctcctcaactgcactagtcacagttcaagtgctcaacagctataggtggctggcggctacagtaccgaacagtgcacatttacaggatgtgcctgggactgcagaaagcgccactggacactcgagcttcaagtgccctcttacccgtgctttacttctcttcctggtacctttcaccacctgacctacacagtattcccttatagtactcatggttcgcttcctcctctgagggcagaagctctacaatggcaggcagcttctcctactttgcccaccgctctattcctagcacctagggataactcctcacacacagcacgtgctcaacaaatccgtctccagtgaatgataaataaaatgaaagttctgggtggaggctattctaggtattttcatatgtaattgtaaatatagaaatttagtcttgtgttttgtgaaacacaaatgaaaccacagtatagagcatgtagctgttcctcattcttaaaaacttgctgcctattattaaaacaaacatgttctgtaatttaacaatgccactatcagtaggcactgaggctgtttctggtttttcactattcagacagggctgtggtgctacccttgcccatgcctgtctgtgcccatgtgtgagtatttgcatactgaattgccttccaaggccaggggtggtggctcacacatggagacccagcactttgaaaggctgaggcaggcagatcgcttgatcccagaagtttaagaccagcacaggtaacatggagaaaccccaactctacaaaaaatacaaaaattagccaggtgtggtggcttacgcctgcgttgcagctactcgggggggcggaggtgggagggttgcttgagcccaagaggtcaaggctgcagtgagctgtgttcataccactgcactccagcctgggagacaagagcgagacctgtctcaaaaaaaaaaaaacaaaaaacaaaaaacaaaacaaaaaaaaactgccttgcaaaagaccacaccaatttacttttccaccctttccaattatatcattatttgtttctatttcttgcaaatttaacggacaaaaattgctatttctttgccttaatttgcattttcctgataacttgtgagacagtaattgttacccacttgtatttcctcttcagagaatttgtttatatatttgtgtatctttgtcctatttgttcatttaatacctatttattgatcccctactgtagtcaaggctctgtttgaggtgtacatgacacagatgcaaagatgacaatgtctcatcagggagaggaacaatataatgccagatgatactgagtgtcatgctgaaaagtaaagaatactcagaagtgacagaaatttaccaagaaggtgatatgtgagcagagctctgaaggaagtacatgaacaagcacgtatatatctgggaagaaaacattgcagacagatgaaaagcaaaagcaaaggccctcagcatctgaaaatagcaaggggaccaacgtggccacacccagtgaaccggggaggatggcggaaaggcttctgtagatcactgtaggggcctgcatattctttttgtaaaaatttagttttcatttttatgaaattaataaatgcaactatattttttgtttagactatttactttaaaatttttattttaatagcttgtgggtaaaagtagttttttgttacatggatgaattgtatagtggtaaattctgagattttaatgcatccatcacccgagtagactgcacctaatgtgtagtttttttcactaccccccatcccactctcctcccccttctgagtctctgaagtccattatgtcactctgtatgccagcgatgtccaatctttttggcttccttctttttggaaaaagaagaatcgtcttgggttacacactaaatacactaataccaacgatagttgatgagcttaaaaaaaatcgcaaaaaaactatgttttaagcaagtttacagatttgtgttgggcagcattcaaagctgtcctgggctgcatgtagcccatgggccacaggttcgacaagcttgttgtatgtctctgtgtactcatagcttagctcccactaataagtgagaacataacagtttgtgattttccactcctgtgttacttcacttaaaataatggcctccagctccattcaagttgctgcaaatattattttgttccttttaatggctgagtagtgtatatataccatattttctttatccactgattggtggatgggcacttatgttggttccacatctttgcaattgttaactgtgatgctataaaaatacatatgcaagtggttttttttttatataaagacatcttttcctttgggtagatagccagtagtgtaattgctggatcaaatagatctacttttagctttttgaggaatctccatactgttttccatagaggttgcactaatttatattcccaccagcaggtataagtgttctcttttccccacatccatgccaacatctaaaaggccattcttgcaggagtaaggtggtatctcattgtggttttaatttgcatttccctgatgattcgtgatgttgagcattttttcatatgcttggccatttgtacatcttcttttgagaaatatctatcatatcctttgcccactgtttgatgggattgcttttttcttgatttgagttccttgtagattctgaatactagtcctttgtcagatgcatagtttgcaatattttctcccactctgttggttgtctgtttatttctttgatgtaactacttgaaatggtcaaatagttattcaaagttaatcaaaatagtagcttttgaaagggcattcctatccccattttctgatgtccagaaattactttcaaccctaattaattctttagtacttcaatgtgttgtttgttgttcaatacaaactataacatcaaatttgtagtgggagggctgggtgtggtggctcatgcctgtaatcccagcactttgggaggccgaggagggcagatcacctgaggtcaggagtacgagaccagcctgatcaatatggtgaaaccccatctctactaaaaatacaaaaattagccaggcatggtggtgggcacctgtagtcccagctactcaggaggctgagacaggagaattgcttgaatccaggaggtggagattgcagtgagctgacatcacgccactgcattccagccagggtgacagagcaagactccgtctcaaaaaaaaaaaaaaaaaaaaaaaaaattgtagtgggaaatccatcagattacagagaaaagagaactccaggatgtttctgataggaacataaataaataagcacaaacactttggagaacaactggtagcaacgtgctaccatttcttcttacaggttagggagacaaacaggactgtttgtaaaaggtagattcaatcttgctgtgaatttgtacagaaatgaataaatgattatttatttacagaatggaatgctatatggcagtttaaatgaataaactgtacctacattatctgcatacataaatctcaaaagttgaatgaatgaagaaagcaagttgcataaagatatccacaatacaccatccttatgtaaagttttaaagcacagcgaaatgtgaagtaaaagtgttaaaacatggcaggaagaatctacaccccacttcttgggcgtgcttgctccagcggggagaataaagaaatggaataggagaaggatgcttcagctctaattgaaactttttcttaaaaatatcaaatataaataaaatgttagcactataaaacctgggcaacaggcacacagtttttccatgacataagtgttttataataaaacttttaaaaaactaaaatacaatgttaactagtaaaatactgaaaatgaaaatattcatgctaggtgtggtagcttatgtctgcaatcccagaactttgggaggttaaggtgggtggactgcttcagcccaggagtttgagataagcctgggcaacatggtgaaaccctgcctctacaaaaaaatacaaaaattagctgggtgtggtggcacacgcctgtagtcccagccactcgggaggctgaggtgggaggatggcttgagtccaggaggtggaggttggggtgagctgagatcatgccactgcactctggcctgggcaacaaagtgagaccctgtcaaaaaaagaaaggaaagagagagcgagagaaaagagagaggggaggggaggggaggggaggggaggaaaggggaggggaaggaaggggacggaaggggagaggaggggaggggaggggaggggaggaaggaagggaggaagggagggagggagggagggagggagggaggaaaaagaaaatattcgtaataaaggagttacttcctgcctcaggttcttatttccaaaacagcaaaagtagctcattaaaaactaatcatccttaatcagtcttaaattgcttagtatttatttccctctggagtattttttcccctttatttacatctttttttgcactcttcccattatttgattctactggtctcttttcagggtatttctatagaattatttgtgcttttcattttctcacccttggacagaagacaagcagttcacagaggtttttaaagtctcctggaccacaattaaaagactctgctggatggtatcagctgaaacaatcttcttttctctttctttctttttgagacagggtcttgctctgtcacccaggctagagtgcagtggtgcagtcttggctcactgcaacctcaacctccccaggctcaagcgatgctcccacctcagcctccctagtagctgggattacaggtgcttgccaccacatctggctttttttgggttttttttttttttgtagatatggggtttctccatgttgcccaggctggtctcaaactcctgggttcaagcaatcctcccaccctggcctcccaaattgctgggattacaggagtgagccactgtgccaaggctgaaacaacttttatagattaaaaatttgcctttgtgccagattgtgccactttggaagaggtttattctctagtttataattggtttttggtgttgttgttgttgttaagaatgcttgtttttcaaaagtaatatgaacaaattccctggcacagagcgaagtccactgaaggatgtccatgctggcatcccagctggcaggagtagcaaggataaaattggaattaatttagttagcagttcaggatattcctagtcaaagcaaagctatgatacaatcagtaaaattcttaactgaatttactaagaatatgagatgcctgtgctagcagagtgctccctgtaaaccaacacatccgatacattcctaatttgctctactgaatgatgtttagaatcttttctttaaagaattttataattcaaccagataaatttgtccaggtacttttctgaatgtgttgagcccttatatatagtttttaagataattcaatctcttggactgagttcatttatacctatcagaagattgaatttaaaaagcaatttgatgcgtaacatgctttttgagcccttttagaagcttttgtgatcaccattcataaaattttaacttggattcttaaaagcttgtgtgagaacaaaacttttcaagtccacagttctccagtgaattataaattctgccaagtgtattcttctatctcaagtagaagccggtttaatgaaatcaggtaacatctctgacaccatgataacctttgcaaaacagctgtcaaccacgctgcagccatcataatttttgctgtcattaataataacaattaaaataggtatcataataccacataactttctactacatatctgaagttctctgtccacttttaagatttacaaattgaaacaattaaatcagaacacagcataacaggcaaactactttccagtatatgcttaaagtcaggagagtcccatccacctatgaatctaagtttctaattcctctcctttcacaagtatgacttcaaatgtcgaagcagccaagagctcccaaacttaagcaccatataaacaatgctatgctgttttcctgtgtttttttttccttctagaaggcatctatgcatttattttttctaattttttagcacttcagtgtctaaagttcatttccaaagattcaaaaagtctcagaaaatatagaaattgatctcataatttcagatgcacagatcgccagaggaacaaaaaaagtgggaaaattagcttactttctttttgcattatttttagaggcctgataaatggtgttgtcatagggctttaaatagagtttcacttgccaccaagtaaagtcaacaattcagtgacagaatgtttaaattctatcctattctttgctacaaaccatctagaaggagcaacattctgagcatcgtcagcttatcctgtagctctatggtttggggcagatggtttggaagctacaatacaaccacacagaaaggatgttcccagcagtacatggttaccgtctagccttctgcagttgaattcttgtgcagaaattatttggaagtgctgctctggcaaccagtcaagacctaatgcttagtgtaattcaatctggaaagtgttgcgtaactctccacttgaacttggatctccacactctgacaaacttcagaccaaaagaggagccatgaaggctgcgtgcaccttgaagttcttgggaaggttatcagttggcctgcccaaattttggtatacccaagaactacctgtctttatgagattttttaaatttttcaggaaaattatcctggatcatttccagcctaaacagaagatataatctgcagccatgaactgcaatacttgataaatgtccccagaaccacagtctttccacccactcagtccccagtaataatctctgactcttctcatttcctcttttcagatgagagaaaagttgcgcttagagatcttttagggaggaagattgatgagtcaggctggagacctgcctgcctatttgagacgctacatgagtgatgcacacaggcaactctccggcctacctttcaattgcacaaacatccatcccgccctaactctatgcaatatattctgctaggctatgtgcaaagtatacaccttcacacacacccccacatacctcttcctctaccagcccacccactaagctcatatattccaaaaatttaagatatttacaactcatgctaaatgtgtctttttgttaacaacttagatgatagactcaaaaagcatattaattaattttagatctaaaaccatcttggtggtaagagaacgatgataaagcactatggaaggtaaatgttgaaaggatatctgccacttaagaagcggtagagaacaggaagaacaatttagaaaaggtgaatatttgaggagaaaagacaaactgttcacacataatagatcactatgggtagcttggcaaaaaattatctttatgagaatttactattatcaagaatacagcaaaaatattaacaatttataggaattcatcaacaaaaataaaaaccgtaaataaaattctatcatgtcaccataaagtattcagattgttaccagggattgatatgcagttatgggaactgcttctaaagaagtagtgtagagcagcatttcttgaacttccagagagtatgtctggacagatgtttttaaaaagtcatatttcttggtctctgcccgagggatgttgatgctgctgattggtagggccacactttgagtagctctggtgtagaactgctacacatcctgaggactcaaaggcaagacctatgaagaatggtgactctcttaatctagtcaagagaaaataagatgaaaatgtaacctaagagactgcatcaagcaatgaactaaggacacggatgtcctagcattcatgctatactcccaactgctagaaatgatggaagaattttttttgacctttttttttttaattatacttcaagttctagggtacacatgcacaacgtgcaggtttgttacataggtatacacgtgccatgttggtttgctgcacccattacctcatcatttacattgggtatttctcctaatgctatccctccccttgccccccactccacaacaagccccagggtgtgatgttccccaccctgtgtccaagtgttctcattgttcaattcctacctgtgagtgagaacatgtggtgtttggttttctgtccttgtgagagtttgctcagaatgatggtttccagctacatccatgtccatgcaaaggacatgaactcatccttttttatggctgcatagcattccatggtgtatttgtgccacattttcttaatccagtctatcattgatggacatttaggttcattccaagtctttgctattgtgaatagtgccgcaataaacatacgtgtgcatgtatctttatagaagcatgatttataatcctttgggtatatacccagtaatgggatagctggatcaaatggtatttctagttctagatgcttgaggaatcgccacactgtcttccacaatggttgaactagtttacactcccatcaacagtgcaaaagcattcctatttctccacatcctctccagcacctgttgtttcctgactttttaatgatcgccattctaactggtgtgagatggtatctcattgtggttttgatttgcatttctctcatgaccagtgatgatgagcatttttccatgtgtctgttggctgcataaatgtcttgagagtgtctgttcatattttttgcccaatttttgatggggttgtttgttttcttcttgtaaatttgtttaagttctttgtagattctggatattagccctttgtcagatggctagattgcaaaaattttctcccattctgtaggttgcctgttcactctgatggtagtttcttttgctgtgcagaagctctttagtttaattagatcccatttgtctattttggcttttgctgccattgcttttggtgttttagtcatgaagtccttgtccatgactaggtcctgaatggtattgcctagattttcttctaggatttttatggttttaggtctaacatttaagtctttaatccatcttgaattaatttttatataaggtgtaaggaagggatccagtttcagctttctacatatggctagccagttttcccagcaccatttattaaatagggaatcctttccccatttcttgcttttgtcaggtttgtcaaagattggatggctgtagatgtgtggtgttatttctgaggcctctgttctgttccattggtctatatctctgttttggtaccagtaccatgctgttttggttactacagacttgtagtacagtttgaagtcaggtagcatgatgcctccagctttgttctttttgcttaggattgtcttggcaatgtgggctcttttttggttccacatgaacttcaaagtagttttttccaattctgtgaagaaagtcattggtagcttgatggggatggcattgaatctataaattaccttgggcagtatggccattttgatgatattgattcttcctatccatgagcatggaatgttcttccgtttgtttgtgtcttcttttatttccttgagcagtggtttgtagttctccttgaagaggtccttcacatcctttgtaagttgtattcctaggtattttattctctttgtagcaattgtgagtgggagttcactcatgatttggctctctgtttgtctgttattggtgtataggaatgcttgtgatttttgcacactgattttgtatcctgagactttgctgaagttgcttatcagcttaaagagattttgggctgagacaatggggttttctaaatatacaatcatgtcaatgatggaagagtttttacaattaaatatataatactgtaaaatgggggcttttggtgacccatgaattctgagaaaagcttgatggtaggtaggtgggatctttttgaaggaaaataccacagccctaaaagcttgccaagagaggactactataaaagataagagttactttggggatgaattcaaggaacagggggcaacctgacagccagctgccaaggccttatacattatacactctttcttcttatccactgtctttaggcaagagataacagaaatgtcctgactccaacaggaaggaggaaggaggaaggaggcctggaaggagaagccagcccgaaatggctatcaacctccaggaaatatgggagtcctctaaggcccagaatacaatttactggcaacctcaatcaacactacctcttgatcttcccataattattggaggctacagtaaacagagcactcatcgagagactaacaaggaatcccaaattccaggaagaccaaattgttctgcaaagtggttgtgcctatttatgttcccatcagcaacctcctaaagctcaccataacctaatggatgtctaactgatgttgttagtttacactttcctgaaaatgcacagaaaagctcatagaccagttttaaattgtggtgaaaaacacattaacatacaatttaccattttaaccatttttaactatacagtacagtagtgttaactatatgtccttatatgcaacagatctctaaaactttcatatcttgcaaaaccaaaactctatacccattgaacaacaactcccatttccctcttcctcccatcccaaggtaaccactattctactttctgcttcttttcttttctttttttttttttttttgagacataatcttgctctgtcacccaggctggagtgcaatggcacgatctcagctcactgcaacctccgcttcccaggttcaagcgattctcctgcctcagcctcctgggtagccaggattacaggcacccgccaccacacccatctaatttttgtatttttagtagagatggagtttcgccgtgttggccaggctggtctcaaactcctgacctccggtgatccgcctgccttggcctcccaatgtgctgggattacaggtgtgagccactgcacctgcccttagcttctgtttctacaagtttgactaatttagataccacacataagtgtaagtaatcatgcagtatttgccttctgtcactagtttacttcactttgcataatgtccttaagtttcatccacactgtagcatatgacaggacttccttcttttctaaggtggaataatcttccaatgtgtatatataccatattttctttattcattcgtccgctgatggacacataggttacttccacctcttggctcttgtaaataatgctcaatgaacatgggtgtgcaaatatctcttagagattttgttcccaattatttggaaatatacacaaatatgggattgctggatcatttggtaattctatttttaattttttaaggaaactccatactgttttccatagtgactgcactagtttaacattcctagcaacagtgtacaagggttccaagtactccacatcctcatcaatatttgtcattttctctttcttcttttgatagtggccattctaataggtgtgaactggtatcttattatggttctgattatcatgtccctgataactggtgatgttgggcatcttttcatatgcttgttggtcatttgtatatattctttggagaaatgtctattcaagtctttgacctatttttaaactggattattttgctgttgttgagttgcaggaattctctgtatattctggatattaatcacttatccagatttaaggtttgaaaatattttctcccattacataggctgctttttaatctgttgattgcttcctttgttgcacagacacttaaaaatttcatgcagtcctatttgtctattcttgcttttcttgcctgtgcttttggtgtcatatccaagatcattgcgaagtccaatgccatgacacttttctcctacagtttcaggtcttacgtttaggtctttcatctattttgagttagtttttatatataatgaaaggtaagggttcaaatttgttttctcaatgtgtatatccagttttcccaacaccaattattgaagagacaatcttttcccaatcttatagacaggatacccttgtcaaagaccatttgatcttccatgtgaagccttacttctgggctctctattctgttttaatggtcaatatgtctgcctttatgccagtaccacactgttttgattactgtggctttgtaatatgctttgaaaaaaggaagtatgaggcttccaccttgtttttctttctcaaaattgttttggttacttggggtactttgagattctatatacattaaaggattctttttctatttctgtaaaaaataaaagaaaaaccaaacgccactgacattttgatagaaataacactggaacctgaagattgctttgggtagtacgggcatttaaaatactaagcataggctgggtgcagtggcttacacctgtaatcccagaactttgggaggccaaggcaagtggatcacctgaggtcaggagttcgagaccagcatgaccaacacggagaaagcccatctctactaaaaatacaaaatcatctgggcatggtggcgtgcacctgtaatcccagctactcgggaggctgaggcaggagaatcgcttgaatccaggaggaggaggttaaagtgagccgagattgcgccatcgcatgccagcctgggcaacaagagcgaaactccatctcaaaacaaaaataaacaaacaaacaaaccccaaaaaaaccatacccatctatgaacatgggatatctttttatttatttatgtcttatttaatttcttttagcaatgtatagctttcactgtgcaaatctttcacctccttagttgcttattcctaaatattttattctttttggtgctattgtaagcaggattgtttttaaacttcctttttgggttgttcttattaatgtatagcaatgcaactggttttgtgtgttgattttgtatactgcaactttgttgaattagtttattagttctaacaatttttttgtgtgaaatcttttaggattattaacatataaaatcatgtcatctgtgaacagagacaattttattccttcctttccaatttggatggaaagaatttggagcatctgttgacctttatttctttttcttgcccaattcctctgacaaggacttctgatactatattaaatacaagtggtaagagaggatgaagatattcttgccttgttcctgatctcagcgggaaaacattccctttttcaccactgagtatgatgttagctatggatttttcaaatatggcctttactactttactacattgaggtcatttccttctattcctaatttgtttaaggttttaccataagtgagtattgagttttgtcatatgccatttctgcattaagatgatccatgtggtttttgttcatcattttattaatgtggtgcaatatagtgatttttgtatgttgagccatccttgtattcaaggaataattttcattcagtcatggtgtttatacatatctttttaacgtattgttgaattccctttttgctgagaatccttccatcatgattcacgaaggatattaatctgttttcatgtagtttcattgcctgattttcgtgtcagggtaatgcttgctcacaaaatgagtttggaaatgtcccctcttcttcaatattttggaagactttaagaaagactggtgttaattcttctttaaatgtctgatagaattctccagtgaagccatctggtcctggtttttttctttgttggaaggttctgaataaccaattcaatctctttactagttgtaggtctgttcagatgtttttatttcttcattattcagtcgtgtaggctgtatatttttagacatttatttattctaggttattcaatttgttggtatataattgttcatagtagtctcaatctttttaatttttgtggcatcagttttaatttctattctttattcctgatttttgctattaagtcttctctttttttttcttagtctaaggaattgtcaattttgctgatctttacaaaaacccaactcttagttttttcttctattctctattttatttatttctgttctaatctttattagtctctcccttttaactttaggtttagtttgttctttttctagttgcttgaggtgtaaagttaggtttctgatttgagatccttcttattttctttttttttcttccttcaaaagcatgtacactttcttcttttttaatgtaggcatttaccactataaacttcctgcttagaactgcttttgctgcatcccataggttgtgatatgttgggttttcattttcatttgtctcaagttattgtctgtgtttcttgtaatttgttctttgactcactggttgtttaagagtgggttaatttccacatatttgtgaattttccaattttctttttgttactgatttctattcccttgtggtcagaaaaaatagttactatgatttcagtcttcttaaatttgttaagacttgttctgtggcctaacatgtggtctttcctacagaatgttctatatgtgcttgagaagagtgtatattctgctgttattgggtagaatgttctctatatgcctattaggtccaattggtccacagcattattcaagttctatttttttattggtcttcagtctggttaatcaatatgttattaaaagtggggtggtgaaatctattattattgtgttactgtctctttctcccttcaattctattggtatctgcttcatatatttggatgctgtgttaagtgcatatattattgtaattgttgtatctccctgaattgacactcttattattatataatctttttctttgtctcttttgatagtttgatataagtatggctatgcctgctctattttggttgccatttttccatcttttcattttcagcctatgtatctcaagtgagtctcttgtagctagaatatagttggatcttgttttctgatctattttgctattccacatcttttgaatggggtgtttaattcatgttcacctaaagtaattactgatagagaaggacttactattgccattttgttgttttccatatacctagtagttattctgttcacgattttctcttattcccttcctttgggtttcattgatttttttcatagtgacatgctttccttctcattttccattgtacatctcctacaggtattttcttgttgttaccatgggcattacattaaacatcttagagttataacaacctaacgagataacttcaatcacatactaaaactctactcatttacatttccctccccagtttatgttatcaatatcacaaattacatccttttctattttgtatctatcaacacagtttaatagttatttttacacttttatcttttaagttctataccagaattaaaaagtgatttatgtacactcagccctctatatctatgggttctgtatccatggattcaactaaatcatggatcaaaaatatagtatttgcaggatgtagaacccaaagattgaacgtttgtatctgtaagttccatacagtttactatgggactggagcatctatagattttggtatgtgtgggaagtcctggaaccaatcctctctggatactgagggacaactgtactatacaacacggtattataagattttgtgtttgtctgtatatttacatttaccagaaggctttatatttttgcatgctttcatgttgctaatattctttcatttcaacttgaaggactccctttagcaattcttgtaaggcaggtctaatggtgatgaactccttcagcttttgtttatctgggaatgtctttttttcttcattttttgaaggatgatttagcccagatgcagtattcttgattggaagggttttttgttttgttttgtttcctccctggctctttgaatgtatcatcccactcctttctggcctgtaatatttctgctgagaaatccactgataatcttctggaaccttccttgtacatgacaagtcacttttttcttgctgctttcaagattatgtctttaacttctgacaatccgatttttgtgtatgttgttgtaggcctctttgggttcattctttggagtctgctgagcttctgaaattaggatatccaattccttcctaatatttgggaagttttcaccattatttcttcaaataagttctctgcccctttctctcttattctaggactcacaaaatgtgtgtattgttccatttgatgttgttccacaagtgtcttaggctttcttgactttccttcattcttttttctttttgtttctctgacttaataatttcaaatgatttgtgtttaagttttctgaccctttcttctgtttgatcaagtctactgctgaacccctctagtaagtttttcaattcacttattgtggttctttagctccagaatatctgtttggttcttttctagtttccatctctttgttgatattctcattttgctcacatattgttttcctgatttcatttagttgtttatctgtgttctcttgtagtgccttgagatcccttaaggcaattatttcaaatacttagtcaggtaatgcatagatctctgcttctttagggtctgtttctgtagatttattttcatcccttgattatgccacgtttccctggtttactttgtgtcttgttatttttgttgtattttgtacatttaaagaaacatctacttctctcagtctttatcgactaacatggtacaaaggaaggctttcaccagtggacccggctagacattctggaggtccctcaaaccttttccagggatatatcttctctgggcttatgcgtgtgatttccaaattagagggctttactggtttttcaagagctcctaatcttcccctcccctctagtgtccgtttgtggtattgcagattctccagtgctgcaacaagctgctgagctctcttgttccaaactacgccatttctctgtcagtgctgtgagtcaggcaagacagataccagtccctctagtaggcccctgagaagccagaggcttctcttcccctcccaaagaacaggtcatgagctaagtgcttcctcccaattctgttgagctatgccagcctccatcggcagcactgtcaattctctggtgctaccacaaaccactaagctttcttttgttctccatggccccaaggcatcaaaagtagtcttcctttatctgcagttttactttttgtagtttgagctagccatggtcacccgtggtccaaaaatattaaatgaaaaaattccagaaataattcaaaggttttaaattgtgcactgttttgttcgagatggcaccttgctctgttgcccaggctggagtgcagtgatgcaatatcagctcactgcaacctccacctcccaggttcatgtgattctcctgcctcagcctcccgagtagctgggactacaggcataagccaccacgcccagctaatttgtacttttagtagagatgcggttttgacatgttggccaggctcgtcttgaactcctgaaatcgggtgatctacctacttcagcctcccaaagtgctgggattaaaggcatgtgccaccgcacctggcctaaattgtgtactgttctgagtagcatgatgaaatctcatgctgtcccactctgtcccatctggaacatgaatcatccctttacccagggtatccataatatatacactacctgctcgttagtcacttagtagccatactggttgtcagatcaactgtcacagtatcactgtgcttgtgttcaagtaactcttattttattaatacttaataatgacctcaaagtccaagagcactggggctggcaatttggatatgccacagagaagttgtaaagtgctttctttaagtgaaaaggtgaaagttttcaacttaataaggaaagaaaaaaatcatatgctgaggttgctgagatctatagtaaaaacaaatcatctatctgtgaaattgtaaagaaggaaaaaaatttctgttagttttgtcgttgcatctcacatggcaaaaattacagccatcatatatgataagtgcttagttacgatggaaaagacattaaagttgtgagtggaatacagaaatgtgttatgattggtggcaatcaggtttggtactatccacagtttcagacatccactgggtgtcttgaaatatattccctatagataaggagggattactgtatgcgatttcctcatcagtgctcccggtcagtagagacagaaatcagttcctcagtctgcttcctaaaaagtgagaatgttggatgcacattccactcttctttttccctcccaaggaagagaagccacaagctgggtttttcctaccaatctcaccaagctgccagacctggaaaagggctatcacagttgacatgaaacagattgtttaatcaatttcaatgtggctattctagactttgagcttgcctgcagtactgtgacttcttaattggttctgtagttctcactataattttttgggatgtatgctgtagttaagtcaatgtctctactggaaaataaggtctaggacttcctattctgccatcttgctgatgtcattcctgaagaacgcctttaatgttattattaattcagttttcatcttctagtaatgacctgcttatattccttgctcatttctataacggagtgtttgcctctttatgatttatttttgcaagtcatttctatattttgcattctgatcctttgtttctatttgttaacagattttaaaaattattttgtttattgtcagctgctttttaaaaaatcaactgtgatgcatattttgggagtttggtgtagggagtacatacacactgcactgactgatttttaaggtctttttgaataaatttataattacataattcaaaagatccatcagtcaacattcacctcacaaccaaatccaagtctttacctgacatgtaaataaataaatctaaacactctccatgtctcctatggttcttcttacattgccaaatccaacataatgaagattatctccaatgttttcctctaataattatatagtttaagggttaggtgcaaaggattcctaaaggttgaggacaaagacaatttctgatagagcttgaattagcaatagctttacaaaaaaaaaaaaaaatcaccaagtccctcagtcccagattctcttggttaatgatatgtcaaaaatgaaatgcccaccaatgaaaactgagattcttttacagagtgaagaaacatttgtaatgtgattaattgccttttaatttgtctgaatctctttgatttgtttagtctagattttggaatatcatgtttcttaaaatagggcatatgttcacatcaaatgttgccttgtaaatatcgtgtgtgtgtgtgtgtgtgtgtgtgtgtgtgtgtgtgtgtgttgggagcagaagaaggcagagccagggcaggctagtgtgagagcatacacttgcatctgtgcacattctcctcttgcagagtgagcaatcccagggtaaaactaagtactgctctttcttttatgctccctactgtgtatgtagggctttctacctaatgggcccacaaaagacattgtatgatttacttactgctctgtgagagttgagaaaatagtgatttttaaaagagtttgaaaaaactcaccaatttgctatgtattccactaaaataatctttctatataaaatacaaccataactgaacatccatttcctatgaattgtaaaattttcctctcataaccaaactgatacattttgaaacctgagaagaaggatgtttagtttaacacctaccgcctttgagtgttaaatccattaagatgattctctctgagttcagacgctaatgataaaaccatctgtaaaacaaaatcagttgcaggttaactcacgctgcaaacaggattacatcagttctatttttcttggtgtgagtgatatttccgttgagattcccccaacccccatcttctcatgtttcactctgtcagagtgaaaaggaagcagtgccatgtcacatttactaataattgggattttatgtttaatgtctataattctgcattcctatttaagcaatgaacaatagacaggtcattaatttcctaagaattaaaaccaaatccatttaaagaaaagttagtttacttcttcatttaaaattcagttcatttgaaaaaaaaaaaaaagttgttattgtacaaagcttccaaaacaccggaatggttaacaaacattaaaaaatctcataacattttttagaagagttacatcaagtttgtaagttaaaatttctcacatttggctataatttaagccagaagaaaacaatgctttaatattaagaggtaaatatttaaaactatgtactgaattttctgttttgctttaacagaaaattccaatcaggttatttgaaatacaagattctttcaacagtacaagactgtgtttataatagctaagaacagctcttctcccaaacatctctgagtgaataagtgagatgtgtccctagaaagagaggctgattggttggtttaggaaaacccttcctggtttccttctttctcataacttcccatctcacatttcttccgtacatggccataagtctgcccaaggtaagaagagataaacaaagaaaagttaaacatctcttctggaggactgaaatatttccatttactctttttgctgatggcacattcagcattaaacatttcaaaagtgataaattttaaatactcacatttttaagcaaaccaggatagtaatctataggtgcatacccaagaccttgagtgaaaagagcaacttctttatcaaatctgagtgctgaaagtatatgagataatacaccctaaaaaacataaacagaaaaagttaacttctttaaaagtaaatgcaagtgccttttatgtacaatgcctacaatttatttgtacatgggggtggtctctatgaaacaaaaaaatctgtttgtcaaagtacccaatttactttgattcaaagtgtaaaagagaaatgttagcattaaagttaacacattaaaaagaagtcaatttaaacaaacattagcagtgaaacaaaaatatatatcatcaatgagcagtgctttacctatattaagaatggaatctttattgtttttaaactcagtaaaatatgtttaacagagatgataatttttctttgctttttttttgaggtcagatgggtaacgtgccgatgtcatacaaggttcaagggtggcacattgcacacacatgcgtgaaacacccaatcatcacgctcatgaactacaaaaggatccagatattagaatttaatataagatagagaacacatcacaaatcagtagggaaaggacagattatgtaataaatggtgcctcaaaaactatctgtaaaaagaaaaaaagattctcaccgggtattattcatcaaaatatactccagtttaatgtaaatcaaagagataaatgtaaaaatgaaataatacacaagaagaaaacatgaacatttttcaagtatctgaatgagaaagaactctgagaactgaaaatcctgggagtaaatcatcagggaagaggcttggctgtgctcaataaaaataaaatcttgtgtttaccagaaaaataatatgagcacaaactaagaagaatgttaacaacaaacagtacagattctatattatcaaattaatgtacaaaatatacgacaaacactaagagcataacaatgaatatgaatagataattcataaaatacaaatagctaagaaacacataaatgaatgttcatcctccataatcaaaaagggtagggtaaaacacctgtatggcactttcacttaatgaattcaagttttttacagacatgaatagctaagctgtatggggttctatgaaacatgtactctgtgtgagctcctggaggaatagaaatagggtcttccatacagagtgcagttgtgaatggcaccgaggcgcccaaagtgtgagcagaggcaacacagcccggaacccatcatgaagcttggacttccaggggtgtgtctgcctagaggtttgtcacctgaacaaagaccgattacgggctaacagaggccctgccttatagaaagcaacttgaaaaaaatatattaaatgtcttcaaaatattcagaacctttgatatatgtggcatacatttaaggaaataaatgcaaatatgatgacaggaactatgctcgaagatgttcactatagtggttatttctcatatagtaaaaattgtctaacagcagagaatgattaatatgcttatatagtggctcactgtaagccactaaaatgtttacaaaggggccaggcacggtggctcacacctataatcacagcactttggaaggccgagacgggcagatcacttgagcccaggagttcgagactagcctgggcaacacagagaaatcccacctctataaaaaatacaaaaaaattagctgggcatggtggtgcacatctgtggtcccagctactcaggaggctgaggcaggaggatcactcgagctccagaaattgaggctctgcactccaggctgggagttgagagtgagaccctgtctccaaggaaaagaaaagtttatgaataattttaatagtatttaaaatggttatattatactactaaatgaagaaagatgtaaaatgttatactcagaaatgatctcatcaatataaaaataatccataaatgagaatggaaaaacaatggaagaaaacatcactgtcttagtctgtgctgctatggcaaagtacctcagactgggtcatttataagagcaaaactttatgtctcagttctggaggctgggaagtccagaaccaaggagctggcaggttcagtgtttgctgaaggcttccaaggtgatgccctgttgctgtgccctctagaggaaacggacactatgaatgctgtgtcttcacatggtgaaagggacagaagggcaaaaagggcccagggcactctcttccacctcttataaaatcaccagtctcattcatgagagctctgccctcatgacttaatcacccccaaagcccctcttaatattatcacatgggtgattaagtttcaacacatgaattttaggggatatatttagatcacagctatcaccaaatgttagcagtttctagggtggtgctagagacccataatagtaccaccctagagactgctaacatttatattaacattatatatatatattttttttcttcttctttctacttaagtacaatttcctagccttccatacatgtatgtgcttcttttactaccaggaaaaatattttttgaaaaagttttatttggaaatatttgatctttaaaaaagtcctatactgcattttgtgataacacattacaagataaaatgaatttgcatctgtgcatataaatgtatgtatgtaacttcatacacaaatacttggagatgacagtctaatccagggtggaggctaagggtgcctcagtgatgggcaggcaggctccatagacccgggacgacaagcacgtggcacacataccagtgacactctgagtggttaccattatcacggtggtcatttcaatttcatcataaagtatctcacacatccaaaaagatacaaaatattatgtcaaattccacaaaccttcaagcttaatcagtaaacattagaaatacagaagaagccttctatgccctctgcccttccccatcatgattcaacagccctacccctgggggaaactctaccctgaatctgggatgcatccttttgtgcagatcatgtactttctccctgtgagctcacccctgcctccgtatccttaaaagagaatccaggcaacactcctaagtcatgtaagtggaaacctgccatttctacatgacatcctatctacagttttcaaattagaattgcaagttaacaaagtagctttaaaacattactactcagtagaagacgttcatgattaataaaaacaacaacaaaaaacccccagtaatatgtactacatgatttacaaaaaaatgaatccactggaaaggggtaaaaacaggaaccttacagagttagagagttagagtgaaccttgcttaaggtagagagaaggatggggccacttgcttgttattgttttttccctctttcagttcaaatctgccgcaaatacagaaagcaaataggagctgaccatagccccaagagagttcgtctccatgttggtggtgttctcttccaacaccaagtgcaatctgggagagagagggagcagccatggctgggtgggcagagtcagggagctcaggtacaagccagcgtgccatctgtggaagtgcttactgccagctgcgcttactgctggactccactgaacttgcgaaggcggagggtggggcctgcacagcagggagagcacttggtgctcttagcaagccaggatggagcctgaatccccagtggggtgcagtgcaggtgttctgggaaaagggaaagcccggccaggtctggccagccatatgtcaaatccacgcggaggtgtccaagtcagacccaggcagagaagggaggacttggtttggaaagtaggtgggctccaagtcggcagcagtctgggtttgcacagagcaggtcagtctgatgctaggtgaggggagggcagtgtcagaagaatgcaaccttctgctcagaaaccagacttttgcattctatttaacactcatttaaagcatttactacacaccaggggctgttctaagccaattacaaatagcaactcatttaatcctcacagcctacgggtaggtactgttactgaatctgggttaaagaggaggaaatcaagacagtttaagcagcctgcccaaggctagttatttactctatggccaaaccttataatgaacctccctgtatccactgtccatgagactgttgggatagtttttaacaatgcaaatctgaatgctctcagtctgagacccttacagcttccagttactcttactgtgaagcccaaacttctcaaagtgaagcagcctggctcaccagcacaccccacacccgccaccaggcttgacttctccttacaagcctgtttgcgaccctggagggccacaggctttttgggccatcaggacttcagtatgtccaatcccctctgcctggggagctctcctatgcccctcacttgtgagaattgacttcttgaaggaattctagcaattgtgacaaccacaatttaccaagtgcttacaatgtgtgaggcactatgttctctaagtgtggcatctcactgaaaatcccaggctcagtttttaatcaaattcaattcagcaaagtttcaattaagccacccataaacaggtggctactgttattgtatatcacaatccacccttaaaaaattagagcgcaaggcgctacaaacctggttgagatggaaagtaatgtagtatgtaattgaaggaaaccagttttgagcagtaacagctaagggtcagttaagattgtagatgttaaacaaaaccatgcccaggctttcccctaacccacagcctcccagaagcactcacaccctgggcctgggaccagctcacggagggtgacttcccaatactgtatgagctccgtcttgacatttgatagattcagagggtgagatgagagattgtaaataattcttaagtaatgtttaaaatagccacaaatagttccctagatattacagtcatgtatcacttagcaactgggatacattctgagaaatgcttcgttaggcagtttctttgcgtgcaaacatcacagagtgtacttacatgaacccagatggctcagcctgctgcacacctaggctacatgggagagcctattgctcctgggctacaaacctgtgcagcatgggactgtacagaatactgtaacattgtgatctaaacctatctaaacatagaaaaggtacagtaaaactatggtataacactgaaaaaatggtacacctgtataggacacttcccatgaatggagcctgaagaactggaagttgctctgggtgagtaaatggggagtgaatatgaaggccgaagacatgactctgcaccactgtagacttcacagacactgtacacttaggctacactaaattcttaaaaacttgtttctttcttcagcaataaactattcttagcttaccgcaactttcaaatttgataaaccttttatttttgttgaacttttggactattacaatcaatgctttgcctaaaacacattgtacagcggtacaaaaatatcttctttcactatatccttatatcataagcttttctattttaattttttaatttttttttactttttaaacttttttgttaaaaactgaggcacactgccacccagacacttgtcctggtcacttcaacccctggctcactgttgtgctggtgtgaatgcaaaccccgctctctggctgccaagcatgcatgtggccaggacagcaaatcaagcattcaagctccaggcaagaggtcttctcaggttcccaaacaggctttccagaattcccccaagacactgagactcagccccttcaaggccttgctgccaaagagaatcagagaggggatcggggagccgttcagactctccagcccaagcttgtcagtgcacagctcaacacaaatttgtaaactttcttaaaacattataagattattttttgctttttttttttaagctcatcaactatcactagtgttagtgtatttaatgtgtggaccaagacaattcttccaatgtagcccaggaaagtcaaaagattggacacccctgctctagtctcttctgtagtgaaaatggacttgtacccaaagaggcaactcactgtccacaaggacaccatcccagatgctgagcatcaacctcctgcctccctggaacagaccttatctgaatcccatcaaagcccacattgtcctccagcctctaacgtccagacatgtgccagaatagcccctcagaactgtcttgatgagatgggacaaggggtggtggagatccaggttcagaatggccgccttatccctgacttctgagaggtctgtacctgctggttggagccctcactccttaggaggcttggcccatgtcccaggaagtgccccctaaaacgaccttccggtctcttcctcctctgaggggagcgccctggaatgagtccctctgtgctaaggaacacgacctccattcgcacaaccaggctgactggcgccctgtgcccggaggcaggaagagacgcaggatccagcttgtgtctgtgcgtctgtgtttctccagctgtggtgcctgtgcaaagagtggaaccccaaagaacactgggtggtcaacacacggacacagcacccaatacaagtatgtatgtttaagctgaataacaatgtcatataaaaatgttatttcattttataagaaaattgagttaaattttgtaagggcgttaaaatataattttaataggaagctatgaaaattatctacacttggtgtacaaatgactgaattttgggtaactctgtaaaagccacttatgggtgtaaagaggggtctgtcacttactttataagacatcgacttccaaatctgtggtgtttttaaccagtgccctctggtgatactaacatttcttagcctgaaggagcatttccatggaaaccataatagagatttcgctaactttggattaaaataattataaaattgcttggttggtttatgctcgttaaccaaatgctcctacagatagcatattgcacatgtgttttgatgtgttctttcatctaaggtcaatttcccttagtttattcatcaaattttatttactttagataaaagagaccttgtagttagcatgtgctctatgaatctgtactttgttagaaatacaaactctcagacaaaaccctgacctattttatcaaaatctgacctatttcattaaaatctggatttaaaataatatttccaggtgattcatatgcacattaatgattgttactagctctgtcacccaggctggcgtgcaatggcacaatcttagctcactgcaacctctgcctcccaggttcaagtgattctcctgcctcagcctccagagtagctgggattacaggtgtgtgccaccacgcccagctaatttttgtgtatttagtggagataaggattcaccatgttggccaggctggtctcgaactcctggcctcaagtgatctgcccacctcagcctcccaaagtgctaggattacaggtgtgagccaccatgcccagccggtattctattcttaagaggataaaaagttatatgggtgtactgatttgtcaaaaaggtacaataaagattatacatgtcaatgcacatacatcttatcttataaaaataaaaaaataaagggatggggaatgagctgaagtatagatgaagcagaaatagcacatgatgagtagttgttgaggctgagtgtcaggtctattacaccattttgtttattttgtatatgtttaaaatgttctgtaataaaacacttgtctaaaaagacaaagtttatccataacattagctcttaagattttggctacctttggagaggaagaaggaagaaagtggatgtcagaagcatgaacaaggctgattctatcttgtggttacaaaaatgtatttgccttgtaataattcactgagctttatcttaatgctttgtgcatgtacttctgtatgcatattatgtatcaataaaaatttaaatattaaagagaaaaactgaagcacacacattagctgaggcctacacagggtcaggtaattaatatcactgtcttctacctccacatcttgtcccactggaaggtcttcaggggcaataacaataacatatgtggagctgtcatctcctgtaataacaatgtcttcttctggaatgaatccctcctgaaggacctgcctaaagctgtcttacagttaactctttttttttttttttttttttttttgagacagggtattgctctgctctgtcacccaggctagcaatcacagttcgctgcaactttcaactcgtgggttcaagcaatcttcccgcctcagcctctcaagtagctgagactgaataagctgaggcttattttttaaatttaattttattttttgtagaggtaggtctcagtatgtcactcaggctggtctcaaactcctggcctaaagtgatccttctgccttggtctcccaaagcactgggattataggcatgagccaccacatctggccaactttttttttttttaaataagtagtacactctaaaataacaaaaagtatagtatgttaagtacataaaccaataacacagccatttattattatcaagtaattatgtactatatataattatatgtgttatccttttctatgactagcagcacaggatgtttgtttacctagaatcaccacaaacatgtgaacaatgtgttatactacattataacacctatgatgtccctaggtcatagacacttttcagctccattataatcttatgagaccactattgtacatgcaggctgttgttgatcaacatgtcattataaggcacatgactaaacttccaatgtctgcattgcacgagctgactttaacatataatgtcctggaaaaatgaaaatgtagtatctcacttatctgcaagggatacactccaagaccctcagtggatgccggaaaccttgaatgtacctaacctttctctctcctctctatatatacacatacacacacacacacgtacacattgtgtgtgtgtgtgtgtgtgtgtgtgtgtgtatgaaacaaaattacatattttaatttacgtttttccataattctgtaatataagtggctatgaagtgccacaagagttttttccctgaataaaataagtgttaagtcctagaaacaacatacagaggccagtatatggttacgtagttttcaaacagacacctcaaactttggtcctctaaatttttattttatagtaaacttaaatattgatgagcatttctcattgctaagaataattttttttaccgccacctagtggtaaatagtctaaacacaaaaccattaaagattaggcattggctcttggacaaaaataaattcctatagtcatataataataggttctttctcaaatgctggcagagtgatcttggagatcctttactctaactccctcagtttactaatgaagcactgagtttctaaatatacaaatcagtatttaagaaaaggatgtggatataaatgaacaggttcagacataaagatgtacagattttatcatcctgaccactgatataaaatctttcatgagtagaaagtatgggaaccaagatggctgtatctaaaatgattttaagcccaatttcgattcatgtaaaagaatgaaactctgctcatgtgtgaaaagccattgaatgtgcttagatcatgcgagtgaactttcctaagaaggggagttttaaataaagcagagggaaatccactgcccttgcttttgggtgctgttagttgtccttgcctcactgtatctgctccctcgtgtaacaggcagcacattcgcaggcaggttaggaaagctggagcaatgggttgtggcttggaacatggtctgggtgtggaggaagggttgtgggttttgctcaggcaaagggctaggagagccaaactgtggtcagtattctcaaactaagacagagcacgtatattatgcttctctaaacaatttcttcatctgatcattaaagtcttttagaatttccaccactttgctctccatggcatatctctttatacaaaatatacaaaaaaaaaaaaaggtgttggccaggcgtggtggctcacgcctgtaatcccagtactttgggaggccgaggcaggcggatcacaaggtcaggagatcgagaccatcctggctaacatggtgaaaccccgtctctactaaaaatacaaaaaattagctgggcatggtggcgggtgcctttagtcccagctactcgggaggccaaggcaggagaatggcgtgaacccaggaggcggagcttgcagttagccaagatcgcgctactgcactccagcctgggagatagagaaagactccatctccaagaaaaacgtgcttataaatagggatcccttatttattcattcaacaaacacaggttgaggatgatctgctttcaagccactctcctgggaccactggggtgagaagccctgcagcctggtgaagggtgctgcaggtgggaatagccatcacgtgagccagcttgctgagtgctggaatgactcttggtgaggcagccgctgtgggaacagagcaaggagagatgagttccaactgctgggttctggggtacttccagagacaatggcatctgaactgattctgagggctggggaagaagacaaagtggaggagggagaggcaaggggaagacagaaagaatgcatgtgtgatgtcgctgggacaggggaaggtgactggggaaggagtagagaaaaaaggtgggaaaacctctcctgtcaccccctaaggctcccggcccctactccagcctgcccctacatggcctcagcccgcctgcgcaaactcacttcccctgcctttctctttcatccctgtgacttggtgacatcagactcctggctggtcaccaaattcacccagccccttcccacctccagaccttttccttcttctgagaaacccaacaacctccccgcccccatctctagctgccaaaatcatacccatctttcaaaattcacctttctctaggattcctgttctagttcttgactgggcaagatgttgttctggagtctctgtggttcctcccttgtgtttctctccctgcaccttccaaggtcaccttgcagtgtaacggtgagcctgctctcctctgtccaccgttagcatgcaggcgctccacggcaggcactgcctcgctgtccttcacattcctaccacagctgggagccacacaatagtcattcaataaagaccagctgagtcaaaaccaagagcacagattgctctcttacagctagtgaagaacataatcgctgcaggattcccttgtgaccttgttataggagaacacaacaagttttctttttcacaatttgctttcctaagttgcaggtcataaaatacccacagaatactgggaaaacatgacatcgctatgtgcttttacttcaaagatattaactcatgttggtaacactgaccagaacctgcacaccaatgatgatgtactttcattggctacggtgttgctttggtgccactcagcttgcagtaaccttcgggtgctgggattagaacatccaggacggacaggaaaagcagaagcaaagggccatctttgctgaaaggggtcctgagaaattcaacctcagctgtatttaaatagaagttataatgcatatctacatattttaaaacatgtttttcctgcaaaactggttagtaaaagaaagcttttgttagttccatccgatacactcaattatttttggcccaccaaaatgtatttctcaggtataaatcagtgtgtttaaccttctctttcctcaaaccagtctattcagtcctgggcctgtggccatgctaccatgtcgaatacctggagggctctctgaccatgaccatataaaatacttgtgcccgaatgctgaattagttgcttctccccccctttttttaatgtaaacattaaaaaaatttaatgtaattaaatgaattttatttatttacataattatggcattatatgtaaacatctaggaaagcatttatgttattatactggaattgtttacttaatatcaaaatgcccaaactgactaaattacctgcaagtgacttatatttttctaaattaaataccatggtgaaaattggccaattttcttacaacacaattttaaattatcacttccccctgcaaacaaagacaaactagaaattaaaacaactcataagcaccacctacatttacttcactaaaaaaagaaagaaatgtcctctacagagtaagatggaccaccactccccggcaaagcattacatgacaagacagcaaagaagattcgtgttacaaaactgttaaaaatacatgtgaaaggtctgcataaaggaagaccttggatcttagcaagaaaaattcaatgtcacaaagatgtcagttctctggcatagaaactcaatgcagtaccagtaacaattccaaatagggtttttggtggaacttcagaagcttttccaaaattcacatggagaagcaaggggccaagaacagcacatgctaagggaaagaagaaaattatagaaataaacaggcagcatcattctgtttatataaagttcaaaagcaggcactaaaggagatatggttcacagatacacacacgagtggtagacgtgcaaatccctccaatcacctctggctgaacgtcctaaaggtaccaagtacagtaaagctaatcagatacttcacactatcctattctgtgcctgttagtctgaagccacctataatactgagatgtctcaggaacaaaatattcttgtaacacagtttcactgataactcttaaaatctgaaatccttaatatctgaaatgataaagaatttctttccatattatgacatacagtgcatacccattggctggtgataaaactattatagaaataagatataaattgcttgaaaaggtatttggaattttgtaagataaaaagtatttcagtctcctatttctttgtaacttacaaattaagaattaaaagatattccaacatgcaaatagcactcttcatattagaataatctacaatcgaaatgcagaagtcagtcctaaattaaaggtatggttttacttttaattctttctgaaaatcaggcatgtttaagttaatttaaaatttgttgagaaaaaaggagtcattatctttattatatatattcatgttaatgcatcctttagcgaagtaataatgaatggttggacttctttaggcatgaagacagtctaagcttagggcctagaccttatttccttccaacacaaaaatggcagtctgagtaaattaacctaagcagtgacacaggaaacaaatcatgcccaattcccaacctcgaacccaacaacttgcttccaacagttaatggtcttccttatcactcttattagggcacgacagattccatctaacagatctgcaattaccatagttccttttcttttaatccagtatttaaactgttcaatgatttccactttcacagaatccatatctacctaagcctaagtggacaaagtataattcagcgaacaattcccatctgcaggaaaactaaccatataaaacatgttttcggaaacacttgtccccattacatggttaggaagcaaaattcaacaagtagtcattgacaattttgcctctttcataaaccacactttgagatgtataaaagtattgctaatttcaagtcagagaagaagccaagtctaattaattttttcctcagaaaatctgaaatcttatcatatgtttaaaatggacttattattcagcacttttttgtttttgttttttaggagatgggctctcagtatgttgctcaggctgctgtggagctcctgagctcaagggcaatgttcacacctctgcctctcaagtatgcactctgtgggtggggccctagaatctgcttctccaacaggagcacaactcaccccactacaccaaaggctggtgttgataaactacatattggtcaagccccttaataaggctgttgaaacaccattaagataagcaggtttaaaccgatcacattttctcagtgttgccaccattggcattttgggcctgacaattccttgttgcaggggcctgacctgtgcattcccgccttctacctcctcaatgccaggagccccctcacaagttgtgacaaccacacgtccccagacattgctcaaatcccctcggcagcaaaactgcctcagctgagcagctcttctttaaacacacacccatttttagaagtgagtttggattaccgtttttgaacattcatcttgtctttgggataaagatagatattggcaatataaaggagacttgtgtggctgctacagaaacagtccaggagttactgtcatgtgaagaaagcaagtcacagagtaagagtcagtataattccacctatgtgaaaacaaacataaaacaaagttattttcatatataaaggcaaagaagactataagaatctgcacagcccactgataccaggttacttctgaggaggcttttgaggttagggggagactgctgcgctcggactgttggatttttttttttttttttttgagaaagagtctcactctgtggcccaggctggagtgcagtggcgtgatctcagctcatagcaacctctgcctcccgggttcaagagattctcctgcctcagcctcctgagtagctgggattacaggcatgcgccaccacgcctggctaatttttgtactttcagtagaaacggagtttcaccacatggtctcaaactccttacctcaggtgccttgacctcccaaagtgctgggattacaggtgcgagccaccgtgcctggccttaggataatttttaaaaacggtgttaggtctcctcagttttcaattccataaaagtagatgataaaactgactttgaggaagttcacagaagtgagtgaggcacatgcacgggaagcagcgagcgttacgcactcccagcacgtctcccatctgatgctgctgtatctgaagtcgcagttcggatgagcatggagtataatctgagagctgcgtaaccccagttcctgggttctggatacctctaaccttctcccttctccctcttcatggtcacggccaaggcccacctcctgccctctggctcatctccaatgcctgtcctgcatacatacactcacctgacgatatcatttctaggtctgccacaaatgtatgcagaggcccaggaggagccaagactgaaaaccggagggcctaagtcagcgtttctcaggatgtcatgtacagagacctcaatctgaattatcctgcagaccaccttggtcccacccagcccactgaatccaaacctctgggggtgggccctagaatctgttcttccaacaggacaaacaccccctttccactgcactgtaaagtctggggctcaccagccacagacctgactatagctcaaatgctgtgtgtctttatctcctgtgcactagggaaagaaccaggagaggacagcatagggggaagcccaggtcatcctgtgacctccccacctctgccggagtgaccccttcctctggttcaaaatctccaacaacagggtgcagacatgacctagaccaccgtgtgtggtgagattacttgaggacctgaggtagaacgctttcaggatggaaacgtctcaagacttggagtcagacccatttaggttcaatgagtagttctgccactcagtgaagaaactcacttactgtcactacgcatcagtgtcttcatgtaaatcgcccggctagagatctggctcatagtaggtgcgaaataaatgttagtttccatggttcagtgccagggctgtttctctgacacaggccaaatgtctagaacctatcctaattagggggagaaagaggtctttaatgtcttctgtttcatcattctgtttgcctacacagcaagcatttatcactgccaatactaaactgaactcttttctatctcccacaagagatgcaatcttcactgtctcttcctggggttcttcccaggctcccaggaaggcaggtgtcacgccactactgccacagcttcaggaggcacacagcgcgtgggttaatgcagcctgctccatgaaaagctcccactggctcttgccactgcctccaagcacaacttcatactgaaaacatcacaccccagcaccatcattgcccctagggagaagacacaagaagtcagaaggaaccacaagcctacaacttacactgcttggtcccataaagaaggtcaggagttcctagaagggagaaatttccatccagtgaaaagcaaaatatttgctttccttggtacatattgctcctgtccataatttcaaatcttcctactcagtaaaccttatcatccttcagtggtggtcacatggcagtccgaaacacgtcagtgtttgtgtctgttttctcagtaacttctctctttgtttcccactaactgttacttcctgcagtttcctgttctctcgcatttttatgtccactcctcccgaaccctgccatttataatccctacctggactgactcttggggctttgcctcctgtcctcaagcctaatctgcctgaatccttttctcatttcactctgcatactcaaacttacagtatgatgtgccctatgatttttaattaaaaaattacacataagttacaaatgatattttaagttcaaaaaaagaatttcctttcatttacatctcagtatatgtaattttctcatgatagcatattatttgtgcattctgggatgctattcaaatactgtgaatatcaattaaatacgccaattgctctaacttaaaaaaatggaacaaatttattcccatcccttttgcagttttacatccacagccaaaacaaattactgcagacacatttctgtagcttttgcttcaaaatcctgccttcaatgttttttttttccctttttaaaatttatatgtcccattgcagtttaagtgaaatgatctacaataaaaacctaactgccctggtatttttagagccctttttactatgaaataaacactcagaaacctggagaattgcagtggttaagtctgtgagtgggaaggaaggctgctcattcacagaccctcccagcgcccgttgtttacatagcctattccgtgagcaggatgctgacagaacacaattcacagaatttccacacacaggtccaaccataacaaagtctgcagcttttacttttgcttacagaacctcttgcttgctcgctcattagttccggggggggaaatagagtaggcttcccaaaaaccaaaaccaaaaggctttagaaaataagcctgaatgaaaccatggcattaaaccgtatctataagaatgtatacagaaatatgtagatacacagacctggaaatgtgtgctttactaaatacattcactaggagcagatcatgcatttgataaatattctgccaggcttaaataatcatccctttgaaaacaccctcatctccctggcttgcccccttttctaaagtccagtggtacttgctgtgtaaaaccttggcccttgtgaatccatgctgcagcttttcttcctggtgcccacacagctgaacactgctggagaatatcagacaactgagctgacagcgttggcttggatttctgaccacaacccttgaagggaaggggctcagcagtgcctcacaatcttcttatgcatccttggtcattttgcttggccacttcctgagtaattatttcctgcttcctctctcatcacaccaccaccccttccccaaaagtcctggtgaggagctcatctcatatgtagttgagaaaatagcaattagcaagaaactcactcatctcaccaccaaccaatttaaccaatttacaagctcacctgcacacgcacaccccccatgtcctgtcttccctcctgttcagatggaaggagtgtctctgctcctataaagtgcagctgtccacttgggccctgatcacctccactcctacctcgccaggaccctccgcagcagtgacccgcgtcattgctggatttctcatgtcaattacaaacatgctagaagagctacctagattaaaaagaaaaaagttctccttgatcctacctctccctccttctaattactcctcatctctgtgttctgcatttagcacaatttcctgagaaagctgtctaaacttgccttctttgcttctgcaactcacattcattcttcaggcttctctaatctggcttctatccctaccagttcaccagtcagaactccatgctacaaaccgtgggatccacccctgcaccctcttgcttgcccactcagcggtgccctgggctgcctctcccccagggctgcacctgtacatctccaggatgcacacacactgcccgccctggcactgtgtgggtgagaccagagcaggtcagcagggtggccctggtttctgctgctggtacaccgcatgctacacatttttcttttcatctagtctaacttagctggtactttctcttcaaccccatttttagacactggagacctgggagctcaagtgatccccaggagattttgtacagtcccatgattttagatgccatttctatgctgaggtcttctgtcatgaagggctggactccaggaaattttgtatagtcccgtggttttggatgccatttctgtgctggggtcttctgtcacaaaggttgcaccccaagagattttgtatagtcccgggattttggatgccatttctatgctgaggtcttctgtcatgaagggctggactccagtcttgaggtgtcaggacagtggctttcaagaccatgagattttgtacagtcccatgattgtggatgccatttctatgctggggtcttctgtcataaaagactgaactccaggccaacttccccttcggccttgcatctgggcaggtcaacagaagactaagaaagcctgagtgctccctcctatggcccagggtggggttcaaacctcacaaggcccagcccagcccagcccagcccagccccagtcaccatcctacttcctttttttttttttttttttttttttgagacagggtctcactgtttcccaggatggagtgcagtggtgtgatcttggttcactgcagccaagacttcctcagctcaagcaatcctcttgcctcccaaagtgctggaattacaggcatgggctaccacacctggccagcatcctacttctatagggtgaccacaccttccaaaattctagttccagccctgccatctctcctatgctccagatcatatatgcaactagcttgcctgacatctgcaactgtgcaattggtatctcaaatttaacacaactaagattcttagcccagccatccccaagcccctttttcatctttgccacccaagaacatgattctaccaaccacatggttgctccagtcaacattttagatgttaccttcgactcatccttcaaatcctctccctcatcctccatacgcagcccatctgcaagtcctgccaattacagctcaactacactctggataggtctgcttctctccagggcactgctttcaccgtgatcccagccaccatgatctctcacctgcatgctgtcacagcctccagtctcgtttttctcattttattcttgcttcctcccccgagatccattttccataaggcagcaagaggagggaatgttaggacatatctctcttaaggccaaaacaatttttatgagtaagaaatgtgagttgttctgaatgcagtaatacttttgatgagacttatttcctttttaagaatgaagatgcagggaacaatgggaggaacaccttggatgtgatatctaaaatcgattcccacggtgcttcagccatgtcaagctggacaactacatctgctgggaccaacgacaggaggagcagggacaacgaccaaggacatcaccaggtagacatcgtgttgctatgtgaaggtgacctggtggtagtcaccttcacttgttcccagatttgagagacaagcaagtctgttacatctccagttcctgccacaggtactttcagttgaaacttgacgccccagggatgggaaacccagtagtgacacagaaactggattagacattcaaagacctcagtcccagtttcccaacttaactagctttttaaatgtttcttaacatttagggcctcacttttctcattttcaaagtgaggatataacatttttcacagggagctgttcaacgcaattacgaatgaacaaactatagaacaccattcaaatatgttattaaatataacgtctctagaaatgtccctttaaaaacagtacctggaatttgactatcaaatttttaaaattactattattgaagcaacagaaaaagattacagaaatttcagagacataaaggtatagtcaaagtagagactcttggatcttgcagaaatgacagaattctatttccagcttctttgtccaacctagacatcagctttttcctatacggtttcatttcctaccacatttcctgcccttcattcatccaaaggttacatgtaagaatgggaacaggcagaatttcaataaccaactacatagtactacattgtccaaatcactgaacaaacaagattctcttgtcagaaagttcctttgttataaaatctttactatagtgtatctatattcaaaatagattaggggatatttattgagcacctcctatgtacctggctttggagatgtagcagccaacaagagttgaggtggctgccttcaaggggtttacattccagtgagggaaaagggaagaggcaacgaacacatatagaagtcaacaagatgaagatgaccaacaataaaagaaatgaagagcatgctgattagattagaaatggatacgattcactttagataagcaagggggcgctactccaaagactaagcatgggatcaagacctgaaaggtaagaaaagagcatgcaaacagcttgtggagtaatcggcaagttcagcccaaaggcaaggaaaaacccagactctagctaggccatggcgagcagaagaaggagtgctatgagatgagggtggagacgaaacagacctccaatcatgtcgcatcctgtatgctgtggtaacaggagccgtgggtgtgatcaaagggtattcaataggtaaacaacttgattttgttttcaaaagtattaaatttgagattattttgtgaacattggggaggggagcactaaaaatgtctctaaatggggcagtagcatgagttatgctttacaaaaattgggttggtaagactgtgcaagacaaactgaaagaggaagatgacattggaaactgagatactacaggttggtgcaaaagtaactgcggtttttgccactgaccagctatcacagtcaaaatgtaaagggtgcccaaattgcaagggcggcaatggcaatgaagagaaaaggataaaagtgtgaaataccacacaggtgtgatagacgggatttggtgctcactggagcaaaagagggagaactcagagctacggagggtcatttcagcctagccagaacgaatgctgccacaggaagacataccaggcataaaggtgaggcccaggaaccaggaggacagtgtgttccatttaagccatgacaccactttcttctctccttctgagtccaccctgttacttccaaggctgcacaccagtaccattagtgaccctgagccatacaccaaaccaactgaagaaggatatagagggttgtgtttttttttaaattccattggtaattctgatgtgcagccagggccaaaactcactgggccaggcagagcatggaaactagattaattaaatttcgtatatttttggagatggaggattactttggtcattttccttctgcttgaagaacagtcttagtactccctttgtggagctctgctggtgacaaattctcctacttttcgtttacctaaaatgtctcatttttaatggattcctccacccccatgaatttgaagatatcattacactgtctcctggcttccattacttctgtaagaagtcaacaagcagcctgtcaaggctggcactaagaagatgcaggagagcatttgccttgggtacaaaactatccacagccatgttcctaccaaaaatgcatgagtaacgcagttcctccacatcttcaccagcattttaagttctcgctggcttttattttagccatttgataggtgcgtagtgatagcccactgtggttttattttttcacttccccaatggctaatgatgtgaaatatcttgtcatgtgtttatttgccattttttttttgctcatgaacttatttcaccttttcgtgaaatagtgtttgcccattttctaactgggttgttttttaccattgagttttgagatttcttgattatctagatactagtcctttgttatttgtggcttgcaaatatctcctcccagtctgccattgtccttcacgtgggctttcacagaacacaaggttttagttttgatgaggtcctaacacagttgatttttctttttacatattatgcttggggtagcaagtatagaaactatgcctagtttggccaggcttggtggctcacgcctgtaatcccagcactttgggaggctgaggcagacagatcacgaggtcaggagatggagaccagcctggccaacatggtgaaaccccgtctctactaaaaatacaaaaattagcttggcgtggtggcacgtgcctgcagtcccagctacttgggaggctgaggcaagagaatcacttgaacccgggaggcagaggttgcagtgagccaagatggcgccactgcactccagcctggcaacagagtgagactccgtctcaaaaaaaaaaaaaaaaaaaaaaaaaccaactatgcctagttccagagcctttttttttttttttgaaaagttttatagttttacattttacatttaaatccctgatccatttgagttaatttttgtataagttgtgaggtttaggttgatgtccaactgcaaaagcaccatttgttgaaatttctccattgaattgcttctgtacctttgtcaaaaaccagttgaacttatttgtgtgggtctatttccaggttctctgttctgttccattcatctatgtgtccacgcctctgtcaatatcacaggatctaattattgcagctatcacagtaaagacttagtattaaatacagtgatttctccccgttttcttgtcaaaattgttatagctattctagggcttgtgcttttccctataaattctagaataagtctgcctatgaatataaaaagccttgctagaattttgataggaaatgctttaaagttatagatcaatttgagaagaactgacatctttactaagttgagtcttcaatgcatcatcactaaatatctctccatttatttcagtctttaagcatttatttcatcagcactttgtaactttcattaaacagatcccattttgttatgtatatacctaagtattttattttctttggagtgactctaaaatatattgtgtttttagttttggttttcaaatgttcattgatagtatacggagatggagttgactgttgtgtgttgatcttgtatcctgcagctctgctgacctgatttatcaattctaacaattgatttattttggtttttggtagattctttaagatattctatgtaaacgattatatcatttgcaaatagcaatggtttttcttcctttacaatatgcaggccttttatttctttttcttgactgataacagtgtcttgaacttccagtgttataagaacgaatctccttgccttgtttctggtcttggggggaagtattcaatctttcactattaaatatgatattcactctacgtgtttgggaggtgccctttatgaagttgaggtaattccccactattaatttattgggagattttttttttaaatcatgaataggtattggatcttattaaatgcatttttcctgcatcaattgatataatcacatgctttttcttctttaatatggtggattacactgattgatttataatattttaaagtctgagtcttaacgctaatatctggagcccctatgtgtctgttttattgtctgctatttctactgattcaattttgttatcctggctctttgtatacctagttatttttatctacaccagacacgacactacacttgcaaaactgctggcagaaataatttgagataccaagataatattgtcgtcctccaaagaggcttctgtcacacctgaatcactagcaatccaggattaccctaatccagggtcagtgactgagatgatctgagggtaaactgcacactctctgagggcctgtctgcttcggttcacatttactcttcaggtgcttcccttcaagatcccaacctcaagtaaaaggttcaccaggatgtgctcagttggcagaccacggactctaatttctgccctcctagtcctgtgatgctccaaaagcaccttgctgcttaatcgtctcctttgtaactggcagacacccctagtcctaaaccataggctcacctcctgtggcctctacctttccctggactctgactgagaacatatttactatatcatgagctttttcaagctttgaagcatatttttcatatttagtctgagttttctcatccttaggaggaggtgtcacttgatttctgagtttgcaattgctaaaaacagaagtccctcatgacctatcctgagtacctgatgaaagttgtgaaccctcttccaggaaaactatatatgcctacaatatttccacacaatttcatggagttttctgaccctttgaagcccatccatgaacaccagggcccaaggtcctcaagttaaaaaagccaactatagccaagtgcagtggctcacacctgtaatcccagcaccttgagaggccgaggtaggaggactgtttgagcccagaagttccagaccagcctgggtaacaaagggagaccctgtctttacaaaaaaactttttaaattagccgggtatggtggcacgcatctgtagtcccaactacttgagaagctgaggttggaggactgcttgggtctgggaggtcaaggctacaatgagccatgattgtgccactgcactccagcctgggtgaaagaatcagaccccgtcacaaacaaacaaaccccaatataataaaggaactgtatggtagttatagttgagacgtactgaaagctttctctgccaggtactgtgcatctagccctgtcatcatgcttatcttgcacatggccctcacagtctgcaggaatcgtggcttgttagttaaattgcagagctgactcctgaggaaggccagtggtgctgggcccaagaggaccttctactgctgctgcagccaagatgccaagccctgagttgacataaaggagttaccaggcagaaggccaagaaacaaagtctcaagcctggacatgttctgaactgatgaagccatccaaaaagcccttctgagtgggtggaacaacacagcagaggtccccacaggacccaaaaatagtagtcaagtaggcatcagtggccaaattccaggagtccctagagaaagggttgatctcatcaggggagaaggtctacaatcaagaatataatcacgggttgagactcaagactcctaggatgggcaaagggctccatgccagagtcttggctcagaggtgttaaaggcccctaagccagcactcgcaggagtgagacacacgtcatgacccagcagctagtggagatggaatttctgaaatgctaccacaattcactgtctttagcttgggacttaggtgggaaagggctatagaacacaacagtgactcttgatggggccaattcaaaatccactaatctgctattaaaacatttttgtggctttactggcatttagtggttaaggaaaactagaaatataccatataatagcaaactgtcacacacaattttcagacgttccactgtatcatcatgtatgtggaaccttcttttagagcctaaagctgttttacatagaaatacaaaatatgttttgcatgttctggcatcctctgacttctctgaaaatgtaattaccctgttggtcagggaagattttacagcagtttcatcatagcattatcaagagttgtctatcgttttggaaaatcacctcctggaaggcaaggccacatgaggccctcctctaacagcctgaatttgcagtggtcacattctcagagagcccatgtgtagatgcatgcatccgttcatgatgtctcccagtctcataagacccaagtatttacactggaaatgtacattatcttattaaaattttttttgtgtgtgtgggggaggggagacagagtcttactagaaacaggtccagactggagtgcagtggcgccattacagcttattacagcctccacctcctgggctcaggtgatcctcccgcctcagcctcccaagtagctaggacaacaggtgtgcgccagcatacctggctaacttttaaactttttttgtagagccagggtgtcgctatgttgcccaggctggccaggaactcctgggctcaagtgatcctcttgcagtactgagattacaggtgtgagctactgtgcctgacctagttttctttatattgtagtaaaggcaatatatgaattttttttgaaagagtattttgaatttcatttcaggatctccaaccaggtattataaaacatctgttattaaaaaccggtgttggatctgaatgggtttagaccttgccatgtatcaaatccttaaaacaatctgttccacagactgcactctggccagttttcgaagccccccacctcacccctagtacttaaaatcctttcctcctgctgctgcttagatatagagaagccttcccaggattgactctgcagccccaccctgcagccccaccctgcacccacagccctctctgcctccttgggcccctcctactcaccatgcctcctcccagtgcgttctgctcacctcctacatccccttccctctcctcacctactaaagcccgaattgctcttccggtgtcagctccagcaagaccacctcatgtccgtttgccatgacctaactagccacccttctcccagggcgtggtctctcggtctaaggaagtactgactgatggctgtttgcctcctgaaccatctgagcaccactgtgtgcccagcacagcacagacagtgcccagcgcacacaggcattccatttgttgaatggaggggtgggggaacagagaaaaaactaccaccagaggctcctggtttccagtccaaggatgagtgtttacagtagtgacttccagagttctgaaaggtatatacattcgccttggtacaatggctctgctgtttaggtgaaacctttcatacttcatttctccccaaaagttttacattttaagaaccctctatacaacagagaggacatttattagataaaaaaaatttccccagcttatatgaaccttctttgtttcttaataaacacttatcttatttttaggatgatttatacaagttagtagctatctgctccatgcagtatagctactgataataatatgtattttatatttaaaatttttcttttatttcggtgtaaattcagaggataaacctctcatttctaagttttcatggtcagatcttcaagattacagatgaatgcaaacagatgctattacaaataccagtgaatacctggcgtttgaaaatccggcacatgaaccactgggagttcatgcacggtagcagtcagggaccctggatctcagagcaaagctgctggggttcacattagtacccaccacttactggctacattaccctaggaagctcaactcacctatctaatgaacctgagttttctcaaccacaaaatagggatataataatagttcctaactcagagagttggtgagggaattaattggggtaagtctcatttcaaaatgtgcgaaactttgtaagcagtcaataagtgtgtgttataaacaattttatggcagttgtccatccacaagccatggtgtaaactatcaaggaggtctaagcagctgtttacgggagagtggcaagacgaacagcagagtcagggatgtgaggacttgatccagctccttcatttaccaaatggggaatttcaggcaaatgccttacatttctcatctcatctataacatggagataattatatctgccctggggtatcatgaggttgttgtgagaattaaatgagatatatgaatttgcttcaaaatttacaaaacagcattaaaatctaaagtattaatgtaattgttattttcattagaaattcactattcttcaagtaacttatgcatataacaagcggatgacatataaataacagaccatgttttcttaaaaaatatactcacctaaggaataaaaggcgcatattttaacttcaagatatttatttgaaccaggaataaaaccgtctcaatcatgaacatagtcaagtgttcttttaaattcagacagataaaaagcactctccagaacacgtcaactaagattatgctgagctgtaaactgtagtacatttcccatcaagaaagcaaatctctataatgaattgccttttataaatgtgggctggtactatgcaatgtaaaaatacaattaacaaaagagaacatttttgaaagttttcaacaatgtagtataaagcattttaggataatttgacttgcttcctttttaaacaacatttgaagtacacgttaatgccaataaaaaaaatttttttttttgcacaaatcaagagggaaaaagcatacacatagcacacacccacccgcttgcactgctagtctctcatcatttccagctcagttaacctctgtgaaactagtacaggaaaaataaaccatgctgctactgtggctaacaccacacaactttttaatggaactgttccaaggcgtgaagttccatttgaaagtcactaacaaaacctttggaaatgttaagaaaaaaagcaagccaaagaattgaaggcctggcaagtcttgaagcccacacttatccacactcatgaaaagtaatcacaagtcaagtctggttctctctttccctccgtattttcttcaaagcaatccactaacaaaattgcgatttcctttttcagtgaaaaaaagaaaaggatgaaggaaaaaaagacagtctgcataaacaaaatgtagggaaaaaaatttgtgccaccacacaagaactacaattatttcttaactaatccacactgaaatctgttggttgagtacctagtgatttaaatttgttcctttttgcgtaagaaacaaacaccacactctaaaactagccaagacacagaaggccacctacttagatagctgtagatccttttttaagtcgcaggtttaaaggtttccaagcttaaaaagatttccagaaaccaagtaccttaatacactccaaacctcagactggtgatattgcattactttctataagatacacacttatattttgcttaaagaagcatttgcagctttaacccatttaatgtaatatataaggcagatggttcttgacaactataatcttggaagaaaactgaaaaaatcaattaggtgtttggcagcactcaaaaaacagcctaataagctcattgccatgcaaatcacctacaatgttaaatatataaaactgctgtattaagctcggagaaggaggaaaatttcctcttcactcatgtgaccggagactaaaaggaaggctccaggggtgctgctggctgggaagagaactggggaaactgccccagtagaggtggagatgccagggcagagggaactgggcttaacggggcagggctgcctctagaaagagccagcttttctagcacaggttaggagtgaggcagcagaactgggcttaacagggggcaggactgcctctagaaagagccagcttttctagcacaggttaggagtgaggcagcagaactgggcttaacaggggcagggctgcctctagaacgaggcagcttttctagcacaggttaggagtgaggcagcttcccaccagtgagtcaaccttgccataaattgccaacaaatatgctcagggcgaaagaaccagatcagatgttatgggactctttttctaattacagaagtttcttctgtggggcagttagccccttccaattaagaagtaattacattctaaaggattggttacaaagcaagataaactaaaaatagaaagtgtgaaataagaataaaggcaaaaaataatggctattttgccagttacattctttttcttcttcatccccaaactagaaatcaattgaaaagcaaaaaatattaggtaactgaggcaaatgtggttagaaacatcccaagtatacacaagaatgatgagttctatccttactgaaattgccatagattccatgaatggcatgagatcacatatgaaagatggtaatctacaatgtttgttaaaagtcacatattacaattcagatgggtccagattatgtcaaactgcaaagaaatatcagctaaataagtaaaagggatcataactctaaaacctatgactccttattaaatttacaagaggacagtggcagctttgcttgataatttatttataaaaagacacatgaggccaggcacagtggctcatgccactttgtaatcccagaactttgggaggctgaagtgggcagatcacttgagctcaggagttcaagaccagcctgggcaacatagcaagaccccatctttacaaaaaaatacaaaaatatagctgggcatggtggcatgtgcctgtggttccagctacttggaaggctgaggtggaaggatcgcttgagcccagagctggagggcacttcagcctcgtggctgggtgacagaacaagaccctgtctcaaaaaaaaaaaaaaaaaacacctgaaaatgtgaaggagacagttcattaaaacctcgtaaccgcaggctaatttcactacattttatatgctcacttggctaaaactctcagagaagccaatggaagtttgattttagaaccacagcaataatcccaattgtatatattagcagttcttaagttttctggtcttgggatcccaaagcactttttattttggttttacctatcactatttactgtacttgtaatcaagcctcagaaaaatttaaaatatttatctagtaattaatatgagataataaccctttacatgttaacaaaaatattatttatgaaaaaatatgttttccaaaacaaaacaaaaaattttgagtggcactgttttacatttttttgcaaatctctttaatgtttgtctcaatagaagacagctgtgttctcctatctgttgcggcattcaatctgttgtgatatgttgctttagttcaatttataaagaaaatccagcataataaaattacatagctggaaaagggaggaccttgtaggcctcctgaaatagtcttgaagaccccagagtccttggaccacattttcagagctgttaatctataacacaaaaacacaacaatgtatacttacacttaggacagagtggaggggataactgtaaatatccccaggagcaaagaagcactgtgtccaataataagacacggttagtatatgctaatgtgttctttatagacaaaaggccaggaaagtaaaataatttcaacaatagtagtttaaacttacgtaaaacattgatcctttaatttcactgaaggaaccacaaaaaacaatacatagaacatttagtcttctaggcgtccattactcatgtctattatatggctatatatctgttttatgaatggagttcaagaagcttcatctatatagacccatggatatccatcacaaggacattaattaggcattggtaactgggagatgttctgagagcatgcctgtgaatagaaatctgctaaacttccactgggtctcaggcagcccacttggtgggaaccacaacatgagtctgaaatgagggattaagaactttcaaaacacaatttttgtgtgtaggcgggttggccttggtgtcttaatgcaaatctgacacccatcaggaagctcaggaaaggggagactaaacacttagtcataagtatatgttaaccagtaatatgaaaattaaatctgtcaaaatcctcgcttttgatatggttaccaaactccaaatgttgacttcgaaaatcaaacccaatctgccttacccctactccatctaaaattaaatgtaatccttcaatttatatagaagaaacacaaatccaagagcaagttaaattcagcatccttaacttgtcccagttgcacccagactctggagttccaatctcctctgccacagggtcccacatcaaacacccgatggctccccataaacagaatggaacgtaccatagaacaaagggagcccaaaatagcttcaaaataccaaaggggattagccagcaatttttgtcttaaattaagctgttatgatctaaagcttggcaagaagcatcagaatagagaattagattagctttatcacaaatgaaaatgactaaagcatttttaaaatgctttcatgaacaataacaaaactccaaaaattatgtatagcactgcattctatacaggtatgattgtaaaaggaagttattccttctaaaatgtataatcacaccactttctctttaagctggttttgacaatgtcattataaattctaattgttagcaattcatttttaatcagcttatgtaaaaaaaggtatagtatactatgactttagtaaggactgtatcttatgatatatacatttaaagtatttttttacatagttcttttactcaattatgtgtgcctatataaaatagcagctaagatgtcatattttatattttaaaaaacttgacaactgtctttaattatatatatgaagactaggaacagtgtctataatttaaagcaacaagacagcatcccttaaggaaatccctagggaaggaaagaagagaaaggtgcgcatctgtaatattaactgttctttattaaaatatctgtgtttttccaagtttttctttaaaaaaaaaaaacactttcagagaaaatgttaaagcttcggaatgatacatttccatttgtacacatttattacttaaaataactcctcccgagagaaactaaccaagagctttactaaactccataattctcattaatcaacaaaaactagtgacttgcttcttttatcaatattcattaacattaaagactaagatcataaaagcttcaaaaaaatggaaagtagaagaacaaaacaggctagcaagaacaacatttttgaatgaggaagaaaaactttgcagatgactcaaattttcatttaatcaaacaaacatcaaaggaaacaagcggtaaaagttaaattttaaaaaaatagtaaggaaataaattgattaaattcaatttaccaggacttataatgaaaagttgctaacttctccaaagagcaaaatatcctaccggtcattttcagcttttgtgctgaaacaggcttcaggagtattaagaaatgttttattttgttgccccaaataaaagctggaaaaagaaatacacaaaagcatcatatgtaaaaaggttttgctgaaaaagcaaacattctaaacaacgaaaatttagaggaggaggcgggagaaggaggaaggagaaaggaaaagcaacctaaaagaaatgctatactttttcaaattaaaaatcctgaaaagcctgtggaatgctgtttacttgtgctcttgcaacgggactggcctgcctgaaatgtctgcggaccatgaccacccacactatgggaagcatgatgattaaagagtgtgctggatctcggtatctgccagcgcggtctgtgccatgttgtaattattaaatttgcagtctttttataatctgttgcatgtgttgtggcaagtcccctacatcgtctaacaaggaaaccactgaacataaatagcaagttatttttaatgtgcacaaatggctaaaaaactggacacttttaacattacgctttcaattttcacaaaaatggcttaacttaccgtacatctaacgctgcaatgaaaatagatatgccactctaaattccctttcaagctcttaaagaagatatacagcccaagttaaaccccttaacagatagctaagatacaggttaaacatgcaccaagggaacaataaaattcacccttacatctgtccagtgattaaacacacagaagaataccaagaaacatagcagttgtaaaaatctgcaggtctgtttacccctaaacttttttttgtaacaaaaatttgctttccattctaattttgttcatgatgacagtaatggggttgcaaagacatgcttttccaggagcattatcccaggtacagtgtataagggtcagtcaggatacccagcataggaactcagaaaaagaggtgaactaatgaatgggagtacaaccaaaccctgctccacccccagcccccagccccacactgcatgtcttctctgtaggagccaagataatatcaagtttgttttttttaaaggtcaagtcagctcagccagaaattggcagcccagcctggctcaaaggtgagcaaggaagaccctaaacctccacctaaactggtctatatcagggtgcctgccttgggaggggcaagtgggtgaactcacatgaagagctggccacagcttctatcactaaaaaggaaagaaaccataaagaagaaaagaaaacaaaagagctataagaattttttaaaagatcctttctagaagcataaagtcaaaacaaccaaaaaatcacaacttccatctctgtagtgctcctgccaagaagaaacctttcatctggaggacagatggcagtctcctatccctctgcccagtgatcaaagtccttgaagattatttgcacaggttaagcaaggaatgaaggctcttccttcccaaacatacccaccaaaagccataaaatcctaaaaccacaagaccgagactcagaaaaccaactttgaactgtgctggcctccaggagatgcaacattgcccatctccctcctagactgatgctccctagaactccgggtggctccactactctgactgagcaggtcagacggacaaatcccgggtgccttctcattgacagtgttacaacctctccactagccacccccacctatttcattatatactgtacctgtggcaaaatgttacaaagataagaaacaacacaaagctgctggagccataaagcagtttgtttagaggcttaatataacttaacaaattttacttcatcctaaggaagaggaatgaagggtgagtgtgtgtgtacgtgtgtgtctgtcttttcggtgtttattttaaaattttaataatacagactagactacattcaggagtgtgacacaaatggctctaactgtagtatttcagcctagatgttaaaaatccatcttctaataaactttgcaggtaagaggtaagggacaggaaagtattaaactctgtaaatgccttctgctaatccagaagcctttttttttttttttttttttttttttttttttttttgtgatggagtttttctctagttgcccaggctggagtgcaatggtgcaatctcggctcacggcaaccactgcctcccgagttcaagcgattctcctgcctcagtctcctgagtagctgggatcacaggcatgcaccaccacacctggctaattttgtatttttagtagagatggggtttctccatgttggtcaggctggtcttgaactcctgacctcaggtgatccgcctacctcggtctcccaaagtgctgggattacaggcatgagccactgcgcccggcctccataaaccttttaacagaaaagtcacccatattatctcctactatgccattgcaaaggatactatcaagagaattaaaagaaaagccacagagtaggagaaaatattttaaaaagacatattcatataaagaactgttaaaacttaactagaagaaaactacttgattaaaaaatgcaccaaagactgtaatggacacctcgtcaaagaagatatacaaatgaaaaatagcatacaaaaagatgctgcacattatatgtcctcagggaaatgcaaattaaaacaacgagataccactatacacctattaaaatggcccaaatccagaaccctgctaacaccaaatgctgataaggatgtataacaacaggaactctcatccgctgctgatggggatgaaaaatggtgcagccactttggaagacattttggcagtttcttataaaactaagcatacccttaccatattctccacctatcatactccttgatatttacccaaaagagttgaaaacttgtgtccccacaaacacctgcacacagatgtttttagcatctgtgttttagtaaacacagatgttttactcataattccaaaacttgaaagcaaccaagatgaccttcggtaggtgaatggataagctgtaatatatccagacaatggaatgttattttgcactttaaaaatgagctactaaatgatattactaaatgaaagaagccaatctgaaatggctagataatctatgattccaactacaggacattctggggaaggaaaaaatgtggatacagtaaaaagatcactggctgctagggattagggagaagaggggaatgaacagggagagcacgaataatttctagggcagtgaaactacgctgtatgatactgtaatggtggatatgtgtcattgcacatttgcccaaacccatagaatgtacactacccagagtgagccctaatgtcaactacagactctgaatgataacgatgtgtcaggacaggttcatcagttgtgaccaatgcatccctctggaggggactgttgataacaggggaggctgtgcatgtgtaggaatgggtagatatgggaaatacctgtaccttccactcaattttgctgcaaacctaaaactgctttaaaaaataaagtttattctttttaaaagcccatgtatgaattaaaacaaaataaaatatgtctatctgttgggagcagttctcatttcagtaaatggcaacttgatgtaaaatcctgggagtctccttgatgttctttctcatccggccccctttataaaatacaccatcaatatctattgattatatttccagacaaaatctccaattcatctgcttccctccattccaaggtaatcactctggttcaagccctcataaccccttgcctggcctactgcaataacctacttccactctggcctgctccagcgagcagcctgctaaagattgtaacctgaaatatctgcatccagacatatacccagagaaactcttgcacatgtataccaggaaatatgcacagaaatattcagagctctactgtttgtaacagcaaaacctggaaataaacacactctaccctggtacaaatgaatgcacacgactacatgcaccaacatgaacaaatctcaaaaaaatacaccatcaagcaaacaagcaggtggcagaagaatacatgtcattatatctatataaaattttagaaacaggaaaaattaatatatattatttatgactaaatcaatacatagcaaaactatttttaagaaagcaaggtgacaataaatagaaaattcaagataggaagagagaataggatatgtgagcagggacagttatgtggatgatattgaacatatcagtaacattctattcctaacactggatgatagatatgtgttatttattattttttaaattataaaatgatatacttggttaaaaaagcaagagaagtctcaattaaaatggtaaaaaaaaaattcaggcttaataaaccttaatcagaaactcagttccctaacaatgacaatcacaatgacaataattaacattttttgagcacataacatcaggcattgttctaaaagctttacacacacacatacacatacacactatatataatcacttaatccaacaatcctacgaggtggtaaagttattttgtcactacagatagaaaactgtaatttcgaaaagttatatgacttgcccagggtaataagtagtaagtgacacaccaggatttgaacccaggcaattagctgtgttgcagagtacttggcatagccattccaaaattcagtctcaatttggtttaactccttttaaatctgatctagatgcccaacaatttgtttcaacttaacaatcttaacaaatggcaattattacagaatggagactctgaaaacatgtcatatatattccataaactctatctatatactaataggacaggttacaatagatctttgtaacctgaaaaatgttaattttaccaaggtcaagtagcatattaatatatatactaacctctaacactacttaaaaatttcttgaaggcttaccaattttttcaaaggattttaaagcactccagttgtcttcaggacttctaaccctagcaagctattatatgtatcctcctgctacagaaaactagaaaactgaacaaaatatcttcagacacttgacaacaggcagcaccagactgtgatcctgaaagcagaaaaaccaatgagggaatccctatgattggcctggctttctgcctgggtgcactttctgaatcagggctggagagccatcgtgagcagagcacagaagtttcactgagttaaggagaccaacactggagtctgataaggcaaagatagctacaatttgagagccaagaggaaactagatagagaaaaggctccagaaatcaacatgggggctctgagtttttggctgaataataatctgtgcatatgtagggtactacttgaccttgttatgctacttgaccttaacatgctacttggccttggtaaaattaattatctgtgcatatgaaagggcagataaaattagccctggagaaaggccactatagacctgccccaacaacgtttacaaacaagcttggaaaggatagacctaatctacaaaacataaatgtctgccgggataaaacaacactctctctaaaagaagacaacataatcaacacattcatcaatgcaatgttcataatacctggcatctaataaaaagttactaggtatgctcagaagcagtaaaatatgacccataaccaaaaagaaaagcagcttaaggaagcaggctggaaatggcagagatgatggaagtagtaaagaccttaaacaattacacgtattataggtatttaaagaaaaacataatcaggagagaaatgaatggtaagaaaaaaaaaaaaaaccagaaccagtcacaacttctacagatatagaatacaatatatgaaataaaaaatacacaaagcaaaattaagcagactaaatacttcaggagaaagacttaaagatttaaagtcattctttctttaaacctttttttaaaagaaaaatctttagaaacttaaagacatagcaataaaactatccaaaaggaagcagagagagaaaacagatggggaaaattatgacaagaacctcaatgatctttgggaaaatctcacgtaggttaacactgatagaattcaagtcctaggaaagggggtacaggacagaataagcacttaaaggaatgataactaaattttttccaaatctgatgaaaactataaatgcacaaatagaggaatctcgaaagactccagctaggatgaacacaaagaaaaccataccatgatacatcataatcaatcttctgaaaatctatgataaagaaaaaattcttaaaagcagcctaagtagaaaaagatacagatgaacaaagataaaaatgacaacagccttctcagaaactatgcaagacagaggtgaatggaattacctctttaaagtaccaaatagcaaagaaaaaaacctgtcgaattagaaatctatcatgcaaaaatgaaggtgaaataaggcctctttccgagaaaccaaagctgagaaaatttgtcagcagcagacatgcactccaagcaatggtaagagaaactcaagaggaaggaaagtgacatcacatggaaatgtgtatctgcaggaagaaagggagagtgctgaaaagggagaatctgtgggtaaacagaaaagattttttccttacttgtcaatgttcttaaaacagtaattttgtttaaaactaataatatactgtgggtttataaaatgtttagaagtaaatgtaccaccacgataaacagaagggagaggagatgtggctgtagactgtgatgaggttctaatagtatacacatatgttatgcactctattttcaagtaatatttgtagtcatgtattatgcaaaatatgaatattataaatcctagagctgtgcttcccaacacagtagccactgaccacatgggcaaatgaaagcttcaaatgtggcttgtctgaactgagataagctacaagttacacactgaatttcaaagatttagtatgagaaggagaacaaagtatctcattctgtttatttcgactacatgttgcaatgatattttcattatactgggttaaataaaatatttttataattaatttcatttctttcttttgagtttttcaatgttgctaatgggaaatatgggggtcacaattgtggctcacattatatttctataggacactgctgccctagagcagccagtaagagataaaaagatatgcctaataagcaaaaagtagagatgaaaggaaacagtaaaaaccatcaatcaaaagagttagaatagccaaaacagtccctaagaagaactaagctagaaggctcacacttcctgatttcaaaacttactaaaaagctacagtaataaaaaacagtgtggtccaggcagaaagacagacatacagatcagtagaatagaatacagagtccaataataaatccctgcatatctggttgaatgattttcaacaagggtgccaagatcattcaatggggaaaagacagcctttgcaacaaatgatggtgggaaattctgactatccatatggaaaataatgcaactgtgtacccttacctagccccatatacaaatattaactcaaaatgcatccatggcttacatttaagacctaaaactataaaattcttagaagaaaagatagggcaaagctttatgacaacagatttggcaatgatttcttggatgtgacaccaaaggcacggacaacaaaagaaaaaaacaggcaaatcaaatagtcgaaatttaaaactttcaaaagacactacagatacagtaaataggcaacccacagaatgggagaaaatatttgcaaatcatataccaggataagggattaatacctggaatgtataaagaactaaaactcaacaataaaaaccaaacaacacaactgaaaaacagatggactgaacaggcatttctccaaacatgacatacaaatagctaacaagcacatgaaaagatgttcaacaccattaatcattagaaaaatgcaactcaaaactattacaatgtgatactatgttacacccattaagatagctactatgaaaaaaacagaaaatgggccaggtgtggtggctcacactggtaaccccagcactgtgggaggccgaggcaggaggactgcttaaagccatgagttgagaacagcctggggaacaaagcaagactctatttctacaaaaaacatatttggaaaattagctgagcatgatggtgcatgcctgtagtcccagctactgaagaggctggggttggaagatcggttgagcccaggagtttgagactacagtgagccatgatcacattactgcactctagcctgggaaacacagcaagaccttgtctctaaaaataataataatatataaaaaattaaaaatagaattaccagatgatccagcaattccacttctgggtttatacttaaaagaactgaaagcaggatcctgaagagatatttgtacacccatgttcccaccagcattatccacaaacaactaaactgtagaggcaacccaagtgtccactgacagacgaatggataagcaaaatgcagtctcttcatgcaatggaattttactcagtcctaaaaaggaaggaaattctgacttacgttagaacatggatgaaccttgatggcattatgcttagtggagtaagtcagacacagaaagacaaacgtatgactccgcttatatgaggtacttagagtagtcaaaaatcacagagagagaatgtagaatggtggtgccggggcagaggaaatggagaattactgttgaatgggtactgtttcacaatatgaaaagagttctgaggatggatggtagtaatagctgcataacaatatgaatgtacttaataccactgaactatatacttaaaaatggttaagataataaattttatatgcattttaccacaaaaatatatgataaaaagtttaaaagaaacattaaaaataggtcaaattgaagtaataaatttagttataaaaaagagttccaaactagcagtaattttaaaaaattaaatggtgtaaacttaccagttcaaagacaaagatatctcttacagttcggatacagatcactgcttctgcagtaataactagataaaatgggtaaaccactttgcatctgaggatgcaaagaaatgtaaaagaattaaattcctaaaaacaagagcctctcttaggggagcagagagcagtttatacggtctctgaagaggtaaggagaaacaagaaagtgagggaagaaggtggtaggagaggaggagagggagatggagagagggagatagggagagagagtgaggaggatgggaaagaggaggaaagaacaaagaacagatgacaaaaatagaaaacaaatagcaaggtgcttgatgtggcagttttgaagtctggtgttaaagatctttgatactcctccccccgaaaggtggggtttcagatcccttcccttgaatctgagtggggtagtatgactgctcctgctaagagagtacagtataactctgtgatttctgaggataggttacaaaaggctatgtagcttctgcctggttctcttggggacactctcatgaaacccagccattatgctgttaggaagccaagaagccccacgtagaggccatgggttccagatgacagcctcatttgaggaaccagctgacagtcggtatcaactaacgtcaggaaaactagggagtaagcacggaggtgactccagccccagatgctgaatcctgccagcattcaagtcttcccagtggaggccaattacattgtgtagtggagttcctaacccagaatctaaaaaggcattaaaaggattattattttattcactaactttggaatggcttgttacttaacaacagcaactattattaaagatttaaaccagccatatcaataattatattacatagaaatgttttaaatattagatgaaaaagcagcaggtgtcacattagataaaaccaaaaactatacgctacctatgaaaaacccactttaaagacacaagtaagttaaaagtaaaaggatgtaccatgcaaacagtaatcaaaagaaaactgttattgttgttactgttgttttaatgtcagacaaagcagacttaaaaacaaaaagtattaccaggaaaaaagaaagatttcacaatgataaaagggtcaattcatcaagaagatgtaacaattctaaatgtgtttatacacagttacagagcttagaaataaatgaaacaaaaaatgacagaattgaaaatagcaattaataactcataattggaggcttcaacatcatctcttaggagattgataaaaatagacagaaaatcagaagactatagggacctgaacaacactattattggtagacaattctccatgggtctgctgcatttctgcttttgctccagactatattttcaatgatatttgtacagccaacccctttggaaaagagacagggtctcattcagaagaaatgggacaggtttgctaactgtccaacaataagaataatgtcttcctccacgaaaaaggaagtttgtttgcagcctattataaaagatttgagcaatacaagctgtaggttcctcagctgtgacacaaacccacatgtgcacagtatttatctaggactctctgcatctctcccataggtcttctgggaccagaggagcagatacaaacaccaaactcttgtggcttgctgtgctgtgattataaaatcctttgtctctgacccagaagtcctatgtcttcagccagcatgcatgaaacagtggcagtctaacttgttaccttccaaaaaggaaggaaaaaaaaatctcagaccggccacagtcttcgataattatcaaccatcttaacccaactgacatttagaaaatattccacccaacattattttgaagtttacatggaacaattactgaaacaaaccaaattcagaaccataaaacaattctcagtgaatttgagaagactgaaataatacaaatatataatcagacacaacaaaattaaattatacatcagtaacagaaagatatgtggaaaagcctcaaatatttgttaatttaaaaacacatttctaggccgggcctgggggctcacacctgtaatcccagcactttgggaggccgaggtgggtggatcatgaggtcaggagatcgagaccatcctgcgtaacatggtgaaacaccatctctaccaaaaatacaaaacattagccgggtgtggtggtgggcgcctgtggtcccagctactcgggaggctgaggcaggagaatggcatgaacccaggaggcagaggttgcagtgagccagattgtgccactgcactccagcctgggtgacggtgagactccatctcaaaaaaaaaacaaacaaaaaacacatttctaaataaccaatggtcaaaaaaagaaatcacaaggaaaattagtaaattttttttaactaaatttaaataaaaacacaatgtatcaaaattcagtggatgcacataaagcagcgactgagggaaatttatagctttaagtctcatggtgtaaataaagaaaggtctctgagcaagtatttgtcaccagcttaagagctagggtaagaaagatcaaattaaatataaagtaagtagaagaaagaaaatcataaagagcaaaaatcaaagacatcacaaacaatagataaaatcaataaacccaaaacctggctatttaaaaaaatttaatttgttaaaccgttgctcagttcatgggggagaaaaaagggagaagacacaaattccaatgtcagaaataaaagagaagacatcattacatatcctacagatactaaaagcattattaaaggatgttatatcaataaacttgacaacaaagatggaataggtaattctttaaatgacaaaaattattaaaaccgactcaagaagaaacagagaacctgaatagaaactacctattttaaaaataaggaacctgcaatttaaaaacttcccccaaagaaaatctgaggaccataaagtttcactagtgacttcaattaaacatttaaggaagaaaaataagggcaggccgagtgtggtggcccatgcctgttatcctagcactttgggaggctaaggtgggagaatcgcttgagactaggagttcgagactagcctgggcaacacaggaaaacctcgttgccataaaaaatttcaaaattagccagctgcagaggtacatgcctgtagtcctagctacacagtaggctgaggtgggaggactgcttgagcccaggaggtcaaggctgcagtgagctatgattggccactgcactccagcctgcgcaacagaaggagaccctgtctcaaaaaaataataataagagtgaattaccctgatgtcgaaacaaagacactgtaagaaaacaacagatcaatatttctcatgaacatagacataaaaacccttaacattttagcatatagcagcaatatattaaaaagataacattacatgactaaatggggaccatcccagtaatgaaaagtaggtttaacattaaaaatcagtgactgcattctccatactagaatagtataaagaagaaaaactatatgatcatctcaatagatgcagaaaaaacatttaaaaatagtcagcatttgatagggtgatgttagctagatggcagactaggatggccctctccgttcatccatggaaacatcaaacaaacaactacatgctgattaaaatggttttgtggaagctgtggaaacaggtcaaggatatgcagcaaccaagcaaacacccaatcaagaaaaagccacactgaaaacgataggaaatgtcatgctgtgcttgcttgcacttgccctagcctttccctggcatagcatgggagagacaaagagacccaattcctagttttctccctcattacagagaaaagtatgtctgcgggctgcccaagggactggttcttcattgcctgactcagagttcggatgggaatgctgggacactttggatctcaggttgaaggctgcagaaggtagtggcaagttctgtagtgcatgaaaactgcaggaaactgcagtcacctgtgggcaagagattatgggcagagaaaaacagcagaacagctgagtctctgtgaagcagcaggagtaaggctcttagagaaattaatacatgtaacagcagccatgtatacagcggaattggaaaaaaacaaaaaaccagacagacaaatccaaggaagatgtatatgccaaaaaagtgtaagaccttaggcctttacactgggctaactactgaaggtctttccccacatggagccagtctgcaaaaattgagagaattggctgttttttttcaaatcaccagttgtcaacaaaatatcacaagacacacaaagacacagggaaacatggccccttcaaaggaacgatataaatttctagaaacaaccctaaagaaatacaggtttgacctgacaaaaacaagaaatggggaaaggattccctattcaataaatggtgctgggaaaactggctagccatatgtagaaagctgaaactggattcctcccttacaccttatacaaaaattaattcaagatgtattaaaagcttaaatgttagacctaaaaccataaaaaccctagaagaaaacctaggcgtaccattcaggatctaggcatggacaaggacttcatgactaaaacaccaaaagcaatggcaacaaaagccaaaatagacaaatgggatctaattaaactaaagagcttgtgcacaagcaaaagaaactaccatcagagtgaacaggcaacctacagaatgggagaaaatttttgcaatctagccatctgacaaagggctaatatccagaatctacaaagaacttaaacaaatttacaagaaaaaaatcaaacaaccccatcaaaaagtgggcaaaggatatgaatagacacttctcaaaagaacacatttatgcagccaacagacacaggaaaaaatgctcgtcatcactggtcatcagagaaatgcaaatcaaaaccacaatgagataccatctcacaccagttagaatggcaatcattaaaaagtcaggaaacaacaggtgctggagaggatgtggagaaataggaacacttttacactgttggtgggagtataaacaagttcaaccattgtggaagatagtatggcaattcctcaaggatctagaactagaaataccatttgacctagccatcccattactgggtatacacccaaaggattataaatcatgctgttataaagacacatgcacacgtatgtttaccgcagcactattcacaatagcaaagacttggaaccaacccaaatgtccaacaatgatagactggattaagaaaatgtggcacatatacagcatggaatactatgcagccatacaaaaggatgtgttcatgtcctttgtagggacatggatgaagctggaaaccatcattctgagcaagctaccacaaggacagaaaaccaaacatcgcatgttctcactcataggtgggaattgaacaatgagaacacttggacacagggtggggaacatcacacaccggggcctgtcatggggtagggggagaggggagggatagcattaggagaaatacctaatgtaaatgacgagttaatgggtgcagcacaccaacatggcacatgtatacatatgtaacaaacctgcacgctgtgcacatgtaccctagaacttaaggcataataaaaaataataataaataaataaataaataaaagaaatacaggtttgaacttactagacaaagacttttaaaaaactgtctgggccgggcgtggtggctcattcctgtaatcccagcactttgggaggctgaggcgggcagatcacgaggtcaagagatcgagaccaccctggccaacatggtgaaatcccgtttctactaaaaaatacaaaaaattagccaggcatggtggcatgcacctgtagtcccagctactccggaaggctgaggcaggggaatcgcttgaacccgggagctgagattgcgccactgcactccagcctggcgacagagcatctgaaaaaaacaaaaacaaaaacaaaaagccacacacaaaatctgtctgaaattatgttcaacgagctaaaacaagaaaacagagaacaaatggaaatctagaccctctactcccacctcataactgtctagaaaagttaacttaaaatagatcacatatctaaatgtaaaaagtaacacataaaacttttggaagaaaacacaggagaaaatcttcataaacttgacataggcaaaaattttttaggtataaaaagcatgaattataatagaaaaaaatgcatgaattataacagaacaaaatgacaaatcaggaaaatttttaaatttaaagtaaaaatttaaaacatatgcacttttgagtatacaattaagaaaatgaaaaggcaagccacaactgagtggatatgttctctgaatacatatctttgacaaaggaacagtatctggaatataaagggtagtcttacacaccttaagaagaagataaatattttttaatgggcaaaatattttaatagacacttcacaaaagaagatagaatcacatgaaaagatgatcagtgtcaaatcatcagggaaattcataccaaaaccactttgagagactgctatacatccatgaggacgactaagataaaaacagactgataatgtgaggtgttggtgaacatgtacagctactggaactctcataggttggtggtgagaatgtaaaccatttggcagtttcttataatattaaacacatactatcacacaatccagcaattccaatcctaggcatttatccaagggaaatgaaaatgtatgactatataaaacttttacaaaaaatgttcaaactgggcctaggagcacatgtctatagtcccagctacctgggaggctgaggtgagagcattacttgagcccagatgtttaagtccagcctgagcagcagagcaaggccccatctcaaaaaaaaaaaaaaaaaaaaaaaaattgttcatagcaacttactcatagccaaaaactagaaacaatccaaattgctatcaacaaatgaacagataaacaaactggtatatggatacaacataccattggaacattctgaacaataaaaagtaatcagctacatataagctagaacatggataaatctcagaaacattatgccgaatgaaggatgccagacacagagtatatactatattattatgtttatatgaaattatagaaaagaaaaagttcatctatggtgacagaaagcagatcagtggctaactgagaccagagttgggagaaggactgactataaaagggcaagagagaactttctggggtgatgaacatgttttgtttcttgattgtggcggtggttataaagaggtatacatgtgtcaaaactatcaaattatacactttaagagtgcatttgatcgcacgtaaaatgttcctcaataaagttgatttttaaaaaataatataacacaataatacattgccacaattctatgtaataaaagcaacaaattaaaagattaaaagaaaaaagcccacttatgattccataatcctaacaaagctttttcattttctgtgtttccttccaatttcagtctgatgcatatatatttcatacaactgttatcattttgtataaaaaattttcatccagcttatttatgttatatgcatttttcacatttcaaaggctatacaaaatgaccatacaatatttcatcaagtagttatgctataatttgttatacctggttattcaccaatgcctagatatttggattctcattttttctgattataaaaaatattacaataaacatcttcacatataaagatcatttcttaatttcaacactgctttggataaactatcagtaaccatggttaacatttttttgtatgtaataaaaacctttttattttagaaattgtactagtttgctagagctgctgtgacaaagtaccacaagttgagtggcttaaaccacagaaatttgtctcacagtcttgatactagaattctgacagcaaggtgtcctaagggctgataccttgtgagggctgtgaggaaatgcctctccctacacttctggggcttcctggcagtctttggtattccttggtttgcagaagcatcagctgagctctttcttcatctccacatagcattctccctgtgtgcatgtctacgtctaaatttcccctctttataaagacaagagtcatgttgattagggtccaccttaatccagtatgacttcatcttaactaatcgcttctgcaattccctgtttccaagtaaggccacattctgaggtattgggggttagtacttcaacatatgaatttgggggcacaaattcaacctataacataagtaatacaagctaattattacaaactcaaaaagtcgaaaaatataatgaataggtgaggttcttctcagtcttcaccaaaccattccatagaagtaattactattagcagggtacagtggctcacacctgtaatcccagcactttgggaggccaaggcgggtggatcacctgaggtcgggagttcgagaccagcctgaccaacatggagaaaccccgtctctactgacaatacaaaaattacccaggtgtggtggcacatgcctgtaatcccagctactcgggaggctgaggcatgagaattgcttgaacccgggaggcagaagtggtggtgagccaagatcgtgccgttgcactccagcctgggcaacaagagtgaaactccgtctcaaggaaaacaaacagacaaacgaacaaaaaaaagaagtaattactatttacaccttaacttttctcacatttcagtaacatctcaccctctcacaaaccagcatttggtgctgctgatgtaccacagattacatataatatggcagtttgtattcactaaaaatagtagagaagtggtctctgaacacataaacatttaaactttgttcctacttgatgggtctttgcaaagtccctggcgtgtctcagaatcatagaatcacagattctagagctaaaaagcccgagagtgagcctgcctttaagtgtgctggtggcaacacatttttcaagtggctttacggacacatctaggcccaacatggtctgccacttcctagctagtaaactccatttaagttctctcacctataaacacggtgacaatatctaccttcatggagttgtgaatagttaacaagataatgcatgcataacacataccaagcattcagttaacagtaataccatccttttgaagattggttaaaaaaaaaaaacagaaaatttatcatcttaatcattcacactgttgtgcaacagatctcctgaaatttttcatcttgcaaaacctagactctgcatccattaaacaactcccctatcacccccgctccccagcttgttctactttctgtttctataaacttgactactttaggtgccttatttaagtggaatcatatagtatttgttatttttttttaatatataggaatgagggtaagtaatttgtaaaagatctcactggcagagccaggacaaatctggatggtctgattcccaaaggagtgacgcatctgaggttattttgtagtttcagctgaactacaaaagcctcctgattagccagaatttttataaccactctttatgtctaccatagagtaaagtactattcaaaccacacagcttttaaaagacctggaaatcatgatttatgggtttaaatacacttggttcctctgccatgctgctaatttatagaaactccaatattgtcagatctgataggaacaatagtcaaactaagacaaagtataataatctctaggtcaaaaagagtaagccagttacagttaccagctcacaatgactggatcctgggagggatgtcagccccctaaagaaatgaacatgtggtctgggaaatcactgaacttcaaaacagatgtagcgatcaggcagccacgtgtagtgcagacatccacacatcctcactagtggctattcattaagaaatacctcccactacagacgtcactgtttaaatttacttttcacagggatttatccctaaatgttccaaggagcattactcaggcaatttaggttgaaatacagtgagcttatgtcttggaaatatagattacatctggaacatagagacctaaaaattcgcttcccttcagactgaggctggggcacaataggggaagaggcatcagaaggggcctggaggatagagaaggggagctggtcaatgttttactaactaagccaactcagttaaagttatagtttaatggaaaagccaacatgatcataaaacaaaacaaactgaaaacataaaacaggtcatccggagaacatcagtaaataccataaacatcctgttcctaattggcaatagatgtcttgatctggcccatctgagcactggcaaatcactaagaaacaatctgatacaattagaattataataagcagaactccatgtaaataaaatgaaaaaaacaaaataaaacaaaacttccaaacaaaattaaaacctacctaggaatacaaatggtatctcattttacccctttaggggaggcaaattttcataatgggaagtttaagaagttcagtgcactcacattaatgactcaggagacagctaccactcccacaaaacatgcacatatagagacattttaaaaattcacaattagaccttatgtgtggaatgaagtactgatcacaacaaatggacttgaaatactgaaaatgggaataacagtaatttccacattttccagagccctgtaaaatgatgctaaatgccatatttacactgcaaaactatgaaatgctgagaaaaaattttcagactaaataaaaccatgatatttaagaaagcaatggcattttgtggatttactaaatgtacttgctgaatttagaacctaccaccaattctgctaccctaataaagtatgacagaaaacttttgtggtttccaaacctccaggaaaaatacacttacaaaagtataaaaaaattttccacaatttctctttttcagatgcctgttactagccacttttattcaataatagacagggggtgaaaaggaaaaggattcaactttattgtagtccctgatctatgctctagggatggaaaaggacaccaaaaggcagtgaggaaggcagaggagaagacagcgtctccccgggcagctgcccaggaacacggcagacaggagtgagggtagctgcccaggaacacggcagacaggagtgagggcagctgctgggatgcgctgtctcctgctcctccctttcgcacattctagtgacttctgtcatggatcccaccacatcttccccttatacttctcagggaaaggtctatcttcaaccacaaaacctcggcattccttcttagaggaagacaaactgcccgggttcccagagaagacagaataaactgcccaggttcccaaagacagaatgtccacccactccccaggagggcaaagcaggggaggaacaagtgcaatatctgtgaaggatgttgtgatttgacaaccatatcatattcagctgtctctgctttgcccaaggtcacacccccatcccatagtggccacatctcaaggactgatggatgtagagctacaaaggtccagccctcccgtcccagcacaggaaagctctgaggggtctctcgcttctacccccacaggcacagctgacggttctgtggagactgcagtgcagctaaactttttcctctgcacagtcctgtctccttcctttctactccatagctgttcctccccaaagcactccctgaacactaatctccatctcaaagtcagagttcctgagagcccgacctatgacatcatctctcaacccactctctctcctctctaagagaaatgatctacttggtcagttcgggagagaaaatttaaaatgccctgcccgccataggtcctttttcctttgtctttccaacttgccttgcctgcagaaaggatgcgtcctggcctactgctgcaccatactgggccaggcaggctcagtcccagccaggtaggcctctgggggctcagctcaccagtgcctggtggatttatctactaaatccagaggagccaaccaaaccacagacacaagctacattcttgaatctgtttaggtgtaaaggaactgtccaattgcctgcctctggtatcttattctcaactagttcctaagacaggagacgactgacagaagtgttattagtctcctaaaacctaacgctatcctccactgctccactcccacttctccaacatctcaacctgccaattcctgccctcctgcactgtgctgaacgtattttcaacaaagaagccaccatctgatttatatttacatatgtgtcccccagcccccatttaaaccctttcaattaaaagttttgccttccaagttaagtgaattctttactacgggccaagtggcccattgggatcaggcccagctaaaccttcttgagtacctaacatttgattaatgagatggccattcttcttatcattagcaagaagaacgtttctagctatctctctgcctacacctcaaatcactttcaggtctcctagtaccatacaggccctcagcctctgctcacttggggccttgttcttcatgttgcaaactcaactgttcccctctggaagcctcttaaccacccctgcaacctctctgcactcctccaacaaagtgtctctcccttccctctggctacctcagcgccttctgcatgctgttccaccccttcacttggtaaaatgcaataaaatcaccagatcctcaaaggcaagacctttccatccccaacacctgcttgtacacagtaggcactcaggatacaattgtggaataaatgagggatggaggatgaagaaaagatgggaggggagccagggcggaagcaggggcatgcggagcatgacaggtgccacattacaacactctcgcagcactattgcctcacaccattaatttataaacaaactcacagtcctccaaaatgcgtcccaaactatttttctaaccttaacttctccctctaggtacctcattctccagcctaactggagtgatcactatttcttggccatggtcaactttgtccattctctcctctccatgtggaagtccctctcctcatcccaccacattttgccacaaaaattcctattcatttctttactgattcagcaaataatcactgaacgcttactgtgtgccaggcactatcctagcctgtacaagaaggtctctgcactcatggaacatgtaacttagttgggaggtaatggggagacagaaaaaaacccagcatgtcaggagctgatgagcactaagaccgcgtgcaagcgaagagagtgagggtctagcccaggatgatgaggcaggcctccatgaggaggtgacatccagcagtgacccaaatggtacccagaggagcagtgttgttctcggagaggagcagtgaaggcagatgcttaaacccccaaaccccaggaaggagttgctgggcacacatggggaatagtgaggaggccactgtggctgagagaagtgagaatatgagagaaaatcagtaacaccccacagccaggtcacagagggcctcatgagccaagcatggactttgcatttcactttgaataagacaggaacctacccgaggctcctgaacagagacacttaaaaagatccttcttggctgggcacgatggctcacacctgtaatcccaacactttggaaggccaaggcaggtggatcacctgaggtcaggagttcaagaccagcctggccaacatggcaaaaccccatttctactaaaaatgcaaaaattagctgggtgtggtggcaggcgcctgtaatcccagctacttgggaggctgaggcaggagaatcacttgaatacgggaggtggaagttgcagtgagctgagatcacaccactgcacttcagcctgagcgacagggtgagattccttctcaaaaaaaaaaaaaaaaaaaaatccttctggttgagactctaggagagcacacacaaagatactgcaatgttcctggagagggcaacagtggcgtggatgggggtagaagcagtgaggctggtaggaagtggtcagattctggacacgtgtcacagataaaatcaacagactggatggattgatagacttgaggtgagatgggagagtaagagcagccaaggatgatgccagggcttttgacctgaggaaacaggaagaatgaagctgctttttaactgagttaaggaagcctggagggagaataaagttttggggaaaagatcaggaattaatctggaacatgtttagtttgagatactcatggtcacccaagtggagatgtcacacaggcagctgaaaatgtggggctcaggggaaaggttcgacctggagatgtggacttaggacctgtcagtgcttgtgtgcacacatgtacacacacacacacacacacacacacacacacacattgtaattctttcatggctctttccagtgatcttgtaacagatcagttcaaaataaaacaaaattctgggtagtcttaccttttagaaaaagagaagggaaaaaattctgaattattaaattttaaataattttatccattcagtagttttttattttgtgcctgctatgagttacaacacaaaacaaaaaagaacatgaacaaaaagacatggcccaactctgcggaatataatgtctgaaaagctgacaaatcctctttaaatggttgcttccttaattatttcagtaaaaaaaaaatttttttaagtttgccattcagaaatcaatgcaggtatttctttaaagccacaatgaagacttagccctgtgccgtccccagcagttccagcctagtgaaagaggtctgtctgaggagccagggttccgtgcggtgtagtgcggctgcagtgcagtcacaccaccacctggagtgcaatctaactgttcctcataccagtgagtggtttcgagagctcaaggttcctttcaggggtgagatatctttggaagcacataccttgctttctatgctgcatctggcccatggatgaataaagaaccagtttccaatgcaaaattatttaaccttattgtgtccggaatttattccttcttgtgggttctcggtctcgctgacttcaagaatgaagccgcggactctcgcagtgagtgttacagttcttaaagatggtgtgtccagagtttgttccttcagatgttcagatgtgtctggagtttcttccttatggtgggttcgtggtctctctgacttcaggagtgaagccgcagaccttcgcagtgagtgttacagctcataaaggtagtgcggacccaaagagtgagcagcagcaagacttattgtgaagagcgaaagaacaaagcttccacagtgtggaaggcgacccaagtgagctggtggccgctgctggctggggtggccagcttttattcccttgtttggtcccgcccacatcctgctgattagtccattttacagagtgctgattggtccatttttacagagtgctgattggtgcatttacaatcctttagctagacatagagtgctcattggtctgtttttacagagtgctgattggtgtgtttacaatcctttagctacatacagagcaccgactggtgcgtttacaatcctctagctagacagaaaagttctccatgtccccacttgacctaggaagtccagctggcttcacctctcattatcagatttctttttgtaacttcactccattttaccagtctgatcttgcattaggttcaatttcaagtatgaacctttgaattccactgtcataccaaatactattttagaccatgagtttatctccttctgttttacttttctgagatctatatgcaatatttgcagaaagtaaaaaccaagtccataaaatatccaaactatgttactttttcaatggtggttgcaaacacgtttcctaaaaatgatacatcaaggtcatactgagacagccaggtgacaggggtccctggagaaactccaaccagcctgcccactgactgaggtggagcctcaggaagttcacaacatttgcagcagggaggcgcctggcccctcctcttcctgtgaggaccctgggattcgaatggcaggcgggaagcactccagcagggactctggtctagcgagagcccctgtctccccattttcttccttttcacccaataaaacccagtctcactcaccattcaaattgtctacaagcctgaattttcatggccatgggataaagaaccccgtccttagctgaactagggaaaagtcctgcaacaatcctatatttgaaagttccaagtgtggagaacagagttcgtgattaacctaaagaggaattcttatgagggtgcaaatcaaagagagggatattttaaaaagaaacttatttattatttggtaagttataacatggaataaaggtattacttgaaggccactctctcttttgccaagatcttgtggtgacctccaattattgggtctatgccatttcagcaaccatggaaatgagcataagctgactgactgtgttagtccattctcgcattgctataaagaaatacctgagactgagtaatggaggcaatgaataatttatgaagtaattataaagaaaagagcttcaactggcttgtggttctgcaagctgtacaggaagcactgcagcatctgcttggcttccggggaggcctcaggaaacttacaatcatggtggaaggtgaagggggagcaggcatgtcacgcagccagagcagcagcaagagaaacaagggaggtgccacacacttttcaacaactagacctcgcaagaactagtagtaccagggggatggtgctaaaccatttgtgagaaaccatcctcatgatacaatcacctcccaccaagccccactcaccctcaacattggagattacaattcaacatgagttttgggtgggacacagatccaaaccatatcagtgacaaacatatattatgaactcacttcaggattgtgcaaaggagtaaaattaactgaggctgggaagaaggatgccttattgaatgcatatatcttctacaatgaatggcagtgaaaaaacaaatacaaattagagcaatttttaagaaactgaaagtactttattaaattcactatttattcataacatccttgaataaataagatttttttcttgcaattgtgtccatgtgtccctgagtttcaaaaaccttcaaagaaatgtttttttatgccccaaacaatgttatctcaaaacactcctggcttttagtaacaaaatcctgaaccaaacagctcaaatagaaaaggaaagaaattcgagcatttatgcctggaaaagacttgatccagggtccacacaatgtgaatatgacctgttttctcttgctgtttttctcagctatgttttgtcaggactaactccatttccagagacgctctgatctcatggttccacatgaccaacagcaacttcagggattatgtgctacttaattcatgttcatcaggaaagatacaatccacttcccaatcttgcaaacaaatgttacagccctgaatctcatcagccttgacggggctcatcttgaccaaccagtgtggccagaggaacagagaagctgtgttggttaagccaggtaggacccactccaggagccacataagatacctctcacccagaatgaatcatgcacagctgggaaattcagggtactattaagaaggcgggaaaggaggggagatggatactggaaaagcaatgaataaatatcccctatacaggcaaatacaaaaattcaattatcaattaatctttaaaaaaaaaaaccctgaggttgtagaaagtcaagcaaatagaacgcaggtagaaaaaaaatatcagtaatgtgtttgttacttaaaagtaataaaaatagtagatggagctgtggaagaggaatcgctaacatccctggcctcatctctgaatttcaccttgcctctgctatttttcactaatcatcttattttcccttttaaattgccattcaaacttgaacaataattatttccctaggtttccatatctcagccaggccaggctagtaagggtataaaaccattccaaggagaggaaagaaaatttctgccaagtacaaatctgtgcataggtttggcatgtctggagctagtgcagcaagatgctaggatctgggaagatcagggagtggccttcatgatatgtggatgcaaaaatggaaaatggagatattagggttgagaaaagatgaagagaagctgcatataccaaggtagaatgtggattttatcaaaatttattactggttaataaagttggggtgtgtactccaagtagtgcacaagatagtccactgagatgtgaaaacaacattagaatatttatatgtaagaagaaatcaagctttattaatatttcacaaatgtactcacactacgaccttagccagtctagatgttatagatggtcatgtgtcacaagtagtccaagtgggaccctgagggaagggtggggattccacctcacagagggctggcaggagccctccggttcccacttcctctcaggatatgcattatggtctccatgtgaccagtaaggaaggtctgctgattatgctatctaactaaaggaaccatcagatggacacctggcttcaaaagatccctgcaaagaagtcagagattaaaaatactactatgaatgcaacctaagagaactgggaaatggtagcacagacacttctgcaagcgaatcatcagcctcattaaaaggttatgctaattaaaagttggcaaaaatgtttcaaagttatcaggaagattatctgaaaaaataaatttgtacaacttttaattcatttatgcatatcatatattcattaatttattcaaaaatttatgccgtgccaggtactgttcaatttgctaatagtaaacaaaactgagaaaaaccaattttgccttagaggatagtggccattgagattctcaccaaactgactaatcacaatgccaatcaaaatgccaacaagttattttgtgttttagtgaaacctgacacacacatcctaaaatttatgtaacagttaatgctaagttccaatattagccaaggctgtcttgatgaagaacaagatggaagaacttcctcctggatagcaagatacttacaaggccacattaatgatgacagtgtggaactggcataaatatagtatatttgtcagttatccagagaaactgaaccaataagatagacacacacacacacagggatttattataaggaatcagctaacaccattacagtagccagcaagtcagagacacaagagagcaaatgcccagataaccaggagagtcaccggtatagtttcagtcagaaggccagcaggctttagacccgggaagaggtgacgtttcagtctgagtgtgaaagcaggaaaaaggacaatgtctcagtttaaaagctttcaggcaggaggacttctctcttactcgggagcatcagccttcttttctagtcaggtctctcactgactggatagggcccacccgtattaggatgggcaatctgctttactcagtcaactaatttaaatgttaatctcaccccaagacaccctcacagaaacacacagaataatgttaccaggaccttgtgtccagtcaagttgatactaagattaataccataaataaacaacaaaaccaatggagagatgcaggatcacacctgtgcacccaaaggcacctgatgcatgatgaaggtggcaccacagatcagtgggaaatgcacccaaaggcacctgatgcatgatgaaggtggcaccacagatcagtgggaaatgcacctgatgcatgatgaaggtggcaccacagatcagtgggaaatgcacccaaaggaacctgatgcatgacgaaggtagcaccacagatcatgattttcaataacggtgtcaggcaatgggacatcaacgtggaaataagatgaaaatggactacttaccaccttacaccacaccataagttacaggtggatcacagacttacataggaaaaggaaaccaacaggcttttagaagataatatggaagatcttcatgaccttggactgcagaaaaatttcttaaataaggcacaaagtggccaggcacagtggctcacgcctgtaatcccagcactttgggaggctgaggtgggcagatcacgtgaggtcgggagtttgagaccagcccgaccaacatggagaaaccccatctctactaaaaatacaaaattggctgggtgtggtggcgcatgcctgtaatctgagctacttgggaggctgagacaggagagctgcttgaacccaggaggcggaggttgcagtgggccaagattgcgccattgcactccaacctgggcaacaagagtgaaactccacctcaaaaaaaaaaaaaaaaaaaaaaaaaagcaacaaggggcacatggggggcagggacatccaggagcagtcaatgttctgttctatttccttgggtggtgattacaaggatctgtcacaatttattaagcttggcatttatgttttgtgtaagtctgttagattttttaatttataagttttttctttttgaaaaaagaagaaagtagaggacagacgctatctggatattgcttagtattgcatttcgaaagaaaatacagatagaatacaacaccttttgatctctgttcctggtaccctgttgtgtttttttgtctttttttctttctatcagaatcaaaaaataatagtggtatggttttgccagagaagacaggcatcctcttacatttggcaggccctggaaaccttccccatctattgtagcatctgagaacagactgtctttctaggtccagtgctgtatcctcagcctctatagttgtgcctggcaaacagtaggtgctcaaaaagtatctgttcagtggatttaccagtaaaactacatttttcaagaccacatattcccaaaatacatgaaagagtcccggaacttcgtctctgaactgtaagaagagctgttgaggtggtgctctatgatggcacattcaaggttgtcagtaaaactccaaaacattttatcaatgtgtttccagtataacacatgctaacatgtcaagtgtcaaacagaattatttcttctctgtgctaaaaatacaactcagtctatcattttcaaatttattaattaatttgaatgtttactgaattttgtaatttactgtagaaattcttagtttttgatttagagtatttcaatcatacttgtaatgctccagtaacacagaatgacccaagattttattaccacaattagaacatcctagcacatggtaggccctaataaatgcttgctgaatgaattagcaaacattaaaatatggctgttttataattttcacaaggatattggatgtcaaggtacacatctttaacagatactatgtcactctaaaacctccatgaagaaaatatcacctccaagataaaatcaagtataccggagatgtgaactgatttataaaccaacctacagactatcttctatcttgctgcatttacagccaacatgagattatgtatgtactgactgatgatgggcaatgtaattagctttagagttgttaagagttaaataattaatatgttaataaattgttaagagttaaatcattaatatgttcctagacatctttttatcggttcatgttatttagttcaggcttgcttggtaactgaggaaggaaactgttttcccaacctcgcatatcctcacctgttccctacccacatattcatctcaatgtaaagcatgtttgggacttgctcaattcagccaaccccaccctagtctggctatcacccccttcattgccaaagttctccctcctttactgccaagtttcttgaaagagtgaagtttattatctctgcttcctcacctcttcaacatttctcaatctggagcaatctggctgtttccctccacctctcactaaacctctcctcaccgagtctttgctcacagtggctaaatccaagtagtgtttcttgatccttctgctgtatgctccacagctgccctgtccaacacggcggccgcctgccacatgtggctgcagagcactgccgtgcagtaagcaccagggaataactgaactttgtatttaattttaattcaattttaatttaaataccgatacttgattcagttataaaattcctcggaacaacttgggtatgtgaatctactttttcaaccctacattttataaaatctaaatacagatcaagaatttccaaagaaaatttaacatctgaatgaagatacaacacgtagatataagtgttagcgtaacatacacagtggatttcaaagatacatcatgaaaaagattataaataatctcaataactttaataatgattaaatgttgaaatgatggtatttggaatatactgaattaggtgaaatatcttcttaaaattaattttaactatttctttttatgttttttaaagcagcacctggaaagtttaccattatctatgcagcatgtattttattcctactggacagcactgctgtatggcattagatatgaatgagcactcattctccgttgcttctctccttctacttcttggacccctccttacattctgtagcatcaatcattcttccacttccccttaaggtcagtgtctccccaaggctctctctagttcccctgggcccctaccccagcactctctgggagcggaccttacctcacctaaggcttccactattcccacaggtggctgactttcaatcctctgccagcaaatcagcttgctctcctgacaatgggatattcacctgctctctgtacatttccagctatgcctaagtgtatcgacatttaatctgccattataccttctgggtatttgccttattaatatcttataaatcgggcccccttctccatttctttgaggccctcgcaatttctcaacttatcactacaatagcttccaacgtctatccttgccctcttcccaaccaacttccttttgctgttagtctctaaaactcacactggctacatgatatctctggctttttttttccttttttctttttttttgttttttgagacagagtctcgctctgtcacccaggctggagtgcagtggcatgatatcagctcactgcaacctctgcctcccaggttcaagcgattctcctgcctcagcctccctagtagctgagagtacaggcacgtgccaccattcctggctaattttttgtatttttagtagagacaaggtttcaccatgttagccaggatggttttgatctcctgacgtcatgatctgcccaccctggcctcccaaagtgctggggcatgagccaccgcgcccaggcatgatttctctgttttaaatactctggtggctgccccactgtcatcaagataaaaaccttctatagtcatatgcaaggactgtgcttgctggtctctctggcttcatgcttcatcaccaactccacaaaaccccaagttccaggcacacttaagtacccacagttccctgaatacgtttgctttctcaccaccatactttgcatagtctgtttctgctgacaggaatattctccctaactctatccttgctctcctagctgttcttcagaattcaattaacacgtcacctgccccaggaaatgtctccaaacccccttgtcagagcaagtgtccccctctacgtcagcgtcacacctaaacacagctttagcaataactcaaccacgctgccctggagtgacctggttaccagtctgggaattccccgaaggcacagattaagtgttttaactccctgaactatacttaataagtacctactagtaagtagatatagtattaaacaagaaaaacaataaaatgtgaggctagaaatttttaaacaggctaataaagtcatgagttaaatgaagaaagttaatccagtcactctaaaaacacttcattagatggcctacttcaggactcaatgagctatctaatacaaaattatatgctaaatattcattaaaatatcaaataataaaagcaacaattaaaaaaattaaggactaaatatgtcattttgtttcttcagccttgttacacattctttcttccctaattctacttatctgttcctttcttcagttccttacattaattttccttccaattaaagtttgtattctttccttccattgcccaatccctctcactcccttctatctttcaaacagaaaaatataaatactgtcttcatcatctgttagcaattttgtctaaaacaaagaaatcgtaaaaagcagtgaatgtaacgatatcaccagtcagactgatagacaaaaccatatgcactaatctggttggatgatttcataatactaagcagctgatctgaaccacaagcatactaagtggagtctgacaggcatcagccagtcctggggttgctgcagcaaggcagtgcggggaacagaaaagaacagccaatgcgctgctggtgagggcagctgcagcccagcctcaccacatctctaccttatgcctacccttcaggagaaagtagaagcagacagggaaatctagaaagctgtcagctatctggactagcacagtaggtagccaactggaaagtgtgagtgagcagcagaggctgcgcagcaccaagatccagtctgtgcatatgctggctcaggcaccaacttcgggacacaaaataaagagtgctgctcccgccgcactgctgaattttcatttcactacaaaatagattttgagagaggcatggaagcatgtggaaaggaatttaaaccaggttgatagggaaaaacaattttttgaaggatagcaattgctagagtgaaatggaatacattattttaatcacctgaaagaaacttttcaaaaccactcaacattaggtcttcatcctaaagactggtatcttttggaattcacagtcaagcaaaattgaaatctcttgaaaaactttttactcagcaagataatgtaacagtgaagggtatgtttgaaaaagtttctaaaacatcatagaactggattccaccccaccccaaaatttttttaagcagcacttttaaataatcaatttaattcaaagaagtgcagagcaagatttactctcttacctgtatccaggagttaagttttgattgtccagaattctgtggttctttgttaattagacaacataagcaccatattagaattttttggctttcatctacaaaaaggaaaacttaataagttttatcaagcagaaaaaatcattaatataaaaacactgtaaacattatatttaggaaaatctcaaactactaagttcacagaacaagtatccctgaatataacatttgctttctcgccatcatactttgcacattctctttctgctgatgggaatattttccctcactctatctttgctctcctagctgtccttcagaattccctaaacttaactttgtggggttttgtccttcttgtggccttgggatcacttaactcttgtgtggtcaatttcctttctgtaacagtatcaatttttaaagccaaacgagaatgatggaaagaactaagagaactgggcttttttcatgatcagttttttcacatttcaaatggttagtaatttcgacctttctaaggcaacttaatggttataggcagttggtagccagtatttgtgatttaatcttttaattttttaatttgccaaaatagctccacttgttaaaaagaaatttaataaaaaggattgttttaaaatatatttctagtaccaagtgctttggataaaatagaagtctcttacatgctcttttactctaaaatgtaaatctttataaaactttaccaaacatgcaatgaaaatctgaactttgaaatcttacattttgcaggaacatctacttgatgagctactttctttctccttttgtggtgactgagtctattccagcggatgattttataacacaattaagaaacaaaaatggggcctagaaactgaagatgtcagtacccgagctagggcaaagcaacttcagactttacaaggccatggaggtgaggctaagacagccggtgcctggaatcagtactctctgccacctcatcttctgcaatctaataaacccaatctttctcttttttttgagacagggtctcgctctgtcacccaggctggagtgcagtggcatgatctcagctcagtgaaacatccacctctcgggctccagcgattctcccacctcagcctcctgagtagctgggaccacaggtgtgtgccaccacacccggataatttttgtattttttgtagagactggatctcaccatgtcgcccaggctggtctccgactcctgagctcaagtgatcctcctgccatggcctcccaaagtgctgggatcacaggcatgagccaccgtgcctggccaaaacccagcatttctaaggacttcattaacaaagaaataagaacaataccaactctagtaagcgacttctgtatttttatccacaaactaaataatgctaacagtaatttttaaacccatttttttccctgtgaacatacatagcttatgcttttccaataactaacatctctgaaaaaactttatcaggggttattctgaggccattcatttttttcccctagcttttatgagctcaaataaagcattataaagcactggcttgcctgagatcagttcatttcaagagtcgtataatttaaccactaaagattctaggattcttcaggtttaaccaatgccactaattaaaaatgtgactgttatgcttcccatagtttcaatattagaagaaattctacctagcttcatgtagtaagtgtgacagatgcatccaatggcatccttacgcatgcagcagggtgttaaaaagaatgtaatctgatggagagcatttccaaaaaccagacattcaccaccaaaaaaaaaaaaaaaaaaaaagaaaggaaatgtcagtttatgagtttatgaagcttaaatctaaaagaatacccaaaactgggagtttccccaggtgttgagtgattatgcaaacttagttcaaaaggtatattattttttatttttctcccaaaattttattttttgggagaaaaataaaaaaagagaaggagccagagaaacttccacccaacctgtaggaggtgactttctgtgcccagagtcaatgcactgaaatgcactgctaatgagcttacagtttgctttgcttaggcaatttacaaacatgagccatggactgttattcacaagtgccaccagcactcactccaggggctggcatctgtcaggctcctccctggaggccctgagctcaggctggagcatcccacagggcatgttaagtgagatgggaaactgcctgggattcactgcagggacagtcactgacagcccatcttagtgtaaatttggattctaaaactgagtggaaaggaaaggaagataacaacatacacttgccatcttgtattttattttttgatatctggaattgaaattctacataaaagctaaagcaattctttaaactttaattctatagtttaaaagtatgaaggcagcaaatttttaagacaatattcactgttttaagctgctaagtttggcagaaatttgttatacaggaatagtgaatagtgaagaagagaggtaacagctgtcatgcttaatcgtgagggcagagttagaagcaatggatcagaatttcagaaggtgaaggcagtatttttatgctgaggacatcatcgaataaaaaggtattctctaactttccattattatctattttgtctcttctcttttcagtatcttttcatttccaaatcatccctccttccttattacccttttctgatcctattctccatgaacactacatatgacttacttttttccatgatgaaaattgtttgcttttactgtaattaaaaagcaattttgggccaggcgtggtggttcacacctgtaatcccagcactttgggaggccgaggtgggcggatcacaaggtcaggagatcaagaccatcctagctaacacggtgaaaccccatctctactaaaaatacaaaaaaaaaaaacagattagctgggcgtggtagcgggcgcctgtagtcccagctacttggtaggctgaggcaggagaatggcgtgaacctaggaagcagagcttgcagtgagccgagatcgcaccactgcactccagcctgggtgaaagagcgagactccatctcaaaaaaaagcaattctgatattataaaaccataagaaaagatcccttccaggaagaaagcgcccaactagtcaaacaacaggggcgacacaggcaacatctgactgctaatggagtttcatgccattcagccacctctgtgagctcacagccagggcatacctcaacaggaaactgaaatttatgagcagttcaaaaggtaatacaagcgttgagacagaaagggatggagaatttgtttctggttgtcagaggggccaaggtaatgcagataaggtgctaaggaaagatcacagacagatacaagttcaaggacaccagaataaatcagtctgaactcctacttttacaaagaagaaatatgagaccccacgagttcagatgccctgtcttagagaatcacatcttcaagtttgccccagcaggggctctcctgagaaaccctccttcctctcagcaactgctactcccattcagagaaccatcacattgagtcaggctgacctgcttaagtatctctttttccctgactggaagctcctaatgggcagagacagtgagccgcgttttcctaagggctggcacacacaaaaaaacactttgtaggctgggtgcagtggcccacgcctgtaatcccagcactttgggaggccgaggcaggcagatcacaaggtcaggagattgagaccatcctggctaacacggtgaaaccccatctctagtaagaatacaaaaaattagctggatgtggtggtgggtgcctatagtcccagctactcaggaggctgaggcaggagaatcccttgaacctgggaggcaaaggttgcagtgagccgagatcacgccactgcactccagcctaggcaacagagcaagactttgtctcaaaaaaaaaaaaaaaaaaaaaaaaaaaaaaaaaaacccaacacttggtaaatacctgctgaattaatatgtatgtgcaagtgaagctggctagtgggaatgccaagactggaacacttcgatcacaagatgtgatccaatagggacagaacattacagaaggtggactttaaagtcacatgaggagtggggttctggctcttcttagtgttgtattctagggaaagcgacttattgactctaatccataattatctaccctgcaacactgtcatcaagaattaattaggtccattatgtagcccacagagaacagtgcccagctcaaagtgagcaatgcctctcacacgacatcataaacctccccacgtttctcacatttctgacttgaggatgtattacatccacgatgtacatttaaaggacgtaatatttctttctttctaaaaagcaattaataaatccatgaagcccctaacaatgggtactgctttcaaatgaaggtcattcaacaatttcttttcctttttcctgccatcgatattggcctagatcaatgttcttcaaacttctggtcaagaagcatcaagggttatgaaatccagtctcgggtcatgaacaccattcactatgaacagcatagtgaacatggactgcacagaataataatacaatagtccctctttatcaatggcggaaatattccaagaccctcaggggatgtctgaaactgagaatagtaccaaaccttaaatacagtgttttctcctatacacatacctatgataaagtttaacttataaactaggcatagcaagggattaacaatgacaacaatacaataaatcaactgtaacaatatagtgtaatagaagttatgtactacactatattgttacagttgatttattgtattgttgtcattgttaaacccttaggccaggcacggtggctcacacctgtaatcccaacactttgggaggtcgaggcgggtgaatcgcctgaggtcaggagtttgagaccagcctggccaacatggtgaaaccccatctctattaaaaatgcaaaaatcagctgggtgtggtggcaggcacctgtaatcccagctacctgggaggctgaggcaggagaatcacttgaacccgggaggcagaggttgcggtgagccgagatagtgccattgcactccagcctgggttgacaagagcaaaactctgtctcaaaaaaaaaaaaaaaagttacataaatgtgatctctccatctctctcaaaatcttattgtactatactgtgagtaactgcaagtgcagaaagtctaaggggggtgccattgtatgcattttttcatgagatgtgtttcactgtgtgtgtgcatatccacgtgcatatgcatatacataatgtatttctggtcaaagatgtctgagaaacactgacctaactgcaatagataaacctaggacaggtaagcgtggtcctggtgggcaaacacattgctgcctcactggttttgccattttgaatcaagaacttgaagaagtttaggggttgggggaagaggtataagtgggaaggaggagggacatacgagggtggggtagagtgagggaggctgagtgtgtgggcgtccacgcacgcctgctcacagggctaaacacacatattgtccctttcctgcctagttcacgtctcttccaataatgattatgacaacctataaatgggaaactgcatgattctttaaaacatcaaaggggaatattcattttattttgggttctaatgtcattatattatgcaattagtctttgactttaaaaaatcttaaaagtaaatattacattagctaataatacagtcaatccaaagcaaacctcagccatgttccttgggaggccctaggacaacaaagagaactaaaaccatggttcctgttctcgagaggcatgctgtcttcccagggcatcagacagtgaagtaagtgtattaaagggagatgctggaggccatggagacactcccagcagctcctacctcaggccagtaaggctatttcaaaggagaatgagtgtgaaaggaatcctgacacaaagtgccttcaggcactgttagtaataggacctggctaccaccatgaggtatagctgtgaaagatgaaacaggaaatgagactggacagcagacaggagctcagtgaaggaatacctccccaaagtgcccccacattcatctccaccttggataaaaccaaaatggcacccttaaataaggtcaaagcagccaatgtcaaaggcaaagtcacggcaggattcacactctgaagaatgactttacaacatgggaaagagtgtgtgagttatgaaaccgtgaaacaaaattaactcggtatcattagtatagccattttatattgaatttaaaatgaagttatgaaagtgattacaggcaaaagtagatatttaaatcatctgggagtttctgtcctctaatacgaagagctctattttcctgaagatctgcatgggtgcgtgcacgcgtgtgtgtgtgtgtgtgtgtgtgtttatctatacaaacctacacacacatacatggacaacagtataggaagccatctttgtaatagaacaatgaatacatttgataagttgttccattaaaaaaaaaaaactaggagaaaggttcataatgtaagcctctgtgaaacaatgcaaagattaaaatagccattttgagaggacacgtttttgattcttaccatatgctaaaataaaaggattccaacaagcttttgccaacagttgaccaattgtggggaatctttcaatgactgtattagaatcctgtgaaagaaaaataaattttggtcagtaaaggcattatgcaacttagaaatactgaactgacattatagattgagggaacgtgaatgcttcttgtttagtataccatttttaaaagtaagcacaaaaggattagagaagatctttaggtaagtaattcaaataaagtttaaaaagcaaccaaccaacttacttcatccttaaatggggtcaccaaactaagatgtatgacataggtaaaatcaattgtgttgcaaaattaattctactcatacttaatagtcagtaaaggctactttatttaaaaataataaagactgcttaagagttgaaaacacattattggtgattaataactatataatcccgtatctttatcctggtttttttattctaacataagagaggttacgaactcagctccagtaagactatttcaaagaagaaggtttaaagggatgagaactctggaacttgtaaaaagaaataaaagcagccaaagcataaatgtatatatctgtttattactattttgagtactgtatggcaaatgacatcatagtctgtaacaatctaaaccctgaaatagaaaaaggatcaaccaaatagaaaacagcttaagatttaaaaacacacatgcatgctattgtacaaccggacctttttccacttgttacctttcataaaatttcaaaaataaaagcaaactaggataacatgcaggtaagccgacacaatgggcactttctgctactgcagcaaaacatctctcacatgtgtcccagcatcaagcctggtcctacactttttgggaccatataaaggtcaagttacgtatgtctcattaaaaaaacaattctaaaaattagcatcggttgttcacacagactgtatctttccttatagtttctaaagacatatgaactcatattatcaatacaaattattcttcaaatttcctatttactctttgattaagggaagaaaagcttaacacaagaacactttgttaagtgacaattttgcttttcattttgaaattaaatacaaaatactagctcataatataacaacatgtgctaaatcataaaaatatctatcataataaaagaaacatgacatcaaaatgaaaatatattaaattttgaaaataataaattatataatagtaaagatactcaaaatcttaatatttataaaaagtattataagaagagatcttaatatctatcatctcttaggacagcccacttgacaagagggttgaagaagggttaagcatgtagcaaattctccaagattcaagggacacaaaggccttcaaaagaatcccatttactacttgacaacaagcatgaaatcttgattatttaagaacaacttgcttggtcaggaagtgtcatgtaacaatacagctactcaagaagaaattataataatataataaatcggagactaggaaaccagctcttgagtaatttgtcttcctaatccatcggcacttcagtcaataccacaagtcccgattctgggtggcattctgtcttggtgaaatctggtagagtccctgaagtcagaaaataatttcattattctggtccactacttaccatctctttcaaggcttcatacatcttccttaggaactcctggaactgagccacgtgaagacaggtgtcttgctgggtttccaaagtggaagcctgatcccatacagaaagcttctgcatccaaaactgataatcacaagaaagatctactgaatcttgagccatcttggaaaaagcgaaaaggtgatgtcccttcacagcagcctgtccagcactgaaggaaatggtcggcacacattaaatctgtaagaaagggaacaaatagaagcatttctaaaaggctcttttatcagtgccttcacgacccattgatgggtgaaggagggattacaaagaactaaaatagcatggcttctatgctggagccatctttgaattgttataaaatatgtcatccagctggagctccaatttttaccatctgaactttttatcatgatactatcattaggctagaagtctttatacctccacaggcacacgctaattatgcacaaaaagcacagctgataatactttatatcttctttttaagattgagctatttttaaatgttctgaatatgaagttgacttgagtattttaatgtaatagaaaataaaaaacatccatgagtgtttaataatagtctgtgcctaagaaatgtttttgaagttcttatgttttatatgaatttctggcttctcatttaggtgtaaaaaaatctctatgcattactgtctaacgaatttttttcccagtttctcttcatttcttagaaaaaagtaaaataatttattccacatgtaacaatttaagcaatcttttaactaaagattgctttatatgcttgatctcacttcattcacacgaagaaaccatattttagtaaaataataataaattccacttactgaggaggtatactagtcccagtgacagtagataaaatctcataagcctgacttcctacccctgaaggccatgctaaaaagaacaatggagttacacagtgagactcaggtggagctggctcagcggctccagctgcccctcccatcccacaacccttcatcacccatggaagccagaagcaggaatcgcagaggagggaaggctgcctctcaacaggtgcaggccttcacaggctctgacactccccagggcaggcaggatattcagcaatgtaatttcaaaagactagtggtaaataaagtgagtttaaaatcctcaacaaccataattaacaggtaaaatgctcccaattaaatacccaagatatcaacaaaggaggttcccattactaaagaagaaatttgaaacgactgtacaatttggctgcagtgcaaaaaaatctagatcgggaaagttttaaaatacctaaaaaatgtgcagtcttcatgttcacttgggcagcacacacactagaacatttacagttttgagaaggatcatgtctaaatgaaaagaaagtttaataatagagggaatatatgcaactgtcaaaatggcacttagccaaaaatctagataatgtccatgcctcctcattgtcttcctcatccaagctatcatcaccacctgtcaagtctaccaccaaaataaatgtgtgtgatccgacttgactgcatgcacttccttccacctcattgccacccctcagcctagccctggagtgttgcacttgtctactgccaggctgggcctgcccgtctccaattcattctctatgcagtagacagaaaaaactttagcaaatgtaaatgagaccagcacattcccctgggtaaaacctctcttcacgcttccttgaaaagaaacttaaactccccgtagatactcccagctgcttgctggagtcttgaagaccctgcaaaacatggctccagcaccgtctctgacagcccttatttcctctctccccagctcaccacggtccagcccatgcctctcatctgcttcatgcacacaacaaatcctttctgctgattccagttaattatcctgggctttattcgttcacttagttaccgcttcctctactggtgtgtaaattccctgtcttcctagaatgcagcatatgcctggcaaacactcaaaaaatactgaattaaggaatgaataattcaccggtattcctcatagtacagttctaagctaaatgccacagcaaaacgcttctccagatgaagtaatttaattttatttttatgttatgtatttttttttagacgaagtctcactctatctcccaggctggagttaagtggtgcgatgttggttcactgcaacctccacctcctgggttcaagcgactctcctgcctcagcctcccaaatagctgggattacaggcacacacaaccacgcccggctaatttttgtatttttagtagagacggggtctcaccatgttggctaggcgggtctcgacctcctgacctcaagtgatccgccctcctctgcctcccaaagtgctgggattacaggcatgagccaccgtgcccagccagtaatttaatttttaaaaggtaattccccaccaaaaaaaattttaaggtatttttatgttgcctgtgtgaaatttaattagtaatatctcattttataaatataataatagtttatacttgcatacatttacactatgctcttggcaatatattaaatactttattcatactaatttaatcattacagcaacactatgaaatgggtactattatcatctccattttacagaggcaccaagagattacataattgcccaaagtaagattatgtaaaaactgaaaggaagtaactgctagttaacagcagagctatgattgtggaatatgaatccagggtctggctctaaagtctgtgtccttaaagaaacaaactgaagaggcggggcacagtggctcacacctgtaatcccagaactttgggaggccgaggtggatagatcacctgaggtcaggagtttgagaccagcctggccaacatggtgaaaccccatctctactgaaaataacaaaaattagctgggcgtagtggcaggagcctgtaatcccagctacttgggaggcagaggcaggagaatcacttgcccaggaggcagaggttgcagtgagccgagaccgcaccattgcactgcagcctgggagacaaagtgagactgattcaaaaaaaaaaaaaaaaaaaagaaaaaaaaaagaaacaaagaaactgaagaaactaacaaactgatgaatttcttatatatttcatatggcactagatgcagatcagtttagatatttgggaacccagtaaaatgaagaactttttgataaaagagacaaacattttattcaaataaaattgcaggcccggggctgggcgccgtggctcacgcctgtaatcccagcactttgggaggcagagacgggcggatcacgaggtcaggagattgagaccatcctggctaacacagcgaaaccccatctctactaaaaatacaaaaaattagccaggcgtggtggtgggcgcctatagtcccagctactcaggaggctgaggcaggagaatggcatgaacctgggagacagcttgtaagtgagccgagatcactccactgcactccagcctgggcaacagagcgagactctgtctcaaaaaaaaaaaaaaaaaaatgcaggcctggaacagtggctcatgcctgtaatcccagcatttggcaggcggtcacaggagcatcgcttgaggccaggagtttgagaccagcctgggcaacataccaagaccccatctctaaaaaaaaaaaatttttttttttaattagccatgcataatagcagatgcctatagtcccagctactctagaggctgaagcaggaggatcgcttggacccaggagttcaaggcctctgtgagctaggatagcaccactgcactccacactccagcctgtgtgagacagccagactgtctaaaaaagaaaaaaaggcaaacaaccttcgctcagcaatagaaatgtatctgattgttttaaatgcaaacagctttaggaatcatgcagtgcactgatcctcaatatgctgctccacaacctctggggctgggaggggtgaaaacatggtgctgtagttgtgatgaccagggagtgtgggtgatggctgctgccagcatctggttaattaaagtaccctgtgccatcggccacatgtgggatgatcacacctgttgggcatatctgaccctgctgggaatctgagtcttgacaggtagaactcagtcattcaaaggctctcttaatctagatccctagaggtatctgagctcatgttcttaataatgtaaggtgtttctctcaacattttaaatcaatatttttaaatatttcactccactctcttcttccttacatggtttctgaggagaagttgaatgttctgctcctctacaggtaaagtgcatttttcttccggcttccattcaaaataagaaagcttcctgtattagtggtatggtgtctgacattaacttggaaaattctcagtaattactgtttcagatatttctcttttaaaaaattttttattcccataggttttgggggaacaggtggtatttggttacacggtaagtcctttagtggtgacttgtgagattctggtgcacccatctcccattgcagaagacaattttttcatggaccagggcgggggcagggatgggggggatgtgtttgtgggatgagaaactgttccacttcagatcatcaggcattagtcacattctcatatggagcgtgcaacctagatcccctgcatgtgcagttcacaagaggattcatgcccctatgagaatctaatgccgccactgatctgacagggagcggagctcaaccagtgatgctcactggcctactacttacctcctgctgtatggtctggttcctaacaggccacggactggtaccggtctgtggcccggggcttggggaaccctgctttagaggaaaggaagatgtgctattgggaaggtgtgcaagaatggcaccaagatgctggcaatattctatttcctgacctgtgtggcaatgactatctatccacattttaataactcaccaaagtataaatcgtatttatatgcttttcaatatgttactttctacaattaaaaaatagtttttaaaacctccacaggctggcaagatggccgaataggaacagctctggtctgcagctcccaacaggatcaatgcagaaggcaggtgatttctgcatttccaactgaggtacccggctcatctcactgggactggttagacagtgggagcagcccacggagggtgagcagaagccaggtggggtgtcacctcacccaagaagcacaatggattggggaactccctcccctaaccaagggaagccgtgagggactgtgccgtgaggaatggtgcattccagcacagacactacgcttttcccatggtcttcgcaacctacagaccagaagattcccttgggtgcctacaccaccagggccctgggttttaagcacaaaactgggcggccatttgggcagacaccgagctagctgcaggagttttttcatacaccagtggcacctggaacaccagcgagacagaaccgttcactcccttcaaaagggggctgaagccagggagccaagtggtctagctcagtggatcccactcccaaggagcccagcaagctaagatccattggcttgaaattctggctgccagcacagcagtctgaagtcaacctgggatgcttgagcttggtggggggaggggcgtcccccattactgaggcttgagaaggcggttctcccctgacagcgtaaacaaagccgcagggatgttcgctcagcaaagccgctgtagccagactgcctctctagattcctcctttctgggctgggcatctctgaaagaaaggcagcagccccagtcagtagcttatagatcaaactcccatctccctgagacagagcacctgggggaaggggtggctgtgggcgcagctatagcagaattaaacgttcccgcctgctggctctgaagagagcagcagatctcccagcacagcatttgaactctgctaagggaaagactgcctcctcaagtgggtccctgacccgcatgcctcctgacaaggagacacttccaagcaggggtcgacagacacctcatacaggagagctccggctggcaactggcgggtgcccctctgagacgaagcttccagaggaaggatcaggcagcaatatctgctgttctgaaacctccactggtgatacccaggcaaacagcgtctggagtggacctccagcaaactccagcagaggggcctgactgttagaaggaaaactaacaaacagaaaggaatagcatcaacatcaacaaaaaggacgtctacataaaaaccccatccgaaggtcactaacatcaaagaccaaaggtagataaatccatgaagatgagtaaaaaccagcacaaaaaggctgaaaattccaaaaaccagaatgcctcttctcctgcaaaggatcacaactcctctccagcaagggaacaaaactggacggacaattagtttgacaaactgacagaagtaggcttcagaaggtgggtaataacaaactcctccaagctaaaggagcattttttaacccaatgcaaggaagctaagaatcttgaaaaaaggttagaggaactgctaactagaataatataaatgacctgattgagctgaaaaacacgtcatgagaacttcgtgaagcatacacaagtatcaatagttgaatcgatcaagcagaagaaaggatatcagagactaaagatcagcttaatgacataaagcatgaagagaaggttagagaaaaaaaaaatgaaaaggaacaaactaagcctccaagaaattcgggactatgtgaaaagacaaaacctacgtttaattggtgtgtggtgtacctgaaagtgacaaggagaatggaaccaagttggaaaacactcttcagggtatcatccaggagaacttccctaacctaccaagacaggccaacattcaaattcaggaaatacagagaatgccacaaagatactcctcgagaagagcaaccccaagacatgtaattgtcagattcaccaaagttgaaatgaaggaaaaaatgttaagggcagtcagagagaaaggtcgggttacccacaaagggaagtccatcagactaacagcggatctctctgcagaaactctacaagccagaagaaagtggaggccaatattcaatattcttaaagaattttcaacccagaatttcatatccagccaaactaagtttcataagcgaaggagaaataaaatcctttgcagacaggcaaatgctgagagattctgtcaccaccaggcctgccttacaagagctcttgaaggaagtattaaatatggaaaggaaaacccagtaccagccaccgcaaaaaaataccaaattgtaaagactatcgactctgtgaagaaactccatcaactaatgggcaaaataaccagctagcatcacaatgataggatcaaattcacacataaaaatattaaccgtaaatgtaaacgggctaaatgccccaattaaaggacacaaacttgcaaattcaataaaaagtcaagacccatcagtgtgctgtaaggagacccatctcacgtgcaaagacagacataggctcaaaataaatggatggaggaatatttaccaagcaaatggaaagaaaaaaaaaagcaggggttgcaatgctagtctctgatgaaacagactttaaaccaacaaagatcaaaaaagacaaagaagggcattacataatggtaaagggatgaatacaacaagaagagcttactatcctaaatatatatgcacccaatacaggagcacccagattcataaagcaagttcttagaggcctacaaagagactcagactcccgcacaataacagtgggacactttaacactccactgtcatatgagacagatcaacgagacagaaaattaacaaggatattcaggatttgaactcagctctggaccaagtggacctaatagacatctacagaactctccaccccaaatcaacagaatatacattcttctcagaaccacatcacacttctgttaaaactgaccacataattggaagtaaaacactcctcagcaaatgcaaaagaacggaaatcataacagtctctcagatcacagtgcaatcaaattagaactcaggattaagaaactcactcaaaactgcacaactacatggaaactgaacaacctgctcctgaatgactactgggtaaataatgaaatgaaggcagaaataaagaagttatttgaaaccaatgagaacaaagacacaacgtaccagaatctctgggacacagcgaaaacagtatttagagggaaatttatagcactaaatgcccacaagagaaagcaggaaagatctaaattgacatcctaacatcacaattaaaagaactagagaagcaagagcaaacacattcaaaagctagcagaaaacaagaaataactaagatcagagcagaactgaaggagacagagacacaaaaaacccttcaaaaaaatcaatgaatccaggagctggtttttggaaaagattaacaaaatagatagaccgctagtcagactaataaagaagaaaagagagaagaatcaaatagacacaataaaaaatgataaagaatatcaccactgatcccacagaaatacaagctaccatcagagaatactataaacacctctacacaaataaactagaaaatctagaagaaatggataaattcctggacacatacaccctcttacaccctctcaagactaaaccaggaagaagttgaatccctgaatagaccaataacaagttctgaaattgaggcagtaattaatagcctaccaaccaaaaaaagcccaggaccagacagattcacagccgaattctaccagaggtacaaagagaagctggtaccattccttctgaaactattccaaacaatagaaaaagagggactcttccctaactcattttatgaggtcagcatcatcttgataccaaaacctggcagagacacaacaaaaaaagaaaatttcaggccaattccctgatgaacatcaatgcgaaaatcctcaataaagtactggcaagccaaatccagcaacacatcaaaaagcttatccaccacaatcaagtcggcttcatccctgggatgcaaggctggttcaacatatgccagtcaataaatgcaatccgtcacataaacagaaccaatgacaaaaaccacatgattatctcaatagatgcagaaaaggccttcgataaaatgcaacatcccttcatgctaaaaactctcaataaactaggtattgatggaacgtatctcaaaataataagagctatttatgacaaacccacagcaaatatcatactaaatgggcaaaaactggaagcatttcctttgaaaactggcacaagtcaaagatgccctctctcaccactcctgttcaacatagtatcggaaattctggccagggcaatcaggcaagataaagaaataaagcatattcaaataggaagacaggaagtcaaattgtctctgtttacagatgacatgattgtatatttagaaaaccccactgtctcagcccaaaatttccttaagctgataagcagcttcagcaaagtctcaggatacaaaatcaatgtgcaaaaatcacaagcattcctatacaccaataacagacaaacagagagccaaatcatgagtgaactcccattcacaattgctacaaagagaataaaatacctaggaatacaacttacaaaggatgtgaaggacctcttcaaggagaactacaaaccattgctcagggaaataagagaggacacaaacaaatggaaaaacattccatgctcacggataggaagaatagatatcatgaaaatggtcatactgcccaaagtaatttatagattcagtgctatccccattaagctaccattgactttcttcacagaattagaaaaaactactttgaatttcatatggaaccaaaaaaaagtccatatagccaagacaatcctaagcaaaaagaacaaaggtggagacatcgcactacctgacttcaaattatatactacaaggctacaggaaccaaaacagcatggtactggtaccaaaacagagatataggccaatggaacagaacagaggcctcagaaataacgccacccatctacaaccatctgatctttgacaaacctgacaaaaacaagcaatgggaaaaggatcccctatttaataaattgtgttgggaaaactgctagccatatgcagaaaactgaattaggaccccttccttacaccttatacaaaaattaactcaagatgcattaaagacttaaatgtaagacctaaaaccataaaaaccctggaagaaaacctaggcagtaccatttaggacataggcatggacaaagacttcatgactaaaataccaaaagcaatggcaacaaaagctaaaattgacaaatgggatctaattaaactaaagaacttctgcacagcaaaagaaactatcattagagtgaacgggcaacctacagaatgggagaaaatttttgcaatctatccatctgacaaagggctaacatccagaatctacaaggaacttaaaacaaatttacgagaaaaaaacaaccccatcaaaaagtgggcaaaggataagaacagacacttctcaaaagaagacatttatgcagccaacaaacatatgaaaacaagttcatcatcactggtcactagagaaatgcaaatcaaaaccacaatgagacaccatctcacgccagttagaattggcgatcattaaaaagtcaggaaacaacagatgccgaagaggatgtggagaaacaggaacgcttttaccctgttggtgggagtgtaaattacttcaatcattgtggaagacagtgtggagattcctcaaggatctagaaccagaaataccatttgacccagcaatcccattactgggtatataaggattataaatcatcctgctatataaagacacatgcacacatgtatgtttattgcagcactattcacaatagcaaagacttggaaccaacccaaatgcccataaatgatagactggataaagaaaatgtggcacatatacaccatggaatgctatgcagccataaaaaaggctaagttcatgtcctttgcagggacgtggatgaagccggaagccgtcattctcagcaaccaacacaggaacagaaaaccaaacaccacatgttctcactcataagtgggagtcgaacaatgcgaacacatggacccagggaggggaacatcacacaccggggcctgtcagggggttgggggactaggaaagggataccattagcagaaatacctaatgtagatgacaggttgatgggtgcaggaaaccaccatggcacgtgtatacctggctaacaaacctgcacattctgcacatgtatctcagaacttaaaatataaaaaaaaaaaaaaaacttccagatacacatttaccataaagacatcaccccacaggcaaagaaaaaaggaaaaagtattatagtttataaatgtgaataaagatggacagtacttgatgaatacaacaaaattttgcaaattgttgaaatagtatgtattttctgtttgtttgtttttttaactgagttctctgtctggaaatattaaaaccacccaccaggatgggcagagataacagtcctagcacttgctccctccttttccttccagtcctcaaataatgactccatttttccagtcctggctctaaggaggggaaaatccaaaacctgctgtctggaccccctatcttacctgtacggctactgctttgccccagagggctttgtcacaaagagggagagacgttcaattcattattcacggaggaataagacagtgtcacccgaagcagacatataaggtggcttccgtgcagctccaaaaaatgcatgccttgaaaaatggggctgattcttcagatttatggtaatttcaacttttttcacagatgtactacttttttatcgcaggtaatctacaaacctattagacaattgacagctgactatattttttgctcaataccaaaatcctttatcttgctccaaatgtaagtccttgactttcttatgattctgcctagtgtatgtacctaaattcatttcattactagctcttagagaaatactgtttagcatttttaagaaataaaaaaggtaaatgttttataacatatttcctgaaaactcaggatgttaacaagtattttgtgcatacacgcacagcatatactaatgcagcaaaagcaattggcatgaaaaatcagaaggaaatccactttttccatttcttgcataatgtatcttttagtgcatttacccagtccctaaggaatcaaaacaaaccatgatttcaccttctccacgtatgcagactaaaaacaacagaagctgttagatccctcagtaagtatttccaggagaaaataaagaaattaaataaagaccttcagaaattcctatgcagaggggactaaagcaaagtcgtatgagcagagagatgcagacgctggaacagaaggcagtgtccagtgaaggacccacacatgcttgatcctgtccctgtttcctgccaggtgggagcggatccttcagaagcaggaagaggtgaggggctgggataaagtaccaagggaaaccagccatggggccatgcaaacatccaagatactgaaaaggaaccagttcacaatggcatcagcttaggaccactgccattgcccttcttctcacacatataaattgctcaagagtttggttgcttgttaagtactattttatgaactcaaatagccatgatacaaagatacaccactgtccacaggggctcatggtctgagtcaccgagataacatggctcagattcaaagtacagcaggcaacaaagagtattacctcaggactaaaggttcctcattttggtgaattctatcctttaggagaaggatatattcaaaaacttcatggaaaatgtaccttacaagaatatggagctcaccaagcacaattcatgagagcagaaggaagtaaaagcattaaaacacttgagcagtgtctgaagaaagataacaaagagggaggagacgctgggtgacaggctggggcaatgcatcctaattcattaaaaacaaacagaaaaccatctcccttcacttagaacggctactatcaagaaaacaacgacaagtgttgatgaggacacagagaaaccagaactctcgtgcactgctggtaggaatgtaaaatggcgcagctgctacgaaaaacagtatggtggttcctgaaaaaactaaacatagaattaccattgatccagcaatcccacttctaggtatatacccaaaagaattaaaagcagggtttcaaagagatatttgtacacccaatttcatagcagcgtaacagccaaaagtgagaacaactcaaatatccatcagtggagaaaaggatacacgaagtgtggcatatgcacacactggaatatcattcagccttaaaaaggaatgtaattctgatacatacaggaataaatcttgaaaacaccatgctaagtgaaatcagacaaaatgcggaaggacagatattctttgattccacacagatgaggtacctacaatagtcaaattcacagaggcaaattaattcatgaggggagacagtaatggaatgttactgcttaatgggtagagtttctgtttgggataacgggaaagttctggggatggatggcggcaatggttaaacaatgttaatgtaatcaatgccactgaattacatgtaaaagtggttaagatggttacaatcttatttatatttaccacaattaaaaaaccaacaacacacaaatgacaaacctacagtggctccagtcctggctggcccagcagaggtggggcctggagaacatgctgcatccctgccctgctgtctcctcagggccccctcagaacagggctgcacacactgctagttgcccacccagcagccctaagctctccatttcctctttgttaagagttttgtccaggaatctcaaggccatatgtcttagggagactgggatatccgccagtgccaggggtgaatcttgattcacacagagcaggtaatttcaaatgttttgttctcagggcccatttacatccttcaatgttactgaagaccccaaagagttttatttatatatatatgtgtgtgtgtgtgtatgtatgtgtatatatatatatatctatatatatatagatatagatagatagatagatagatagatatttaccaccagaaactaaaactgagaacaattaaaaagacaaaatatacaaacacacattccattagctgtcagagagaggtcatcatcatctatcatgtaacctcttgacaacgccaccgcacactagtgagcgaatgcgagtcgaaaaggcaaatagcagcttagcattattataaaaatagttttacccttgtgaacctcctaaaagggtctcggggaccctgggccctcagccacattttgggaatggctagtacagaccagtcatggtatttacttttgctcgcctatcaaactgtaggaacaggtatattatggaaatatagggcatgagaactgaacttcaacaaaaggtttctcagttttcctcagttttaaatgagttcacttttttccatatctgacatagtagtctttgtgtgatactcagaacggtaacagtcaccttgagacccagggataaggaaacctgaggggactggccaacatactgcaaacagcaaagaagaatcacagccccgtgtcctcacagcatagttgaggcaatgaaggagccaaatgtggaactgctctttttgcttaatcccttaacaccattctttggctttcctgttacttgcaatcaaacacatcctagctgacacatctcaggacctagtttgctgagcatattttgaaacccacaaactcacacaatacttggcacattgtaggagcatgataaatatgtactgaacaaatgtatggaaaataaatacataaaaaaagcaacaaggctgttgtagaagaaaaataaaacagataaaattctgactgattttatgttgatagaaacccctgtagctccaagattgttaacatttaaaacaaagctcattttaaaccacacaaaagtagctatacatggtacctgtcagggggacaagaaagtctaagaatgctttcctttggtctaaaacatctctaagcccagagagctaagtctactcatgccaaatatggaccatataagcttctcaaagtggaggcgacctgataaagtgcacttttttcccatttaccctcagcatgaggtcctttctctcatgaaataagcaccaaacaggagatgtatggagagaatgctacaaaacacactaattatggaaaaagaaaaaaaagacaaatcaaatacttagcttccaatcaatcaatgtcatcaactaggggcaccatgaccttgtcagaaaatatttaaaaccccctaaaatataatcaaatataaaattaagaaatttatgttcaattccacttaagttgacaagattcttcctcttccttgatgaaagcctgataactatttttaatttgctgaaatgtaatgtttctttgcttcacttcacagggtaagactggtcaatttacccctgtgtttgtggctttttttttttttttgaaagtcacaataaaagattcttgttcccattaagtgcttatgaaagaaacaaatggtatttttcctcctaaaaccaatgaggttttaagaaaagttccactaggaggagctggctatttctctgttgagtcagtggcgttccacctctgagatagtctaatcaaaaacacagacctgaaatttgcagataatttcaaacaaacctcaattgtaaacaaaatctgggcctaaggaattggaggaggcaacttcaatccaggtgcagagtatgtatatatactcttcagatgactttgcaaagaattaaggaaactgaatctagcagataactctggggatttactaggctcaattctcccacccaagacctcagcaatggggggagaggagctattctctggacttggcttcaaaataaaagcatcccttcaccacagcgcttgccatcgaggctgctaagacagaaatctctgaccttgttctccatcagagcaccaaggagccatcattcggacttgaaaaataccagccttccctcatgcattctattacaatcattacttcctttccttgcgtttcttgtcctcacttcacttacctgacagtaagacttgggttttggttagaccagttagaaagtgagctgaggaacacattagttattaaaatattaggaagcttcttcttgccttgtgacttggctccaagttatttctgcctctttctctccttgattctacaggtaatttattactacctaaacaaaaacaaggaaacccatacatttattaggagcctattttatgacaagagctctgaaaatcactgcaaataaaaagatgacagtgttccccactctcaagcaacttatggctaatgaggaaattgggacccatacacagattacactgtgggaagggctgggagagaaggaaacacagggggctgcaggcagcatgaggaaggggcaccagcccggcatggaggtgtcagagtccccagagagaaacgatcctgagctaagcaggtcaggaagcatgagcaggagtgagctaaagacatcaaaatcaaatgcaaggtgcttgctgcaaccaacagcaagagttaaattaccatttgacccatggttctcaaacttaaaaactgttgagagctcccagtattatctaaagtcattcttcttattagttaaatattaacaaacataaaccagtaaaacctttatgcttgtaactcttacacaaccacaatataaaaaatatacaaattaaataccaacaaatctacaaaatgagtaaaatttaaattgacaaaattaattcagcgtgatcaatgatgcagtcattgaaactcactttggactaaccatgtagggcttggtaccgacaggcaggttctgttgactggccaatactaacacatgcagggagacagcttaattcacgcatcactttcctcttcagaaccactgtgcaacggcaatctcttagctcaaacacgttatttacattttcacctctgttcttttataatatctccctatatttaaagcagtgctccttggcaccaatacaaacacaactccaggcactgaaattttaagacattacttagttagaattgcaggcatttaggtgtgtggaattatgaatttttaaaaaattaccaccaaaatgaaaaatagaaggtgaaacctttgtagagaaccatagcaccctaataaatcccacctgcctaatcccactcatcttttggggcctgcaagcctcagacggagtttaagtaactatatgctatgggtcactgagctcacataggaagcgttcttgtggttagctttcagtactatgtaaaaccaagtatctttctttcctttaaactctctgcccatgtgacttccagttaagatggcacggtaaattcacttttggatggattctctttactccaaacatacagcaatgagaggggaaacataaaaagaaaaaaggaaaaggatacaggcaagcacacacacaaaataaacatttctatgaaatcgatacgagacagaaacacaaagaggcaagaccccgaggacaaaaccatgagcagccagcccctcctatgctagggtccaaaaacaggcaatgaaactgtaggtttgggtcttagaagggttgggggctaaacagaggcacaaacgacagagtgagaaactagcacccttgctggaaggtgggatggaaggtgctgactagagccctacccctccatgcctgaaggaaggctcgcagcatccttgcctcctatggagtggcggtctagggaggatggaggacacctgtcaggcaggaccaggcactgcgtgaagcagccatgaatgcccaggtaactaagcccccactgtgaaagctagttctgcacccaggctccatggaagccagacagagacaagcagaatgaggctacacaggggagagtgtgcagagagggagaaagaggcgaaaaatgactgaatgagtgaaaagtttttaaaacctcattcaaaacatgtcatttaaccaaagttctaaagtacatgaagaaataaatgcaactaacaatatcagacattagatcacaaattcacttcagatgaagttaatcagtccaacaaataggtatatttagatgctaaaaaatcctaacaaagtatacttaagacactaaaataatcccaacaaaatatatttaaggtgatttttaaaaccaacaaaaatcagtatatttagggtgctttttaaaaaagctaattaaaaaataagaaagtataaattgaaaaggcagaattaaaagatggctaaaaaaaaatcaactgcaaagtatgtaaatcaggactacggtcattaaaacctaaaaactcagtgcacaagatactagacagtagactggagaggaagcactctgtcttgacaaaacacactgcacatcactggatctgcagcagcacagctcaggagcccagctgctggccccacagcctggcctcactcggacctggctggtagcctttcgacatcacaggtgactgaatgggtcagatcagcacatccaggctgtgagtcccactagcattttgcctctcccctaccagttggtggatataggtgaagtaactttcgttttatacaacccctacagaaacttgatgaaaaagcagaccctgaaatgcttcaggcaacagatttgtcctccttgtaatagataactcactctggatttaaatttatcttctttgcccaccacacttctccagcatcaccaaatgtggacttgactggattccttattcaccatcatggtatcacaaccaacttcggaccaaggaactcattatatagcaaaaggagtaaagcaatgggctcctgccaaaagggtctgttgtcagctaagttactactagctgctgcatgaactcgatggctttcacctgtattccttcatcacttccaaatttctctactacatatttatttctttctgctgcatcttctctgaagcttaaacaggaaacaaacattaacataaaggaaaacataaacaagaatgataccctgagttatgtggaaaggaactttgatttgaggaatcacagatgaataacaatataaaaaatcttggaaaactggtaacaatacacatcgtaattgtttggataaacagtcacattttttttttctttaaaaggttagaaaacctctcatttaggttcccctggaaagcagagctcagacaggctagagaaggtaaagaccttaattcaccccctcatttccaaagacagaaagcctctcaccagaccagccatgtgatgccctccaggtgtgtgcctggcagctatgaaaggggactgacaggacacaggccctggaaccagccgctgtgctctcagaacctctccaaagccgatgctatgctatagcacaagagcaccacctactgagttccaagggacaatttagtccatttattgaaaaatggctcagtaaaatatgactgtggagggatgaactccacatcatttcaatctagttggctgtgtctctttcttttaaaactagaacccttgccaagactcctgaaaaagaagcagcatgccttcttattctcccattttcactttaattaccacagtaaaatgaatgtctcttcctatcaagctttggctatcttaatgaatactgccatttctagatccctcttcccctacctgttttccaaagggcagagaaaacctctaggggagcagtagtcctaaagggtctgggaaggatgtatgtaaagtcagtcattcggtcaaattttaaaccctatgaggcacagtgctgtgatgggggaattgtttttacaaactcgttgaaagatgattacaatagtccttttctccttgaggagcttaagatgagcacagaggttctaaaccagcaaagctggagatcagatgatccattaataaaattgaatacagaagaaaatacgtaggtgtaaggaaagatgatttatgggataagtaacattggggagagctgattgcttctgctgtgctgtgtattaaacatatagaatacaactgaaggcaaagagcgggttctttctggagcccttcatgccttacatgaagcccctaggtactgcccagtacagttcaagtgacacagactcactcgaacaattcacatacattccagcctggttatcacgtagttttgctatgttttattggtctgagagggacactctgggaaccattattgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgccttcaagcatctgtttaacaaagcacatcctgcaccgcccttaatccattccactctgagttgacacagcacatgtttcagagagcacggggttgggggtaaggttatagattaacagaatctcaaggcagaagaatttttcttagtacataacaaaatggagtctcctatgtctacttctttctacacagacacagtaacaatctgatctctctcgcttttccccacaattatatgtcagcctctcccatgccttagtcatgattaaaaagctgcagcttttgtttatgccaacatctgcaccagtactagtcctctcatccagtaccggtcagggacccgtcgcagcgagagcacttgcaggccaacacgagaggggagcctgtacaaagcaaccacccggagaaacggcaagcactccagagatcagccacccgagaactgtgagagtgcacatttattactttggaaatcataaaaacttcaaaacagcaaatgtgtctatactctgtttcaattatttcacagaaaaataagatacttcagaaaaattccaatcctgattctctagtgcataaactgctgtgctaaatgtgcagttcatactctactaatgccgcatggcaaggcaaggagcaggcagcagtcgcagggaggataaatccaactgagtatgaaaacctccagaaagggacctgctgaaaaagaatgaggtgatacatggacaaattctaagataaagggcaacctaggtatttaacatatttaacataggtaaagtagaaaaaacccaacctggggattcagaggtccattggatttttttaaaacataatattgagatttagttgactaatataaaatgccacaatgttagaatacactaacaggggtctagcaaaaatttcataatcctgctcgatttggcccatttgtggacttcactagaatgttaggtgtagtggagaggagcagtcacctctccagcatccattctccaccctcccccttcttaacgagactggaaacttcccagtcagcatatttgagtgggataagaatgggctctgattaggttaaagcagtgctcatcaaccaaggacagtcgtgccccagaggggacccttgacaatgtttgaagacatttttggttgtcacagctgggagaaggatgtcactggcacccagtgggcagaggccaggtacaccgctgaacatctaccaagcacaggacagtctcccacaacaaagaattagcagcccaaatgtcggcacctcattcccacactagcacatgggacctgtgaatattactttacatggcaaaggaatgactattaccttgtacaacaacaactactacaaagtggtaacattcaggatcctgagagaaggagcttgtcctggaatatcagggtagggtaggccacatgcaaccttatgacagaggcagagcaagttggagacagacacagaggaggcagcaaagtgaagacagaagcaaagattggagggatgcggccacaagcccaggaatgccatgctggccgccagaagtgagaggaaggtgtccccagagggaatgtggccatgtcagttttcacacttttggcctccagaactgcaacaagatatgattctgttctcttgatccaacaagtttgtagtaatttgctataacagcttcgggaaactaatatcgcatcctgcaaggaggtgtatgaattgcaaattacaaaaagggaagcaaagttacatcttgcttttttttttgatctgaagattcccttctaccaatataccaaaggtttccacattaggagtttcttctactgtcaaaatccccaatgaaaaatattattaagcacttttgctgctgaatgcacgccttaaaagtttatcacctgactcaccaaccaccttccaaagtatggctccttccctcttccatcaatcccatcaagcctcttctttttttttttttttttttttttttttgagatggagtctcgctctgtcgcccaggctggagtgcagtggcgcgatcctggctcactgcaagctcaacctcccgggttcacgccattctcctgcttcagcttcccaagtagctgggactacaggcacccgccaccacgcctggctaaatttttttgtatttttagtagagacagggtttcaccatgttagccaggatggtctcgatctcctgacctcgtgattcgcctgccttggcctcccaaagttctgggattacagtcacaagccaccgcgcccggccccgcctcctcttttttattgaggcaacaaagcatcattttaacacattttatgtaccaattacatttatttaattttggattatttactaataaaaagttttcattgctcaatgatatatttttctatttgtagaaagtatttggacatcttaggttgggatggaacacatcataacttttaccactaaaatgaacataagttagccggctgcagttgagaggccaagcgggtggatcacttgaggccaggaactcgagcccagcctggccaacacagtgaaaccctgtcactactaaaaatagaaaaaattagttgggcgtggtgtcatatgtctgtaatcccagctactcgggaggctgtggcgagaattgcttgaacccgagacgtggaggttgcagtgagctgggagatcacgccactgccctccaacctgggtaacagagtaagactctgtctcaaaaaacaaaaccaaaacaacaacaaaaaaattaacagaagtaatttttcattttctagcttttcacttactggcaggattcttagaattaacatcattaagtgagggataggcatatttatttcatctatagcaaatgcctgtgaagtagcttgatttcttcacactctttattcacaccttgttttgtgggagttatcagctagaaatcggtgatcagcataactcttcactgtccggcaaaggtgtgggggtaggggtacagagagatgaagaaccttacagagaccatccatcccgttagaaccccaacaagaacagaacccacatcccctggcacctagactaatattctacctgaggttatatgaaggaattaaggacaaatgtgatcaataaagaagcagaaaacagcagaatgtttttcttttttgagaaaagatgaaatgacgtaggcattctttagcctcgacgagggaagggtggtgaacgagtcactaaatgcctaccggtgaggaagacattgactgactgaagggtaccccaacatgtagttattttgtactgattatcaaccttggttttctatctttttgtgtgtctcacaacccaaagagtctttaggactttaattacataagactctattgcactagattctgctggcactgcatttcagctctagaacagaaatccactcaactagcacaagtcaaatgggggaagaggtgttatgaaaaggctatgaccaaagatctcatgaacaacacccaaggaaagaaaaggtttagctggtccaaataggaagtggaactagaagctcctgccacatctcagggtgtccacatttctgctccgttcaagcacatctctctgtacactagctgcctctgctgtctctgctgtctgtggctttttttgttcccccagcttgcacgtcttttatgctgtagttcagaaggtggtcacaattctatacgaaatttcagcccaagaactaaccattatctaatcagctcagtatctcaaggtccccattctcagggaagaggatgtgattggctcaatccagccaacagaccctttagatagttttctacggggtcagttgctcatcccacaaagattggtggttgatgagtactactgtctgggcagacacttcaaaacagggtgtagcaaagaggaaatgattggcatatgcatagaggaactcaagagtgatacagctcttttagttaaggctacccagaaagattgtatcactttagaatttgtgatctttggatgaagtggtcataatttgtaaatagagagtaggaaccattttttaatttttttattatactttaagttctgagatacatgtgcagaacgtgcagatttgttacacaggtatacacacgccatggtggtttgctgcaccgatcaacccgtcatctacgttaggtatttcttctaatgatgtccctccccaaatccctcaccccctgacagaccctggtgtgtgatgttcccctccctgtgtccatgtgttctcactgttcaactcccatttacgagtgagaacatgtggtgtttggttttctgttcctgtattagtttgctgagaatgatcgtttccagctttatccatgtccctgcaaaggacatgaactcacccttttttatggctatatagtattccatggtgtatatgtgccacattttctttatccagtctatcattggatgggcatttgggttggttccaagtctttgctattgtgaacagtgctgcaataaacatacatttgcatgtgtctttatagtagaatgatttataatcctttgggtatatacccagtaatgggattgctgggtcaaatggtatttctggttctagatccttcaggaatttccacactgtcttccacaatggttgaactaatttacactcccaccaacagtgtaaaagcaaggaaccatttttaaatttcattctagctccagtgtctagaacaaaaccttactactttgggcttgtactgccagaaatttatcatttgtccagaagtgtctccaaattagcagaccatcaaggaaatctcaaaaaatgaaatggactgatacacagtatgggcactgacttgccattatttggggaagggaaaggaggaaagggataaggggaggatatctgcagtccctacataggtaggaattctctgaactatgtatgatacaagttcagcacaggactggaattagaaccagttcctcaagtaatttttaaaaataaaaacaggccaggcgtggtggctcatgcttgtaatcccagcactttgggattgcaaaggctgaggcaggaggattgcttgaacccaggagtttgacaccagcctaggcaacataccaagaccctgtctctacaaaaaaaaaaaaaaaagaaaaataaattagccaggcatggttgtgtgtacctgtactcccagatactcaggaggctgtggcaggaggatcacctgagcctaggaggtagatgttgcagtgagctatgattgtgccaccacactcctgcctggataacagagcaagaacctatctcaaaaaaataaataaacaaaaaataaaataaaataaaaacagaaattccactcgggcaggggagagggaagagtgaataggtagaacacggaggatttgtagggccataaaactattctgtatgatactataatagcggacacatgtatatctgtccaaacccatagaatgtacaacaccaagagtaaactctaatgttaactatggacttcaggtgataatgatgtatcaatgcatgttcatcaattttaacaaatgtaccactctggtgggggatgttgacagtagggggatgttatgcatgtgggggcatggggtatagaggaaatctctgtactttctgctcaattttgctgtgaacctaaaactgctctaaaaaatagtctattaaaatcaacgacaactacaaaccttggtggcaggaataggaggaagtgtagccaaacagaacccaaacctagctaggtggtgcatgcctgtaatcccagctgctcaggaggctaaggcagaaggatggcctgagcccaggagttcaaatccagcctgggcaacttcacaagacctcagtctctaaaaagaaaaaaaagaatgcaaacctactctacacactctgagcataaggatcataaatagcaggagcagagagagaaggcaagagtggatctcagttacacctggcaggagccacaggactcacaccctgtctaataaaattaatcagttccccctgaattacaatttcactaaaatcagacagccagatgcttggtttttccagacagtgagaaaagttcctgttccttgtactatgaggtattatctgcttccaagtctagtgtttgaactctccaaccaccaggaaactaaatacaaaagctcttcttgggtctcctcctaacccaaccaccaggatgaatgaattttcaacgtcaactaacagtttcatatgggagattgcctctcacattcaagacatgaagtttctcagttgctgaatttgttcttaaatatgttttcaccctgacttagtctgcagaatatcctaacagtacctctggtttcttgcattaattcaatgggccagcttttctctaaccctttcctctaaataacagataatccttttctggtcacagggagcttggtctttctctgtcccttgcctaccacatcttcaagaccacttatttaggggcagggcaatctcaagtaacagcatgattatttctatgtatacctaacctaaggcttcataaggtgctactactcattccttgtcataccccaagaattatatctggtctggcaatactcagaaggcttcaccacattgatttgagtaggatctcaagaacgacaacaacaaaaatcaaagaaagagtatgagtacttttgcctactaactgtggttaaagatctgaaacattttccacgagcttaaaaagcataattatcggttcatcaaccagtacaaagttacagttagacaggaggaaagagttcttgtattctattgtacagtaggttgactacagttaacccttttcccgtttgcccagagaatactcgcccacagtacatgaggctgcagcgtctactctgagataactttgctcgcttttactactattttcgcaagctctagtacattgaatttggaaacaaaaaacatcattctatttataacattctgtttttagcactggtatttccatttacaaaatatagtaattctcaatcgctgaaaatatcaaatcctagaaaatgcagcattcctacgcatgatggtaacattgttcttgaacagttattagccaaagatccatttcaattcaatttttctgaaatagatgattctgatgattcagacaattctgatgttagttctgtttagaaataactccaaaaacagtttttatattttattttcacattgaaaatctgtcagatttgcttcagcctcaaagagcacattaatgtaaaattaaatgagcgctgggtagtgagctgcaccttttttcctaaatgggaaaagggttaaacataatgtatgcatatttcaaaataactagaagtgaggattttgaaagttctcaccacaaagaaacaatgtttcagatgacggatatgctaatcatcctaatttgatcagtacataatatatacatgtgttgaaacatcacattgcaccctataaatatgcacattacgtgccaattaaaaataaaataatttttaaaaagaaacatataaactccccaaatttattggcacttgggaacatcaacaaaccccaaataagataaatgcaatgagatccacaaacaaaaacactgtagtgaaaatgctgaaagtcaaggacaaggagaaagtcttaaaagcagaaatagaaaaatagcccattacttacaagggaaccccaataagattaacaggtgacttctcagcagaaacaaaagatcccagaaaaacatgggaaaacatattcaaagtgctcaaaagttgtcaaccaagaatcccatatcccccaaaactacctttcaaaaatgaaggtgaaataaagactttcccagaagaacaaaaactgaatttgttgctagaaaacccactttgcaaaaaaaagtgaattaataccagaaggtaatttgaatccacacaataaaagaacactgataattatgtaattataaatgcacattttttctctcttattctcataactgacataaaaatgaattgcataaaatgatatgtacacactgtactgttgggcctataacatatagaaaggaataagatatgtaaatatatttgccaaacacagtgcaaatgagttaaacagccaagctgtattgggctaaggaagtaactacacatgttaaagtaataattaaaacattgttgaattcataacattgagaggtaatatgtataacaataatgtcacaaaaaaaggaagagaagggaataaagctatgcagatgatccataacttatgaaggttagacttacaattttttgactttacaatgatatgaaagtgatacacagtcagtagaagccatactccaaattttgaattttgctcttttcccaggctactgatatgtgataccataactactgataaaacaactagaaaaaagatcgagaaaatagaacacttgaataacactataaccaagcagacctaacagacatctatagaactctccacccaacaacagaacatacattcttctcaagtatgcttttctcacaatgctgggcagtgacagcaagccacagctcccagtcagcccagcaatcacaggggtaaacaagtaacactctacagtgcacggtgtcactaagcaatgatgtgcactacattaggtgtattaagtgaatttctgacttacaatattttcaacttatgatgatataactccatcataagtcgagaatcatatgtataggacataagtcaaaaatcatatgtataggagtaacatttctatatatcacggtaattattctacggcaaactctagagtagccactaaaaaaaaaaaattcaaaaagaatagtgaaaacatcattaaagaaattaaaatgctacattatgaaatattcacttacaggcatcagttactactcatgcctgtaatcccagcactttgagaggccaagacagaaggatcacttgagcccaggagtttgagactggcctgggcaacaaaaaatctctacaaaaaaataaaaaaaattggctgggtatgctggcttacacctgtaatcccagaactctgggaggtgaaggcaggcagatcacttgaggccaagacttaagagactagcctggccaacatggtgaaaccccccgtctctactaaaaatacaaaaattagctgggcatggtggtgcatgcttgcagtcctaatcactcaggaggctgaaccatgagaatagtttgagcccgggagacagaggttgcagtgagccgagctcacaccactgcactccagcctgggtgacagaccaatactctgtctcaagaaaaaaaaagaaaaaaaaaatcaaaaatagaaaaattagccaggtgtggtggtgcatgcctgtggtcccagtttcatgggcagcaaaggaaggagaatcacttgagcccaggaggtcaacagtggcagtgagccatgtccatgccactgcactccagcctgggcaagagagtgagaccctgtctaaaaaaaaaaaaaacagataatacttacttaaaagagcgtaataaaaggagaaacagagttacaaaaaaaagacgagatatacagaaaaagtaaaagttcagacataaagccaactatgtcaataatatcatggatgtgagtggaataaacaatcccatcaggctggacacggtggctcacacctgtaatcccagcactttgggaggccaaggtgggtggatcacttgaggtcaagagttcaagaccagcctggctaacataatgaaacgctgtctttactaaaaatacaaaaattagctggctgtggtggcaggtgcctgtaatcccagctactcgggtgggtgaggcaggagaatcgcttgaacctgagaggcggaggctgcagtgagcagagatcgtgccattgcactccagcctgagtggcagatcaagactctgtctcaaaaaaaaaaaaaaaaaaaaaaaaattcccatcaaaagacaaagattgtcagactttaagaaaacatgatctaactatatgctgtctatagaagacacactttagagtgaaaaatacaaacagattggaagtaaaaggatagaaaagatatgtcatgcaaacatacaaaaacaagaaacttaattgtggctatactgatattaaaaaaaacaaattttaaaacaaaaagctattagagatggagagggacattttgttaatcataaaagggtcaatccatcaggaagatataaccattataaacatacacaactaaggaccaaaattcatgaagcaaaaattgacagaaagggagaaacagacaattgaatattaatcgctggagacttcaaactgtcattttcagtgatagataaaacaactagaaagaagatcaacaagaaaacagaacacttgaataacactataaaccaactagatctaacttacatctatagaattctccacccaatagtatatacatttttcttaagatcacatggaatattctaaacagatcatatgctaggtcataaaatgagtcttcatatatttaaaagaacattagtaatataacaaatgtgctctgatgacaaaaaaagcaattaaaaataaatgcaggaagtttcaaaggaaattcacaaatgtggaaactgaacaaggcactactaaataaccagctggcccaaaggaggaaaaacatgctttgggacaaagataagctgccagtaactgatcctaaagagaggattatagaaaagctgcctgacagaaattcaaaatacttgttttaaggaaatttggctaacttcaataaagtagagaaaaacaattcagaaattcatcagagaaatttaacagagagattgaaataattttttaaaatcaaacagaaatccaggagctaaaaactacaatgaacaaaataaaaaatccaacagaaagcatcaatagcagaattgttcaattagaggagtatcagtgaattcaaagacaggttaattgaaaatacgtaactaaaggtgaaaaaggaaaaaggaatgaagttacaggatttatgagtaacatctaaagagcaaatatgtgggtcactggtgttcaagggggaaccttgaaaaagagaaagtagtagaaagcttattaaagaaataataacagaaagtatttcaaacctggagaaagctatagctatccacgtacaggaagatcaagggcaaccagtcagatttaatccaaataacactaccccacaacatattataatcaaaatgtcaaagatcaagcacaaagagaggatcctgaaagcagcaagagaaaagaagcaaataatttataagggagtactaatatgcctaacaagagacctctaagcagaaacattgtcctgaagaaattcaaagtcctaaagaaaaaaaaattaaaactatcaaccaggaatattacacctaccaaagctgtacttcagaaatgaagaaaagaataaagacttctggacgacaaaagctgatggaattcatcagcaccagacctgtcttacaagaaatgctaaagggagttcttcaagatgaaagaaaaggatagcaatgagcaacacaaaaacatctgaaagtatataactcactgataaaagcaagtacacagtcaaattctgaagtctctaatactgtaatggtggtatgtacatcatatatttttttaagaaggttaagacaacacaattaaaaataatagctacgataatttgttaggggacatgcaatataaaaagatataaattttgacaccaaaagctcaaaatgggggagtggagttaaagagtattttcttttcgatcaaagttgctatcagtgtaaaataaccttttataactataaggcatacttttataagtcccatggtaaccacaaagcaaaagcctataatagatacactaaaaataaaaagcaaagaatcaaaatatactactagagaaaatcacttaacctcaaaggaagaaagaaagaaaaaaagaatctacaaaactagaaaaaaattaataaaatgacagtagtaaatccttacctaccaataattactttgaatgtaaatggattaaattatccaattaaaagacacagagtagctaaatggatttaaaaaaaaagaaaacaagacccaactatatactgcctacaaaagacttgcctcacctataaggatacacatagactgaaagtaaataaatggaaaaagatacttcacacaaatggaaaccaaaacaggagtggctatacttatatcagataaaatagactttaagtcatctgtaaatagagacaaagaaggtcattatattaatatatgataatggggttggtcaattcagcaaaaggatatgttacatatttaggtgctctgatgttgggtaaatgtatatgcacccaatgtcagagcacctaaatacataaagccaatattaatagatctcaagaaacagatagattgtaacacaatactagtagaagagtttaacaccctattttcagcaatggacagatcatttagacagaaagtcaacaaagaaacatcagatatgaactgtaccctagaccaaatggacctaacaaacatttacagaacattctatccaacaggtacagaatacacattcttctcaactgcacatcaatcattttccagtataaatcatatgttaggccacaaaataagtcttttaaatttaagagtatcaaaatcttgtcaagtatcttttctgaccacaatggtataaaactagacatcaataaaaggggaaaccttgaaaactttacaaatacatagaaattaaacaacatgctcctaaacaatgagttaatgaataaatttaaagagaaatttaaaaatatcctgagacaaatgaaaacggaaacataacataccaaatcctatgggatagagcaaaaacaattctaagagggaagtttatagcaataaatgccaactctcaaaaataacccaaagcccaaactttgagaatgatctattaaatgcaaataccctgagaaaggatatcccttttattaaacattaattaatattttatgagaaacttgttttgttgttgttttgttttgaacagatggctcttcctctgttgcccagactggtgtgcagtggcacaatcatagctcactacagcctcaaactcgtgggctcaagggatcctcctcctcagcctccccaggggctgggactacaggtgcatgtcaccacacccagctggacttgttgatagttagtaaaggttgttaggcaccataccatatctggcaatgacaaaaggtgaatgagacaggtgccagtgacaggcaaaatgagaagatgccaaagacaaattctgcctagagtcagcttgggttactccaaaacatttagcctgccatttctgcaacattcagctcttcaagatggcgcacaggaccaataaggcagtctctgctatttattacagagcattgaccaaataacttactactctgtggctgtcaccctgattctgaacccactcttcaaagttttgtttcaaacactttctttctcaaagaccacttttttaatgaaaatacaggcttaccctaaatttgtacaaacataaaagggtatactttactcactatgttccaattataatattacatgcaagcaaataactcactttacaaaaaaataaaaatttaatgaatggtagcagcttaattatttcaagctgccagtaggcataaagtcaaatattttccaaaaacacaaacagccacttatgactcacctgtgcctctttcttttcatctaataaatgtcagcataacagagtgattaagaaggctgacttggaggcagactgccgaagtttgaatccctactctataacatactagctatgtgaccttgggaagttattttgccagtctatgcctccgtttctgtatctgtaaaatgggaaaaacctagtagggttgctgtgaataataaaatacattaattacacagaaagcacttagaattgtgcctggcacattttaacacccattcaatgtcagttattatcattagttattgtatttctaagtagaaaccaatgtctttctccaagagtcctctactagctagaaataatctctcttggcaagcctaaacacctgtcggcaaaactgttcacaaaagcaatggagtcaacagagagaataagcattaatgtcctgaacgggctgtgcatcacacagcctgaaagccccaaagttgtttactttactatcccacaaatattagagtcagaggtttcaagattttgctaagccagttcctactacattcacaatatgttaatatgagatggataagacagtttggtcggctgtcaagtcatgagttgtataaacactagtacgcaacaaaatgactgtaaaagtcatgtggttcctattggtcatattaaattatacttgaagacttttgcttttctagctgcaaataactgggaaaagagtgtacttgagagcaagactcaaatttaaataaactgtaaatttctcaacatcttggaaacttcagttcagcctctttttatgtgcaagactaaacccagtacagtttataacttgaaatccaaacatatcactagcatactgggttctaatctcagctctgatccacacagcactattaacagtatggcccaaaatatttcacttccctctaaatgaaaaacacaatgatatgtaccagtcttaccagacaaaaaaagattaaatgagataaatattaacaacagcagttgtaactgttaataaataacacaggaaagtatcatttacttgaactctaagactcctctctctcacacacacacacacatacacacacacacacacacacacacacaaacatacgcatgcgcacacgcacagagagagacacgcacacacacagaaaaaataaatctgagccaaggaataagggagaaagcataaaaaggaaataatttaatggttcttctaaatactgaaaaaaaaagattttgatatctagaagaacatgaagataaataaaacggtatgttgccaaagagaaggattgtgcaaaaaaaccatagacatgtaataaataatataaaggaattgagaaagaaataatttatttctcagtcagaaccaaaaatgaagtctctatgtaattaggagccctagggagaatataactatgatggaataaatctcacccaacagacttggctgagataatattataaattattataatactataaactaaacaaactaatatccaaaacagcaaactgaaaatagaatgccataaattatatggagttttacacttaacattagtacagcttatgtactttttgtatatcacaataaaaaagcaaaaataataatgccaataatagatgtgaataaacaatatacatatcaagaaacacggatttcttctttcaacaaacatctactaaatgctgactaaatgaaaaataacactacaagtcaaaaaagcagagtgaaaccacttttgactataaaatcagtgattaaaaaatacttcacagattgcttgagcccaggaagctgaggctgcagtgagctatgattataccactgcactccagcctgggcaacagggcaagatcctgtcttgaaaaaaaaaaattcccagtactggcaagaatacagttaaacagccactcatatgcaggtttctggtaatgtaattggtccaagttttctgaaagataatcagagaagtatatcaaaaaactttgaatgtgtttataccctttcactcattaatccacttctaggaatttagtgtaaggaaataaccagagatgtacatgattgatataaaaggatgttcactgcatatttatttacaatagtaaaaaactgctaacaatctatatctccaacaataagcaatgaattatataatttgtaatacagccatatgaaggaacttaagccattagtctaatttcagaaaaatatgacttaatggtacggaaaactgcttatgttagacttaaatgtaagactataaaaagctatatacaatatgattgcaattttcttctatacacacaaacatatacatatacaaccaaaaactggaaagcaaacaccacaatgttaacaacagttttctttgtgtaatgccagattattttattgtacttttcattaatttataaatttcctataataatcatgtattatttttgtaaccagtgcagtgatctttgtggttaaacacaaactgccttttccaagccaactagggaaattccattcccttgtcagtgactgtatcctaggccaatacgtggagatgtctggtgtaggggcttccaggaaagatttccttgctccttacaggaaaaacaagagaagaactgttttcttttgaatactgtcatgaccggtatgatttatttatcattcaatcatttacctaaaaacacctactatgcagcaggcactgtggctaatgaaaagatgtaatttttaatctttgaaacattttatagtagactggaaaacacacaactgagtggggtagcagatatgcaaacaaaaattccaataataatgtgaaattgatctaatggcagcacacacacataacgtgggggcacaaagatttcacaaaccagaagagtctcgagggctgattactgttcaagcaaagaaaaggggagcatcatcagacccagtgtccagccacagcactttcctggcacgtgcaaaggctcagagtttagtgaggcatggtggcgggcacctgcagtattcttcacaatttaatttttaaaaggtaatatgaacatatctttataaatcatcttaaacactaaataatttgctcctgaattctgtatctcatttatatataaatacatcaactatactaaggttattagaggaagcaaatagcttcctccttaagggaatttctcaatccaccaaaataataattattattattttatagcagctatcacttacatggtgcttattctatgccaaggacaattataagcaccgtaaacttatctcagtccctacaatcccactatacaggtgtggaaactaaggaaaagagaagtaaatatcttgcccaaatatcttgcccaaggttacatatcatgtacgagatggagccactcaccaagaaacataccatgtgctcatccacatggtatgtcagttttttattgttttttgttgtttttatccataaaagtcagttttttgttgtttttatccatatcaaaagcaaaaattttcaacaacctcaacctaaacttaaggaggaactatcattttttctaagcatgtgcattcctcatttatgttcacattggttaattcctccctcaagtctctctatccaacatcatccatatcagcagtctccttctaagatcctcagtggatccttccagctgtcagaggcaatgtctctgtctgctgtttatatttacacatccaaagtttacccactcaaacttttgtggggaaaccacagacaatgtctgcctctgccaaaggataaagggagaaaaatgctttccatagagttaaaagaattccatttgtcaaatcaatctgatgatgctggatgaactgaacatttccatctgactaccttaccacctgctatttaatatgaaattacataatttcccaagtggaaaccattcaaattgctcttcaaggaattaaactagaaaattctctttcttgtgtacaacaaaaaggcaggcatgttctagacaggagctgcacagagtagtatttctgcaattttttttcctgaacaaaactgtatttctgttctgttgcataaaaattcaagatacatatccaagataaggaatttggtatggacttttttttaccactgccatatggtagtaaaatcagtttttctagctgataaggaacccctgttctcccaaactgaattcataatttatcccaagacctctgaaattttatttatcagcaacagattcatgatcccagttcttcataatctctgtacagaacaagtacttctgacattaaaataaaatgctataatttaattttaatattaataagtggaataattatttcttttatctaaaaacattcttgctttctctaaaacacaggctgtttcagcaataataatttgtaaagcaggattttatttacaatttcattatccaagtcgatcatgtttgttctatataacatgatgcctttaccaagaccatatataggagaaaattaaacttggtttggctagtataataactatttgttacagcagatcttaagagttatatatgtcaagggattttctttacctgcccagctacttgaaaaccgctaggctattctttgaataggctttgactgtgacttaaccttagcatgcactgatgcaaattctattgacaagccatactttaatacaagtgtccatggttttgtgttttatatggatttacatggatttctttttatttgttcttataggtcaactgagtcccagcacttggctcatgcattcagcatgtttcactctggcccctgacgtcttggttaccaagctcttgccaggggaaatttcctatgctcttccatcttgattagtttgttgataatctgaatccagtgcttctatttgatcacacatagggcatttcacttttttttttttttaatttccaatgactcttctctttgttcactgtttcctgtttcctttaagagtctcatttcagaccaggcttggtagtgcaagcgtgtaaccctagtacttagggaggctgagatgggaggatcactttagcccaggagttctgagaccagctcagttaacagtgagaccccatcttcacaaaaaaacagacaaacaaaaattagccaggtgtggtgacacacaccagtagtcctagctgcttgggaggctgaggagggagggctgcttgagcccatgagtttgaggctgcaatgagctacggatcatgccactgcactccagcctagacaaaagagcaagaccctgtctctagaaataatgataataagaagagtatcatttcaatctactacttttatattttattactctgttttctatagtttttcagagttactacataaggttcagacttaaaaatttttttctgaacttttaaaatacctgattaggtaactaatgctcagaagcacatataattctaataaatagcactatctgtctgtctcctgccagtaacagtatatataaattaacaggtatgatttttacacaatcacggagtatttgcacaaccagtggctggagtaagaactgaaaaaccacacaactgaaccttgaagtgcgcgtgagtatagtatatagaaatcataccacaaaaaggtagtcatctttcacacttgtatttcacggggggataataatttcatgtgtcatcatctacaggcttatgattgagctaaaattctaaatgattcttctccacaaaattaatataaattcaaagcatattaatacattctctattgttcattcaaatttttaaaaatttgttttagtttttaaccataactgtatgatattttattgactgactgagacagggtcttgctctgtcacccaggctggagtacagtggtgctatcatggctcactacagccttgacctccaaggctcaaaggatcctcctacctcagcctcccaaatggctgagactataggcacatgccaccatgcctgactaatctgatattatttttattttttgtggagacagggtcttgctatgttgcccaggctggtctcaaactcctgggctcaagtgatcctcctgcctcagcctcccaaagtgctgggattacagacatgatccattgtgcccagccacacgttttagaatagaaatcagacatgcctgaggcttacatcttctgaaagactgattccagaaaattggtcttcatgtcatccaaccttgcagtaaactctaaaaaacgtttggcaattgttgtgaatcagttaattctacctcctgagtaggcacacatgtcactgggttccagaagagtaatgttcaagcagtggaagggtaattgaccaaaaccatataaaaccccattagaagtgataagggagcttctcttgccatgcaaatccatcctttggggaactctgggggacctgagaaacaatacttctgtctgggatcatatatgctccatcttgatccacagattcccaagtcttttgccattagggaaactgaggatcttccaagtataaccaatgatatctttctgtcagcaatatcactattccattgtgatcaacacgaacattaatcctcagatcgaagaagccctattactcccaagaaggagatcttgaaaaagggatttgagtagagtagtttatttggacaataaagggaacaccattaagaaagtagagaagtgacacagggaatcacagccaatgaaaggagggttattaagccaactaccagagtgggtaggtaaccagagctcagtccaacaagacctctggaaaatgggacaaaacacactcctctgaagtaaaatacacagtaaaactgcagaaactaaaggcaaagaggaagtcctaaaagcagacagagattataaaaagacaaattgctttcaagggaacactgctaagaataggaggcaaagacacaaaaagaaaatcataagccaatatccctgataaacttagatgcagaagtcctcactcaacacaacactagcaaacagaattcaacaacacataaaaaaagatcacatatcatgatcaaatgaaatttacccctgggttgtaaggatgattcaacatacgccaatctatgaagatgatataccacattaacagaaccaagaataaaaatcatatgatcatctcaatagatgcagaaagagcatttgacaaaattcgacatctttcatgataaaaaaaactgtcaacaaattaggtatagaaggaatgtacatcaacacaaggccatctgtgacagacccacaactaaccataccgactggggaaaagttaaaagcattttctctaaaatcaggaacaatacaacgaggtccactcttaccacttctatccaacacagcactggaaatcctacccagagcaattaggtaagagaaagaaagaaagggcatccaaactggaaaggaggaagttaaactgtctatgtttacagatgacacagtacatagaaaaccctacaaattccactaaaaaaaaactattagaactaataaatgaattcagtcaagttgcaggatataaaatcaacaaacaaaaatcattagtgtttctatacaccaaatattaatagcaaactatctgaaaaataaatcaagaaagcaatcccatttacaatacctgccaaaaaaaaagaaataaaatacttaggtataaatttaaccaaggatgtgaaagatctctacaatgaaaactataaaatattgaaaaaaattgaagacacacaaaaaatgggaagataccccatgttcacagattggaagaattcgtatcttttaaaagtccgttaaaatttgtatggaggctgggcacagtgactcatgcctgtaatcccagcactttgggaggccgaggcaggtggatcacctgaggtcaggagtgcgagaccaccctggccaacatggcgaaaccccatctctactaaaaatacaaaaattagctgaggatagtggcaggcacctgtagtcccggttactcgggaggctgaggcaggaggatctcttgaacccaggaggtggaggatgcagtgagccaagatcgcgccactccactccagcctaggtgagagagtgagactctgtctcaaaaaaaaaaaaaaaaaaaaatatatatatatatatatatatatattaagaccccaaagagccaaagcaatcttgcgtcaaaaaaacaaagctagaggcatcaatcttacctgacttcaaaatatactacaaagctatagtaagcaaaacagtagagtactgacataaaaacacacagacaaatggaacagaaaagagaacacacttacagtcaactgatttttgacaaaggcgccaagaacacacactggggaaaggacagtctcttcaatgaatggtgttcaggaaaactggatatccacatgcagaaaaacggaggtagaccctatctctcaccacttagaaaaatcaacacaactgcgagctgggcctggccgccctgcgggagccatggcggcctcggaggcggtggcggcggcggggtccacggctctggcggcgggtgcccgcgccgtcccggcggccacgagaggagcctccgccgccgcctcgggcccgtgggtgcccccgggaccccgactgaggggcagccggccgcggcccgcgggggtgacgcagcagcccgcggcctccgtgctggcgggggagctgatccagcagtaggtgagcgagctgtcccagaccacatggcccaacatcctgtgcaccgtgcgcggctgccgcaagatcctgcccaacagccccgcgctcaacatgcacctggtcaagagccaccgcatgcagtatagcacagtcaatccaataataagaaaagatttgaaaactgtaccgaaattctactgttgtccaatcgaaggctgccccagaggccctgacagaccattttctcagttttctctcgtaaaacagcactttatgaaaatccatgctgagaagaagcacaaatgtagcaagtgcagcaattcgtacggtacagaatgggacctgaaaagacttgcagaggactgtggcaagaccttccggtgcacatgcggctgtccctacgccagtagaaaagcattgcagtctcacatctaccgaactggccacgagatccctgcagaacacagggacccacctagtaagaaaaggaaaatggaaaactgtgcaaaaccagaagttatccaacaagaccactgaatcatttaacaaccaaccaatccctagaccagacacccaagaactagaagcttcagaaataaagctagaaccatcttttgaagactcttgtggctctaacactgacaagcagactctttcttacaacatcaccgagatagcctcaaaagttgcttttaccaaagcccaaagtggctttgcttaaactacccgtgatgcagttttctctcatgcctgtctttgtgcctacagccgactcctcagcccagcctgtggtgttaggtgttgatcagggctctgccacaggggctgtgcacttactgcctgcccttgtcagtaggaaccctgatcctcggcctagattcagaggcttgctctcttaaagagagcctacttcttttctaaattgctgatcctgttgctgttgagccaataagtactggtgttcaagtgaacttgggtaaaagtccatctaatactttacaagaactagggaacacatgtcagaagaacggcatttcttcaatcaacgtgcagacagatctgtcttatgcctcacaaaactttataccttctgcacagtgggccaccgctgattcctctgtgtcgtcttgttctcaaactgatttgttgtttgattctcaagtgtctcttcccattagtgttcacactcagacatttttgcccagctctaaggtaacttcatctatagctgctcagactgatgcatttatggacacctgtttccagtcgggtggggtctcctgagaaactcaaaccagtgggatacaaagtccaacggatgaccatgtacagatggaccaagctggaatgtgcagagacatttttgagtgttcattcatcatataatgttgctacaagtaacattataagcaacagtttagtagcagagatagtaactcatagtttgttacctcagaatgagcctaagactttaaatcaagagattgagaaatgtgcaccaattataaacttcagtgcacagaacagtatgcttccttcacagaacatgacagataatcagacccaaaccatagatttattaagtgatttggaaaacatcttgtcaagtaatctgcctgctcagacattggatcatcatagtcttttgtctaacacaaatcctggacctgacacccagctcccatctggcccagcccagaaccctggaatcaattttgatattgaagagttcttttcggcctcacatatccagactcaaactgaagagagtgaacttagcaccatgaacactgagccagtcttggagtcactggacacagagactcaaacggacttcttactcgcagatacctctgctcagtcctatgggtgtaggggaaattctaacttcttaggccttgagatgtttgacagacaaacacagacagacttaaactttttcttagacagtagccctcatctgcctctgggaagtattctgaaacactccagcttttccatgagtactgattcatctgacacagagacacaaactgaaggaatctccactgttaaagatatacctgctctagaaagcaaagttcagttgaacagtatagaaacacagaccatgagttctgggtttgaaaccctggggagcttgttcttcaccaacaacgaaactcaaacaacaatggacgactttcttctggctgatatggcctggaacatgatggagtctcagttcagctctgtagaaacccagacttctgcggaaccacacacagtctccaacttctaaaactaacagtggagtccatgtgtgagacggcatctaccatttcctctggattaaaactacggacgggggacaacagtattaattcgattgaatgtggctgatgatgcagttgcttagcttctttgcagttctttgccttttgtacttgtaaacagaaatttgtgtataaatgtgagtgtattataaagtttgagatgttgatctaaaaaaaaagaaaaatcaacacaaaatgggctaaatgtaatacctgaaattatgaaactactagaagaaaacatagagaaaatgcttcataatactggtcttctgggcaaagattttttggataagaccacaaaagcaataaaagcaaaaacagacaaatggaattacatcaaactaaaaatccatcaaactaaaaatgtcttcacagcaaagaaaataacagcgtgaagagacaacctacagaatgggagaaaatatttgcaaactatgcatctgagaaggtgttaatatccagaatatattatataaggaactcaaacagctcaataccaaaacaaaacaaaaaacaaaacaaaacaaaacaaagcaaaacaaaacaaagcaaaacaaaaaaacctgatcttttaaatggtcaaagggacctgaaccaacttttcttcaaagaagacaaacaaatggctagcagttatttgaaacaatgctcaacatcagtaatcatcagggaaatacacatcaaaaccacaataagagaggatcatctgaggccagagtttgagaccagcctaggcaacagagcaaaaccccatctgtacaaaataaaaaattagccaggcaggatggcgcatgcctgtagtcctggctacttaggaggctacagcaggaggatctcttgagccccggaggttgaggctacagtgagctatgatcacgccactcattccagcctgggcaacacagtgagaccctgtatcaattaaaaaaaaaaaaaaaaagagtacaatggctgttgccaggggctggcaggaggggaaattgagaggtgatagttaaaggtacaaagtttcagtcctaaaagagaagtaaattttggagatctactatattgcatagtgcccatggctaacaatattatgctgtatagtaaaaatgtactaaaagagtagagcttatattaagtgttcttaccatacacaaaaaaataataacaaaacaggcagggggaactttgggaggtgatgggtatgtttacagttttgatggtggtgataacttcatgggtatatacttatccacaaactcattgagttctatagattaaatatgtacaactttttatatatcaatcatatctcaataaagtgattttaaaaatcaaaacaaaccttttacatctgaaaatatcaaggatctactgcacaatatattaaaacctctctatcacactccaatttaaaatgactaaggatcatgacctagacacactaattaaatgtaacaagaggtttcattgcctgaaaaatagaaaagtagtaaagagacagatcctcaaatgtcatgtctttggatgacaaggaaaactttgaagaaataggtggaaaaactcaacagatctgaaaataaatgttgtctttaaaaataattatgtggtttttattttaaaaaatttattgatatgttcccataccaaatccacagagctttgttaggcttttttttttaatctaagggtaattaatttgaattttccaacagggtttcagtaaagcataaatgaggaaattacatatatctaatggattagaatatttcaagtgtatggatttcgatatgaagacagaaagtggagaaaaggcaggtaaggtgtattcagttagccaaacaaacacagtcatgtgttgggacaatattgggctggctttacacctagagtatacaccaaaataaagaacatcaaacatgaacactgacattcacactcaagatagtcacaactggattgaagcgggctagctctcatctacagaatacctttgatatgtctaaaaattttcaaaattgtaatgaagttcaaaggcaactcatggcttttatatatttaggaatggagaaatgtctcaggactctggtcaatcctcttgaagaaactcttaaaatctctttcatttcaaacaataacattagtcatagtcactgaacttaaaatacaaactaaaactgcagagtgagaagtgttacatagtacagcagactaagtggagcacttaacccagatttggggtgttgaggaaagtttccagaaaaagagacctgacactgagaactgaaccatatgtgggggctcaccaggggaacagcagactgaggcaagagggactttcagcaaagtgtagactaacaatacaaaaggcaattgtttagaatcctgcccaaatcagggatgcctcctttctctaggcatctacactgacttataataatggagataaacattttagggcatctagagatagaggccagccaaaggaatacactactcgtgcttttatattttgatctcaccattttttatccctctgctggtgactggcccacctacatagcatcttccctccctctctccgtccctctcttccttcctttcccaaggttttcaggaaacccgctttcttagaaggagatacagatgcccacaacttctgttggcatgtctgggcaactgcttccaaatgaatgctgactcttgttacctcttctggagagaaaggaaaggctgtggtgttatctaattacctccattactttatttgtgtaagattcatcagacaggctctctactttgtaataaaaacattaaaacaacaccaagcataacttctacaaaaggatttctcaaaagaacctgacaactattacatgttttctctctttgtagaaatatgtataatgtattttttggaagaggggcacacagatctgagtgtggtttactaatggacaaaatgtcacaataaaatttctcgcttctcacaagaaaggaaagcatcatgatatgttaagtgtgagggggacttctggctataaaagtacattttaccaagactgtcaccctgctcaagcaagtagtagatggatttaaaaggactttacaaaacagagtaaggactctggactttattctaagagcaaaggtaagtcactggaggatttttagcattaaagtgatatactcagatttctgtttcagaaaaatcacacaagcaatatagaaaatggaccaccaggggagacaagatcatactgtaagatggaagaccatcttacagtaactgaggcctagtctagtcacatgaaggaatagagaaaagcacccagataagagatgcttatcagggagaacacatagtatttagtatttagatcagacatagtaaaaaaaaggaatagagaggaggtaaagatgttgcttaggtttctgattagagaactagatgtgttatgccaccatacactgaaaggggcaacaaaggagtaggaacatacttggataaaaagataggctcagcttagggcatggtgagtacaagagacctggggcatctaaatgaagaggtccaataggcagtgggtatgtgaggaagaggttaggaaacaggcctgagctgaagacatagatgtagaaacatcaacagagagacagtaactaaagctatggaaatggatgagataacccagggaggatgagaaaaggtctgggccaaggacaatagagatatgggagcaaaggatggctcagctggcctgtgaacattcaattgaagaaaacgtcttgtacccagggagaagtagcatgagttctgctgagatcaattagcagacctgtagcccacccattctgttcttagctgtcacttccaggtttagtctgccatcttcacaaagactacagccatccaaaataaataaaagcagtcaaaaccaactggcaaaatcattgttctagttttatttagtagatttgaagcggataccatctgtgcagccaagtaatatacaaatacaagaaatcaatcttgtaccacaaacgcaatccaaaagccatatcaggacagcacagacatacagtaacatcagacagaatttcaaagtgctataaaacacaatgattctactttttggttgcaggctttaaaaatactacggtatatatggttttaagatcctaaattgcagtcatgttcttaagctagtttgtttttctatttaagtgttgacagacaaaaaatacagttttagtctaacacaccatttaccttacttttaactttatttgagccttaagggtactcttgcaaagcaacaaaaatgtgcagaaccgaggtcaattaataactagttttgaaaatctactgaacttttaactgcacaatatcaaaatccctataatttgtaatgagcaataagaaaacttgaaatttttccagctttgtctaggatttcctcaaagatgaagaacatattattttaagaaactgtatgtggttcctctgtatgtcacatatatagttctttactaacagtgactctattgctagatacccacatgtagactacattttagtaaaaaggttccaaattcagtactgaaaccgttatccacatctaaccgccttcttggagcaaaaccttgttttctaagccccagaataggttttatcccttagtcaatacttaaccctctgtcaaataaaagttactaatggtatcacaaatatactgtatctctgcggccctgcagtggctcacacctgtaattccagcactttgggaggctgaggaaggaggatcgcttgagtccaggagttcgagaccagcctgggcaatatagtgagacctcagctctacaaaacatcaaaaaattagccagacatggtggcgcatgcctgtggttccagctacacgggaggctgaggtgggagaattgtttaagcctgggaggtcgaggccatagtgagccatgtccgcatcactgcactccaggcagggagacagagtgagaccctgtctcaaatgcatgcgcacacacacacacacaaaatggtatctctgtatactcaaaactcatctcctcaaagtctgtccatttctatccatcattgactggcaatgtatgtgtcatggatgtcacactttttactatcagaactcccagaagtagggactttatcagtcatttctttgtaagggtctacacacaaaagccacttgatattagcggccagccaattctatggtctcccaaatatagggaataaaaaaggaaataagttccttaatatcttgttttatatttgaaattcagcaagtatcgtatttacccccaccttcctcacctcagccttctatctccatccactgaaaaactggatcatgaaatttaagcagaagggaaatctggtaatggtaagattaagaaaagggaagaagtctgaagaatccaaaatatggaggagaaaataagaaagaatgatccaagtaaaagactaaaaggaaaatttaagccaaaaataataaaaaggaataaaatacataataaaatacctgataaggcaatgtcaggtgataaccaagaaaaagaagtctgtaggaaataaatacaatttcttttttttttttttcagacagtctcgctctgtcgcccaggctggagtgcagtggcacgatctcggctcaatgcagcctccgactcctgggttcaagcaattctcttgcctcagcctcctgagtagctgggattacaggcaactgccaccacgcctggctaatttttttttgtatttttagtagagacggagtttctcttgctcaagttgatccctaaaccacaaatgacaggacaactgacaattttaaaatcccagtccagggatatgtggttatcccaccctggtacttgttacaccaaatattactgctgacttggggtgctcccacgtcagaatgagaggaccaccatcatttacactagctgccaagagacacatcagcgactgggggctggaaagagagccagtggcaaagataactccgcagcaggccaagggctgcacaaaataagtctggtattgaggttaaaattaaacgaaatgaaagagaaataagacaggggaggatgagaagaacaaatacagcatgagagtgggctctttctatgtagaaggaaggcaaacatctgcaattatttggtggtgagtgccaccaaatttaagactttgttcctcgcttgcaattatttctcggttaagaccacacaaagaaaaaaagagacctaaaggctaaaatgatgaaaagtggctaaagtcagtataacaataaccatcaaaacacacacacacacacacacacacacacacaaaattgttaaagtaacagaggagttaacagtgcatgaagaatattcctgactgactcagaaagatgttcatcataaattcttaagtcaaataaggaagctgcagaaaaatatttataatatcataacatttttgtacaaaatatttatatgtgtaagtacaggaagtcttcaaaaataagtgctggtgctatgagggatttgttggggttttttgttttttttggttctgggttttttttagacaaggtcttgttctgtcgcccaggctggagtgcagtggcatgactgatttaggctcactgcagcctcaacctcctccaagcgatcctcccacctcagcctccctagtagctgggaccacaggcatgcaccaccatgcccagctaattctttttttctagagctgaggtctcactatgttgcccaggctggtctcaaactcctggactcaagtgatccaaagtgctgggattacaggcgtgagttgccatgccctgcctgggatttgttgttgttgcattttttccctgtgtttttcaatttaattgaaataaaaataacaacagttctttaaaataaaagaaaaaaggcctggcgcggtggctcacgcctgtaatcccagcattttgggaggccgaggcaggtgaatcacgaggtcaggagatccagaccatcctggctaacacggtgaaaccccatctccactaaaaaaaaaaaaaaaaaaattagccaggcgcggtggcgggcgcctgtactcccagctactcgggaggctgaggcaggagaatggcaggaacccgggaggcggagtttgcagtgagcagagatggcgccactgcactccagcctgggagacagagtgagactccatctcaaaaaaaaaaaaaaaacaaagaaaaaaacaaaagaaaaaagatcttctaaatcattcagtttttaccctgaattaaacatgtttaatttaatgaatttgtaaacaatccctttaatgcagagcccagctttaggagagctgctcccacgtggtggacagaaggggtcactggccaaccctagttgcattctggtagaaagaaacacaagttttaaagaaaaacggaaaggtctgaacccggcgtcactattcactagttcattcagtgagccagggcaaatgatgtgaaatttctgagtgccaacctcgcttctctttgggagtgaaacagaacctacctcaaagggctgttttgaggattcttgagaacagttcccacctatgaagacacagcctggtggggtagattccaggaaattcagtgatccttctgaccaaaattatactttttgtcatctcaggaaataatctgttccgagaaattccagaatgtaggccgctttcagtgacctgcctttagcctgtgaatcctcagactcaccagtgctcagtagagcagtggggttctgacagttccttctaaagcacttgtgcctacctcttccgggagagcacagcaacattcagcacagcaaaccagagcagcacggctcagatatgaaggcctgcttcctgcaattctctgtcctacaaacatatcagaaagcccagtaggggtaaaaaacagctcttctaagggccatactgcagaagcatggccaaatgaatagcatgatcactgcagacgcagttatagactcagtatgcatatgacactttggcagagtttgcactataatggctgtttacttcttagtgttgttttaaaaccttgaagatgtccactacaaattctagtattcctaagtatgtcttgaacctaaaaaagttcagacccactggacaagaaaaaaaagagagagggagaggtgtaaggcaagtatctagaatacggttgtacagccagactttctgcaaggatggaaaggttctggctctatctgtccatccaatactgcaggcgccagctgcatgtggcttctgaacgcatgcaatatggctaatgaatctgaggaagtgaattttgaattttatttaattttaattaatgtaaatttatataattaaacgtacctattgactatggcattggtcagcacagatctagaaccttgggttaatgacttgtgctaactcacaaagggtgatatgcagatgagtgagctaagttcaaaaagggaccagtcaaaaaggagaacacacgcgcaccagcatcatgttaatattctcttgcaacgcatgcagttcacctttatgaagctgaggtcctagcttgacctcaacctgtcttcgtcagtttaggctgccataacaaaatatcacatacatggtggcttaaataacagaaatgtattttctcacaattctggaggctgtaaagtccacaatcaaggcctattaggtcctgttgagagccctcttcctggcttgtatgtaggcagccacctgtgtcctcacatgacctcttctttgtgctcatgtggggagagatctctctctctacctcttcttctaaggccaccaatcctaccagattaggaccccaccggtatgacttcctaaaggctccatctccaaatacagtcccattgggggttacagcttcagcttcaacttatgaatgggggaggggtggacacaattcagcccataacacaaccctctactcttccttaattagctttcttgtaatgagttccaatatggaagggaagagataatcaccaaaaatattctcagaacgaaaagacaggagtttccagattgaaagggctgaccaagtgcccaagaaaatggatgagaagagatccacaccaggcacatcatcatgaaattgtaaaaacacaggaaggtagaaggaaattaaacaatgcctcacaattctaaaggaaaataatttccaacctggaattcttatctagacaaactatcaatcaaatgtgactagaataacttcacattcaacaggcagtgactagaaataattcatctcccacacattctgctttaggaagatactagaacatctgcttcacatcaagaggagggagaaaacaaagaaagaaaataaagtaaacagaagacccaatatcaagaaaggagagaaggatgaatgacagtgaaggaaaattccagggcgactgcaaaaaagttttcaaacaggaaagggaggggttctttgtacctgcccagattttcttctcaaaatataacatttttaaaaacaccaaaagaattcaaagaaacctccacaacctctttaattttttttaaaaaaaagggggccaggagtgttggctcacacctgtgatcccagcactttgggaggctgagggaggagatcatttgagcccaggagttcaagaccagcttgggcaacatggggaaaccctgtctctactaaaaacgaaaaaaaaaaaataggtgggcgtggtggcgagcgcctgtaatcccagctactttggaggctgagacacaagaatcccttgaacctgggaggcggaggttgcagtgagccaagatcgtgccactgtactgcagcctgggcaacagagcaagactctatctcaaaaaaaaaaaaaaaaaaaaaaaaaagggaaaacagaagaaataaggcagaggtgaaggcaatagatgcagtctgttgtgtcctttatgctgatggaaatagccaaagttcctctgaaaaaggtatcaccatatcaactatgtgcttccacagttaccaacttcagattacaatatggtacttgacaatgcttggcttcaattctccttattagaaaattaacagaatttcaaaagcaagtttaaacaagagaaattcaactgttttcttttgataaatgctgcctctctaatagagcactgaggatcgcttacaaacagtcacttaattgctctattatccaatttagaggtttccccaaaagtccaacaaaaaaaaattcagtaaaggcaaatggaatttaatgcaattaccaataaacaagcaaagaaaacaaaatcaccccacacatacagccatgcacaaagaattaggccaaagcccagttattcagcacttccagtggacccctgcatgctcttaaatttggcaaacatcatagaagacttaattggaaatcagagcacagaaagaaactttagaaatgactatatggccaaaatgatacctcaccagatgtcccactaagtggaaactaagaagaaaaaaacagattaagactggtacaggttttgaatgcttgtcctaccttgtctagatgaaagacaggaccacaaaaaaatgtgcttcaaatcactttagaataaaattccttccctaaatgcagcattctaaaatgtcacactaatacaatccttaaacagcaactatttttagcatccttttattttttaattgaacaatgcaactgagttccattaacagttaattcttcccaactttaattctaacaaactcatttaagttaaatgaccatcaagaataaaagacttatactgtatttttgcattcctacaattcaaaggcaacaggatcaaatgttttcaggctgtgaaaagacacgccatacttcaggttaaaagtatattttattccaaaattaggagtgaaaataaagcttgaaaagaaatgacttctcagccttgaatttggtggcattaatattaatgacaatcccactcatctcaaaggcatttcctagagtgtttatgttatgaaaactgggtctggaatgtcatcttcagtaaatttgaaattgtttaacctgaggttttgctagatttgtaacagctgcactgatgtttacaactgtaataaggtctttacagcatggcactcctttacacattttttagatctggttggtacaaacatgttgtactgatcaacaaaaatgagtttggtatctctctatacctacaagtttagtcagaataaagttttgttttggattaacattgtacaataaatgcatcaaggaccttcagaagttttatggtattggttacagaagaacaggacaaaaacttccattcatatacaaacatttggaaaatgactcagtttgtgtttgtgaaatttgaattttgtttggggaaaagacatgcgtatcaaatacactgtggatctaatttgtttgctggcattcattgagggtttcagggcacattaccaagcagaaactggttgggcagtattcaaagattacatttctcctaatgcccctatttacacagtagaaagatgcaaccgaaagcctgcgaaagacttgcttaacaatgcttccataggaagcttcagccccccttggacatcgaactactggtgcaacaaaaagagcaccagacaggagttagtttccctgggtaacagccaacaaccctgccattaaactcagtttccttctctctaaacatttcaaagagaagttattatttaaggcaaatgttttctgctaaaatcagttgggtttgggtaaccagaaatacccggctcttttgattattgaaaaggttatcatctcataacaattaagacacatttaaaagctgtacacacacaatcaacccaagaagttcatcagtagctatcctcctttgggcaatctcttgggaattccttaattatgagccaaagtaatttttttgaaaagtctccattctatttttcttttctaatttttatttatttatttagtttttagacacagggtttcgctctgtcacccaggctggagtgcagtggtatgatcatagctcactgcaccctcaacctcccaggctcaagcgatcctcccacttcagcctacagttgcatgtcacactgtatgggtctacagttgcatgtcaccacgcctggataatttttgtattttttgtagagacaaggtttcgccatgttgcccaggctcgtcctgaacttacgggctcaagtgatctgcccacctctgcctcccaaagtgctgggattacaggtgctcagccctgtttttctttttttaaaatgcctatcttaccttagcacatatggttattgtgagaatcccatataatctatatggaaataatttggaaagtacaaagcacttttaatagggctattgcccaaagtaatgttagaaataaattaagaaatcaaaagaagtagttaacaaaaaaaaaccatgcttataaaaccaacgtatttgtataaaatcaacagaacaaaaagctctgatttataaagggtatacagtatcttactgctcaagaataataataaccttttctacagatatgaaacttagaagtcaccagagaaccctgattaatgcagtaatttctccaataagtatgacaaatttgttctgatctgtccatttttttctaagtgttagtttaacaactgaatgcatttcagaattattcaaaacttaaattactttagacaaaggtcataaattcaaagtccacaacagataagttaaatgagtaaagcaattagacaggcttgtggtgaaaaacagcaactgtccaaagaagatagccagtaggtatagctcagtggtagagcatttgactgcaaagaagacagccaggatttcactcctgccagttgctgctggaagggaactcagacttgctgttgcccaactgcctgtcttagtctgttttgtgctgctataccagaatatgtgagactcagtagtttacaaataacagaaatttatcagctcccagttctggaggctgggaagtctaagattgaggggtcacatcgcaatggaaggcatcacacagcgacagagcacaagagggccaaactcgcttttataacaaaccactccatgataatatcaatccattcatgtacatcagtaataccttagaaacaatgtttttaaaataacatgtagtcatttagtcatagccactttggccacaaaacaatgtaaccaaaggtggttctgatcaagtaccacaatattttcaaatacttgtcctattctcaccattttgcctcaaaaacatacttttttaaaaacttatttttaaattaaacatcttaggcttaatttttttttcttttttttttgagatagggtcttgctctgtcacccaggctggagtgcagtggtgcaatcacagatcaccgctttttgtttgtttgtttgtgcaatggcccaatctcagctcactgcaacctcccgagttcaagcgattcttgtacttccacctcccaagtagctgggattacaggcacatgtcaccacacccggctagttttttttgtatttttattagagacaggtttcaccctgttggccaggctggagtcgaactcctgacctcaagtgatccacccgccttggcctcccaaagtgctgggattacaggcaggagctaccttgcccagccgacctgcatccttgaccaccaggactcaagtgatccacccgcctcggcctcccaaagtgctgcgattacaggcatgagccaccacgcccggcctagacttaaattattttaaaaccaaaaagacagtacaattttaggcaaacattagatgggtacagcacacacgtgtagaactaaatgaagatacctgaaactttgatagaatgaaacaaatttctagcttttaataccttcaaaggaatgtcactaccaaaattcaagatatttttaagggcaggcacagtgtctgcctcatgcctgtagtcccagctactcaggaggctcaggtgggaggatcacttgagtccaggagggcaagactgcaacgagttatgattgcactactgcactccagcctgggggaccgagtgagatgcatctcgaaaaaagaaaaagatatttgtattgcacttttcttgcttacaactactcaattttaagaaaaaatcagtcatattataccatttcatataaaaatatttctgttactcctaaaactggctgcatagtttcaaaaagtcaccacttatcaaaatacttatcatcaagcaaaagtttcactagctttgccaacttttttagtgtaatgactaaaaattctaatggtactagtcagtatcagaaacacaagatactcttctgggtgccaaatactgcagaaaatactacttcataaataaaatgcatgctgttataccaataataaacggttactcactcttacggcctatgattggaaattcctagctaacggcttcaagcaaaagcagcaattcgatattatttgtataaatgtatattttatatagtgttttattataatctttaatatgtaggggtagataggctaagtaatcgttacaatccatgttggacaaggtcatgtttgggtacaccaaattcagaaagctagggctaaatataactgattccttcagacaagtgtcttactaatcaattacaatgtataatctgcatacattgtaaatcaccaaatacacactaagaattacaaaattatactatatcacctaggatgcctttggtttccagtaattgaaaacccaactctattcatcaagataggctaagttatgatgtagtaacttttttctgatactatatgtccaacatgttatgtgggacacacatgtttgtggggtgggggtgttgttctgctccacagtcactcatggatccagcatgacaggtgctcagacatctcaacacctagcctccagaatcaccattgcaaaaagaagagatagctaggtcaggaatctgctactaaatgcttctacctggaaataacctgcttaaaatctattggctagaacaatcacaatgtcctacctagctgcaagtgaactgggaaatgtgagggaagatctaaatatttagtaagcattaaatgcccctgctgcaccaagcaaaaccagctaaaacaataatgggaggccaggcatggtggctcacacctctcatcacagcactttgggagacccaggcaggaggacagcttgaggctgggagttcaagaccagcctaggtaacatagcatgactctgtctctacaaaaataatgataattaattagccagacattgtggtgcatacctgtagtcctagttactcaggtggctgaggtggcatgattcctggagcccaggagtttgaggctgcagtgagctatgttcgtgccactgcactcctggttgacagggcaagaccctgtttcaaaagagaaaaaaaaaaaaggagggggggaattcgttggttcaagaaactggcaagtccagaaacagggcagacttcacagttgatctgtctctccatcctgcttccctcatgatagcaaaacagctttagccattacagaagtcacatcacatccataccacccaaaaatagagtacatacttctgttccagcatcccaagtaagagacagacctcagatgtattcagactggacttgcttgagcttatgcccatccttaaccaatgactgtgacgaatcaataaaacacactccttaaaccaataaaagtccacccccaggagctagaggtagtatcagtgttccccagagcccatagaatagtgactactaaaagaaaatctagggtctgttatgacagagaagggaggaaaggatgttggcactcaacaaacatcaatgcagttatataataaaaaagaatataccctgaagaagttggctaagagttgtggaaacaagcatatacacataaggcaataatatgaactgcagtgcacaaagacagaggaaaagtcattatgcataaccacaaatggtcatcaataaatcaggcgttggccaggagcggtggctcacgcctgtaatcccagcactttgggaggccaaggcaggcggatcacgaggtcaggagatcaagaccatcctggctaacacggtgaaactccgcctctaacaaaaatacaaaaaattagctgggcgtggtggtgggctcctgtagtcccagctactcaggaggagaatggtgtgaacccgggaggcagagcttgcaatgagccgagatcgcgccactgcactccagcccgggagacagagtgagattccgtctcaaaaaaaaaaaaaaaaaaaaaatcaggagttaataaggaaatctattgagtacagcacttgaatgtacaagcataattacaaaaataggattaggctaagtacaatgccttataatgttatagctttaagtaaacagtaacaaccaacaaaaacaaaatgacaacaaaaaggaaccagccataggagggtgttggaagtcactaaggtaaatggcacctccaaaatcttataaaagaagcaaaagtgtctggcaattccatacctttgaactgaaccaggtaaagaaggaatcacagacataaagtcatagccttttatttatttatttttttccctggagatagggtctcacaattttgcccaggagacttgaactcacaatcttccagcctcagcctctcaaatagttgggactacaggtgcacagcactgcacccagccaaattcatattgtttaaatagtctcctctgaatctgtgtgtgtgtgtgtgtgtgtgtgtgtgtgtgtgtgaaaaaccgcagcctcaaactgtcttatgggtagtcaccagagtaacagatctcagattccactaaaatagctaaatgtatataaaatgtttatatcacacataaatgtttctgaattacaaaagcatcattggggctctagaggaaaatgaaaacacaagtcccagaaatctgaaaaatgaaaaacaggggtgaaagataatgagaagtacagtcacatctaaagtcaggtcatctgggaaccctgcccactggatgccataaggtcgaccacagttctaatcctgtcctcttctcctcccctcctaatctctgaccccactttccatgataatctatactgtttctaatttgcaaaggcatggaaaggcagtttcatcacttcataaaagcctacatactctcacacaaacgtgtctttcgtcatgtggaagtgggagaaaccttaggattaactttcacaattcaagaaaatgaacagactaaatactctcaccactcatgatttcttgaggaagttcagagcaaaggtgataaatcagtctgggtccagtcagtaaaaagaaaccacataataatttgaataaggaaagtcaactataaataattactgttgttgttgtcattttcttttttagagagagggtctcactctgttgcccaggctggaatgcaatggtataatcatggctccaagcagcctcaacctcctgggctcaacgatcctcccacatcagcctccgtagtaggtgggacacacaccactcccagataatttcgtgttttctgtagaacaggggttttgctatgttgcccaggcttgtctcaaactcctagtctcaagtaattctcccaagccctgcggcctcgcaaagtgctgggattacaggcataagtcaccatgcccagtcaagaactattcactgtaacaggactggagtaacaaggtgctggctagtaagaagtacagagaattctacaaaacacaggaataggagatataaggaggagccactgcccctagggctgaggtgggtgccctaaggaaaaatacccacttcttcccagaaatgggatcaagaactttttggagggagcacagccatggctcactgaatacgagagatgtctctgtgggtgctgtaccagtacaacttgctggaaaaccacctttggtaacttgccagaaacccatcctctagggcgccaggaaaagtgttcacagggaggtgtcccaccacaggctcagttacaaaatcgcctgagggggatgctgaggtacacagttgaccattgggtgcagctgatcacagcgcactacaagagcctgcactggggaagatacacaccacagaagccggcgctgcagaagcacatatgccaaggacctagcgctggagacgtgcacacgcctgggaacaggtgctggggcggcacccaagcacgggagccagcgttggggaagcggcacaccccagggagctagcgctggcaaagcacacccaccaagagtgagcgctagaaagccgcacacactatgggagctccgccctggagaagcgtcacgtgtgtgcctgggaaccagtgctggagaaagtatgtggaagctggcgatggagaaggcgcgcgcatgtgtgcacaacctcgctctggaggagtcacggccaggtgcgcgcacgacaaccttcaccggagaagtcacacgcatgcgtgcgctggagaacctgaatttgtaatttcaaatttccctataaagaaatatccacgaactgatgactttgtgagtgaattctatcaaatatttgaagaaaaaaaaataccaatccttcacaaactctgaaaaaataggagggaacacttcccaactcattctaagatgccactattacggtaataccaaagccagacagacatcacaagacaaaatattactaatattaccatgaacataatacaaaaatcctaaacaaaatattactaagccaaatccagcaatatgtaaaaaggattatataacatgactaaatgggatttagaatgcaaggttagtataaatacacaaatcagttaataaatcatattgataaaggaacaaaaccacagtcatctcaatagatgcagaaaagcaacatttctaacatttgttcataagaattctcaacaatctagtaacagaaggaaaatctctcaacctgataaagtgcatttatgaaaaacttacagctaacgtcgtatctaatggtaaaagattaaatgttttccccctaagatgagaaataagtcaataatatacactccatgtctattcagcaaagtgctggagggtcgaaccaggtaagaaaaaaattaatcaggcaaaaaagaaactaaaggcatccacatggaaagaaaagtaaaactatattggcatgatgccgtatgtagaaaatcctgtgtaattcacaaaaaactggaagtaatcatcaagttcaacaaggaaggttgcaagatataagattaataagtgaaatcaagtgtatgtttatatactgacaacaatccataatgaaattttaaaaataattcggctgctctacctgtggagtagccattctttattcctttgctttcttaataaacttgctttcggccgggcgcagtgactcacgcctgtaatcccagcactttgggaggccgaggcaggcgggtcacgaggtcaggagtttgagaccagcctgaccaatatggtgaaaccccgtctctactaaaaatacaaaaattagccgggcgtggtgaagggtgcctgtagtcccagctactcgggaggctgaggcagaagaatcgcttgaacccgggaggcggagattgcagtgagccgagatcgtgccactgcactccagtctgggcaaacagagcgagactctgtctcaaaaaaaaaacaaaaaacttgctttcactttatcgataaaaaaaattttaatgaaattttaaaaataattcaattcacaataccatcaaaaataaaacttcaaaattaatttacaaaagggcaaaatttgtacactgaaaattactaaatactgctaagagaaattaaagcgctcaacaaatggaaagagattccatgttcatgatgagatggcaattctcccccaaatagatatgcaaaattaaatgcaattcctacaaagtctatcacagcacggttttctgaaaaaaaataacaaactgatactaaaatttatatggaaatgtaaggaaccctgaaccgccaaaacaattttgaaaatgaagaaaaacattggataacttacactacttaatttcaaaacttactataaagctgccataatcaagataatgtaatgctgacataaaaggcatgcaggtctcttaccctcagtcccgtattaaacttgagttagaagatgccaatctcaaaatggaggtaaaaccattgcctgctagcccccagtccaactctggtggccaatctgaattgttaccaattttatttttccagacacggtctcagtctgctgcccagtgtggagtgcagtggcgcaatcacagttcactgtggcctcgacctcctgaactcaggtgatcctccacctcagcctcccgagtaactgggaccacagccccgcatcactatggccggctaatttcttaactttttgtagagacagggctctctctgttgcccacgctggactcgaactcctgggatcaagtgatccttccgcctccgcttcccaaagtgctgggattacaggcataagccaccatgctctgcctgttatctgaattgcctttccttctccacttctgcatttttattaaaacattgcaaaacttccaaggtgcttctcctgtatgtattttttcacattaagtcaatcactcaagatccacaaacaagacagagaatgcacatatcccagcctaaaataaaacttttaaaaatcatttggtgctcatttccagcccgatttgaggccctaacactaccaacttggaactaccactcatgtgagtttcctctggctctctccatggcccagataatcaatccaactttctactggccaggctggcctccctgtagctggttctcataaacacgaaatttgtataattgttattggaactacctgctgaaatatggaactggttaaaagtaccatttgttttaaaatgtacatgcacagttgcacatacatgcagcaacacatcttccacaaccagccaatcaatcaagttaatgctttttattagaggacaaaacaaaaaataccaatatagagcctgcttttcttttctgatgccttggtaaacgtttttggagaaatcaagagaaaatatgaccgaataaagcaaaaataaattcgaatgtataatatacaaagtataattagtccagttctcaagaagcaggctctattactgggagtagtgggttggtgaaaaagatctctgatatatctaggaaaacaaattctttttcgatgcagcctttcttgtatatgaataatgtatatgagtgcttatttccaggtgactctggtacagcacataacattgaaacatcaattcaagtttaatgtataaagtcgcaatgaacatgttttccatctaagcttaggtaatgaatgatctcaacacatggtatgaattctactgtttgtaacaacctttcaggggagtaaggagaaaacgatctgtctgagggcatatcactgacagtgagtgacagccacaaagagctgaagttgggtggcccaaaagtgctctgctcatttgataaatgctaagtcaaatcacatcacagtttagatgcattaaatggggcacaagttagaataaaatcagatgcccgggagttttccaagtttcagattagaacaaaagtccaggcacatacaggactttgctagaaaactccttggtctcttcccttaagattctggtacccaatttcccatgttataaaactccaagtcttttcccccattcggtgcgctggacacataagatcatagagggttcgtagttgtaaacgcacccacctaaaaaattaaaaagagcaaaccaacaaacagcacctgaaaaatctctcacgggctttgaagatatggcctggcgtccacaaaaagaatggagggaagacactggcctctgcgaacccgcctccctccgggaataaaaggcggagggcgggaggggtaacagccgcgccccgggctcctctaattggacctcgcccctcctggcgccccggcgaatggggtttgggggcaggggtgtgagggacggggaggacgaggccagctgtagagggcgaccggctcaaaggggcgagcttttcacggctcccacgagtccgaggcagagaaattcacctttgctcctctcctttgaagaagacatagctgcctgcgctcaatgaacaaaaagaaccaaaacgccaacacccggctcccgcctctccgggggctcccttccgcgcgaccccagcgccggctcccgcccccgctttccccgccctggccccgccccgcgggctggcaccgcccgccaccttccgcctcccgcctcccgcctcccgcctcagccttagccacagccctgcgccggcgggaacccctctcgcccaccgcaaggcgcgcctggcccacccgctctcgcgagccttccctcttgcccctcgcctcctcctcccgctctcgccgctgacgtgtcggccagacccccgagggaagcctccgccctcgctgcgttctgcggcctgccgcttaccgggtggtcctcgcgggagctgcttcagcagtttgggcagtggcggaaaggaagccaccgcccgggatctgtggcttgaaaatttggctttgcctcgtattggctttttgagtttttttggaattttcccgcggtcgcccggcagtggagccgcgcgcgcgcacacgtgtcagcagtgcattctggggcctggctagcggccccg

SEQ ID NO: 116 - DNA, 75551 bp, Homo Sapiens
cgtcacgtcatggcgcgcctcggtggcgtcagagcggcgtcgggcctggcgggaaagtcgaaaactacgggcggcgacggcttctcggtgagtaagtggagcaatggtcgtagtctctcgaggccccgctcccctgcggcctaatctctaagtccgggccgcggtcggcgttctcctctggggctccgcgccccgaaccttggcttcctcatctgccctgagatgggataatccccacaggtacctttctgcgtcattaaaatgcggaaacgagaaaggcttttaccctcacccgcttcccgatgaactaatccaggcagtcggcctcatctcacttctgttgggcttttctggaagccagatggtatcgcacgtgttaaaggcgggtgcctggaagccggacgtgctgacaagacttagtttttccatctgcaagatggctgataatggttatccgtattaaccgaagcggcgataaataaaaagtttagcacagggcccggtacctcgtaaatgttaaccattattagaagtcattataatcatcaagagtaagtataggtggtgaagagcgcaggtgctgaagccagactccgagttagaatcccagttctgcccgtgatgatgagaataatggtacccacctcaaaaagttttgtgggaaataaatgaattattaaatataaagcacttgaaacagttcttgttagcttttagcatttcccctgcactgcgagcttttttcactctgaatattctcagaaattttccttatgccggtaactatgctgggcattagggacattgagtaagtgagactgggttcctgctctcaaagagccccagtctagtgtgaggtaagggcccctaggtataccctgtggagcagggaagctgcagtagcaaactcccttagggataggaggaacacttttcaaggaagatgacattcgattgaatgtttagatctgagtaggaatttccaggcaaataagagcacttcagatgaaaagaacacctttgtgcaaaggcactgagaccacgaaggttctgatttacaagattaaaaggtcatgtgattcaggcacttcccccacctctgctgtctgatttctaactccacatctccttgtttcagtatgagtatctatttgcctggactcctcttctcctaccccttctactggctaactgctgtttcagccctcaagtccctgcctaaaaatcacttcttcaggccgggcgcggttggctcacgcctgtaatcccagcactttgggagtccgaggcgggcggattatgaggttatgagatcaagactatcctgggtaacacggtgaaaccccgtctctactaaaaatacaaaaaattagccgggcgtggtggcgggcgcctgtagtcccagctacttgggaagctgaggcaggagaatggtgtgaacccgggaggtggagcttgcagtgagccgaggctgcaccactgcactccagcctgggtgacagagtgagactccgtctcaaaaaaaaaaaaaaaaaaaatcacttctttaggccgggcggctcacacctgtaatcccagcactttgggaggccgaggtgggtggatcacttgaggtcaggagtttgagaccagcctagccgacatggtgaaaccctgtctctactaaaaaaaaaaaaaaaaaaattcaaggagattgtccctaagaaatggtccttgcttctctttaccacccttactagcaactagactaaatttcctagtaagccctcatagaacctgtacttttatagcacttacataactgtagttcagtacattaaggctatttgttaccatactgtaaattccctgaggacagggatcatgtctgtctagttcacagttgtaaccccagcacctagcacagtccctaacatatagtattgaaatcatgaattaaaggacaggtacgttggggatagataatggagggtcttgaatctcagatggagagtgatgggttttatccttcagcaacagcgaagtagtctgcctaaagaggtaactaagacttgaaaggaaggtagtattggctagatgtaagagttgaaatttgcttagcacctaggtttaggtagcattaatatggagatgtgagcccctctgattttggatagagcagttttctttgaacaatagctttaacttctcagaatttatcttctagagggtaacttctgtttcccgattttgctctaggaagtaatttaagtgcacaagacattggtcaaaatggtttccaaaagaagactgtcaaaatctgaggataaagagagcctgacagaagatgcctccagtaagtatctagtcatttgttgctttatttcctgtagcaatgtgtgaggcatgtgagagatataaagttcctgcttttcaagtgctgagaatcttcaaagtgtaatgaatggagtgcacagaattaagggagaaatatcagatttgggactgagtttttgcctcgaattctgcgtataactttgagtatgaccacagcctctggacctcagtctccacatccataagaggaattagtgttacagactttttctgctatacatcatttaggtgttgagacacaaagacataacatagtctgtacccttaaaaaactttatggtctttcttcctctcttggaaaaaaaatattatgatctagacacatgctatgttagtgatgtgaaaggaaaaatacatcaaagcaagcaaaccagaggcaaagaaacagtgcagactctgcccatatgagaaatagttgacaaagatcccaagagttccagatataaggagttgatggctgggtgctatcgctcacacctgtaatccaagcactttgaggggctaaggtgagagggtcacctaaagctaggagttcaagaccagcctgggtaacatagcgagactccatctctacaaaaaatttttttaattagctgggcatggtggtttgtgcctgtggtcccagctactgaggaggctgaagtggaaggatcacttgagctcaggaggtcgagggtgcaatgagtcaataacagcaccactgcactccagcctaggcgacagagcaagagagaccatgtctcaaaaagggagtggggggcggggaggttgatagttcatttattgctcttatctactctattaatcttgatttgtgttggtttgtttttattttactaggttttttgggaacaggtggtgttcggttacataaataagttctctagtggtgatttctgaaattttggtgcacctgtcacccgaaaagtgtatggtgtacccaatgtgtattttttcaatccctaaccccccttccaccctttctcttgagtatccaaagtccattatatcattcttgttgttgttgttgttgttgtttgagacggagtctcactctgtcacccaggctggagtgcagtggcacaatctcggctcactgcaacctccacctcccaggttcaagcgattttccagcctcagtctcccgagtagctgggattacaggcgccagccaccatgcccggctgatttttttgtatctttagtagagacggggtttcaccatgctggccaggggctgtctggaactcctgacctcaagtgatccatccatctcggcctcccaaagtgcaaggattacaggcttgagccaccacgcctggcccattatatcatttttttttttttttttgagatggagtttggctcttgttgcccagtctggagtgcagtggcacaatcttggctcactgcaacctccgcctcccgggttcaagcgattctcctggctcagccgcccaagtagctgggattacatgtacatgccatcatgcctggctaatttttgtatttttagtagagaaggggtttcaccgtgttagtcaggctggtctcaaactcctgacctccggtaatccacccacctcagcctcccaaagtgctgggatatcggacgtgagccaccatgcctggcctcattatgtcattcttaatgcctttgcattctcatagcttagcttctactgacttgtggattgaagagttatttcttactaggttattggaagttaagtctgattcttggtcaattcaaccgaaatagatgaaaatgcttgctgaacagtgattataatgataaaaattgtgagtccaaaaccatgtaaggaataggcttgatttagaaacggaaactgtgggccgggcacagtggctcacacctgtaatcccagcactttgggaggccaaggcgggcagatcacctgaggtcaggagttcaagatcagcctggccaacatagtgaaaccccatctctactaaaaatacaaaaattagctgggcgtggtgtcacgtgtctgtaatctcagctactcgggaggctgaggcaggggaattgcttgaaccccggaggtggaggttgcagtgagctgagatcacgccactgcccttcagccggggcaacagagcaagactcttatctcaaaaaaaaaaggaagttgtgaagctccaatggttgattagtaatggggttctagaattagaatatagagaaattggtagaaaatttgaaactgaagaggaataatataggaaattactgaaagtaaatgttatactttggaaatactgttctccaaaagagaagagacttctgaattaagtttattagaagggatttgggttctcttggtcagtaatgaacaaactgaaactttcattctggttgtgttttacatttcattcaggaaggtagtggtctttgtctcattctgattaaggctttattagaaagagggaaaggaggccaggcacggtggctcacgcctgtaatcccagcactttgggtggccaaggcgggcagatcacgaggtcaggagattgagaccatcttggctaacatggtgaaaccccgtctctactaaaaatacaaaaaattagccgggcgtggtggtgtgcacctgtagtcccagctactgggaggctgaggcaggagaatggcatgaacccgggaggcggagcttgcagtgagccaagatcgcgccactgcactccagcctgggcgacagagcaagactccatttcaaaaaaaaaaaaaaaagaaagagggagaggaattgaagaaggaaaaaacaaaatggcatcattaagggagaagagtaaattttaaacttggcttcaagtacctgtttgtttcttgtttcttatttctttttatgggttgaaagtcttgggattaaacctatctgagcattgtagtcaaagatatgatacaaagaaccttccccattctgtctaccctttattcagatcattgagtctcaaatttggtgtgtatcaggattattatctgaagaacataaaaaattcggattcctaggtcccattcccaagattttgactcagtaactctggtatatggcatggaatatgccttttttttcctttgagacagagtgtcactctgttgctcaggcaggagtgaagtggcgcgatctgggctcactgcaacctctgcctcccgggttcaagtgattctcctcctcagcctcccgagtagttggtattacaggcgcacgccaccacacccagttaattttgtatttttagtagagatggggtttcaccacgttagccaggctggtcttgaactcctgacctcaggtaatcagcctgcctcggcctcccaaagtgctgggattacaggcgtgagccactgtgctgggtcggaaatatgcattttaataagcttcccagggattccagtacagtggtttgcaggcaacagcttgagagacactggctagtttagtatttgggtggaaaacatttctgtgggttattcttgttaggcacttatttgtttgaatttatttttttagagatggggatttcactctgtcacccaggctggagtgcagtggtaatatcatagctcactatagcctcaacctcctgggctcaagttattcttccgccttagcctccgaagtagctgggactacaggtgtgcgtctcctcacctaactagtttgtgtgtggagggggggaatgggggtgaagggggggagatgggggggtggtctcactttgttgcccaggctggtcttgaactcctggcttcaagtgatcctcctgccttggcctcctaatttgctgggattaccacatgagccaccttgcctggccagaaatggcacattttgaattcttcaaatgaaaataggtgaaaataattctatttgtttgttttggaagccactattgctgaagacagtttatttcactacagcatcaatcctagtataatttttaaggacacatcagttttcctctcatgattattattcctgggtttaagttttaatttttcctttactatttgccatattcttgaaaatttttctattttcagaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactaggtaatattttaatctaattttattctctgggtttaatgaaatagttcaggactgaatcatgggttttctaaatagagaggcaatgaagattagaaatcagagggccatccatcttgagacaaagttgaaattgctttttagaaaatggtacagtcaggccgggcgcggtggctcacgtttatcatcccagcactttgggaggctcgaggcaggcggattgcctgagctcaggaatttgcgaccggcctgggcaacacgtctctactaaaatataaaaaattagccgggcatggtggcatgtgcctgtagtcccagctgcttgggcgcctgagtcaggagaattgcttgaacccgggaggtgaaagttgcagtgagtcaagatcgcaccactgcactccagcctgggcgacaagagtgagactccatttccaaaaaacaaaaatggaaaaagaaaatggtacagtctttggtcctcattactatgtcttaagtaaagcatttctcatccttttattagaaaaaatattatatattatttattttgtgttttcttatgaaaaaataaatatccagaaagcagctgtatcagtgtcagaataatttcagaagaaaatttataaagccatataagattctgttttgggggagcagattattctatcttgctaaggttatggcaggtcttttttagaacacttagtggctatctgctatcaaagctaagtcttttttttttttttttttttgagacggagtcttgctctgtcgcccaggctggagtgcagtggcgcgatctctgctcactgcaagctccacctcccaggttcacaccattctgcctcagcttcccaagtagctgggactacaggcgcccgccaccatgcctgactaattttttgtatttttagtagagacggagtttcaccgtgttagccaggatggtcttgatctcctgaccttgtgatccacctgcctcggcctcccaaagtgctgggattacaggcatgagccaccgcgcccagccaaagctaagtcttttatgtgggtttagacacaaccccatgactctgggctgggcacagtggcttatgcctgtaatcccagcacttgggaggctgaggagggtggatcacgaggtcaggaaatcgagaccatcctggctaacacagtgaaaccctgtctctactaaaaatacaaaaaacgaaacaaaacaaaaaaaaacgtgtctgtagtcccagctacttgggggggctgaggcaggagaatcatttgaacccaggaggcggaagttcctgtgagctgagatcacgccactgcactccagcctaggcaacagaacaaaactccatctcaaaaaaaaaaaaaaaaaaaaagatttgtctctgaaattaggttgaaaatatttttattggtttcatcaggcaagaaacttgggtttttagagaaggaaaactatggtaggaaactggtgaccagctcttcttttttctgcatagctgtggatcaaatagctttccaaaagaagctctttcagaccctgaggagacacccttcctatcccaaagtatgtatttttcccctggtatttttgcttgtgccagcataactctagaatttggaatttaaggacactggtataaagttgagtgggctagaatgatttttaacagcaaatattaaactaaaaattttattcttttttattttttaaatctccttaagataatagaagaatttgttagtggcctggagtcttacattgaggatgaagacagtttcaggaactgccttttgtcttgtgagcgtctgcaggatgaggaagccaggtgtggagaggaggcatggaatcttgctgaaattcagtctgttttgccaacttcatggggctggggagggagagcacagttgtttcaaatttcatttttggtgtaagctctgttttcctcagagtttaaactaagtttaaaattcctaagcttgtggttatgagcctaacaatcagtgttttacctatgctgacagaatttcaaatctctacctctcccttgcaaagagccatctgctcatttctgtatttcttgtctaacagggtagttcctctttaaatattatgtatttaaccaattttattgagaaaagatgataaaagcattaaaacaaggaaagcaaagtggaaaacagatttcttttttttttacagtatgggtgcatcttattctaagagtctcatcaaactgcttctggggattgacatactgcaggtaagactgtcactttttctgtgaacatttgatggaagaggtttgtggtgtatgctcaagtctaaatagcgggaacacaggatagagtagggttaattggagaatttgggtttgtagcagctttagcacagccctgttgctgtgatgggtttggtagggtaatgtctgtgttttaaaactgtgcttattagcctaatacatctggcggccccatttattctctctgcatctgattcctgttcttaaagctgcatcctgtgtatctctgagtatctggtaatctttatcatattcatatctacattatctcccatttagctttttagatgcttatgtaacttaattttgtccttttcctcctcctcgtctcttttattaagtagacaatacattgatatgatttaaatatctcaagttatacaaatgtatatagagcagaaaacttccctccaccccattctccatttttcctcttctcccctactgttaatcttttcacactcttaaactcttccttttcactggaaatcttgaagataatttagttattttaagtctaagagctcccttgttcctcctgagagctccccttgcaagttatttgataatcttttaaagtttgcattttgtggattaacagttattgtatttaataatattttaattatctgattattttaacgttgccttgataatcattttcagtttttcagaagacaaattaagtctttgtattccaatagcatattctaaaaatgaagacatattcgtgtggatatccttgtaataagatatcaactttagcaaagtgtttattccaggagctctagttggaaagagaattatacatttctttttttttttttttttttgagtcagagtctcctttgtcacccaggctggagtggagtggtgcaatctcggctcactgcaatctctgccttccccaggtccaagaggttctcgtgcctcagcctcccaagtagctgggattatacatttctattgtgtattttgagatcatctcctaactccctatgtcttcttttttagcctgccattatcaaaaccttatttgagaagttgccagaatatttttttgaaaagtaagtggcgttattatggaatgttcaaagtaccctgatgtacttaagttctctctgaaaaggttactctgaaaactattggtttctctgaaagtcatatttatcattatatttcttaagtgactactaaaattttactggagtgtctttgaagtttcatctattaatatgactttgtaaaaatagataggattactgttaaaagtaactattggcctggtgcagtggctcacacctgtaatcccaacagtttgggaagctgagggaggaggattgcttgagttcaggaattcaagaccagcctgggcaatgtagtgagaccttgtctgtatttcaaaacagaattttttttttttttttaagtatctgttgcttatgctcagggataatccctagtagaaggatacacaatatactggtaatggtagttgtctccaaagagggtagccagttggttggaatcaggtattttctgaatacttttctttaccttttaaattttgtagtgtatgttcagacagggtctcactctgttgcccaggctggagtgccgtagtacgatcatggctcactgaggcctccacctcccaggcttaagtgatcctcacacctcagcatcatgagtgcctgggactacaggtgtgcgccacccggtccagctaattttcgtggtttttttttttttggtagaggtggggtttcgccatgttgcccaggctagtctcaaaacttccaggctcaagtggtccacctgccttagcctctcaaactactgggatgtggccctacctgtttttttttaattactatgttaagaaatgaacagcctaatagaaaagtagacaaaggtcatgaacagacagtttacaaagaagaaatacaagaacatcaaatatttaaaaagttcaattttgttagcaatcaaaggcacaaatttaaaacactgtatcaaaatagtaaataataactattacacagtaaaataaatgcattttttcctactctcaaagggtctccttgttgagtgtagtgaataggcatgcttgtacgttgctagtgagcatataaattagttcaggcatcgattcggaagagcaatagattgtatgtgtcaaaaaccttagattttgcataccctttaatcctaatgtcatgtctcctcatttatcctaagataataactgtgaatgaaaatgaaataatattagtttagtgcttgctttggcagcacgtatactaaaattggaacaatacagagattagcatggcccttttgcaagggtgatacccaaatttgtgaagtgttccgtatattgaaaaagattactctttaaaataaagaaatgtaaataattgagatgttcaaaaaatagaaatattatgtgcacattaataattgtaaaaagaattagttaatatcatacattaattgaaaaaaacaaacccaggttacacatagcacttatattaggttggtgcaaaagtaattgcagtttttgcaataagtagttcagtattttgtttaaaaaagaagatacacacatacacatatgtatattaatagtgtacctttctggaatgacaggattatagtcatttttatgttctcctttttaattttttcagagtcctgatacagtaatagtaagtttaaaggtttacttattttgagacggaatctcactctgttgcccaggctagagtacagtggtgcgatcttggctcactgcaacctctgcctcctgggttcaagtgattctcctgcctcagccccccgagtagctgggattacaggtgtgcgccaccacacccagctaatttttggtatttttagtagatatgaggtttcgccatgttggccaggctggcctcgaactcctgacctcaagtgatctgcttgcctcagccccacaaagtgctgggattgcaggagtgagccactgcacccactgaaggtttattttttcaaatttgttttagctaaatgtctcatgctggatgctttacatcctggctagtctttttcagttaagattggctgcaataacaaggaccatgctgtcaaggagatggaagtggtccaaaactttagatataggaggctcgaaggaaggtggaaactatcatatttggaaaaatgataattgagccaacatttctttatttataaatgatttttagtacttttataaatataatctaatttgactttctatgttcccttagcaatatatgcttgcttttttttttttttttttgagacagagtcttggctctgtcacccaggctggagtgcagtggcacgatctcaactcactgcaacctccgccttctgggttcaagcgattctcctgcctcagcctcccaagtagctgggattacaggtacccaccatcgtgcccagctaatttttgtatttttagtagagatggggtttcaccgtgttggccaggctggtcttgaactcctggcctcatgtgatctgcccaccttggcctcccaaagtgctgggattacaggcatgagccactgcatctgacttatgcttgcctttttaagcacttactgcgttgatgttattagtgtcttaccttttaaaaatacttgtcatattcagtttttaagatttattaacattgtctttttaaaaattattattaagagatgctgtctagccctgtcatcccttctctctaaatcctccctggatgtagtcactgttcatatttagcatgtcttctagacatttttcttaacatacgtaagcatgtatctcctgcatcttgggtatcacttgtgtgtctagtgcagtgccgaatgcatagtaggtgttcggtaaatgttaatggaatggctaaaatattttgtgcagtattaatgcttgctgttattttgaccagaaaggctcagttccctgttttctcttcctaacattttagcaagaacagtgatgaaatcaacatacctcgactcattgtcagtcaactaaaatggcttgacagagttgtggatggcaaggtaggcttatggactttatctcttgaatttaaagagtatgtttctcatatcttttggaggttgtatttttttttctttctaaacagaaaattcatacttttccatccatccattagctttttccaattttcataatttgagaatcatagatacttcaccctttaaatttcagaaaagtttaaatacgaagagtagatatcatttattaaataaattaaatatttgggaagattctttttcaaagtacagagataaatgactgtgtttatttctcaaataatttcagctctgcatttcacacgtaggtagtctttctttattctgggtaatgtgctgcagttctaatagtgtcttctactgcaggacctcaccaccaagatcatgcagctgatcagtattgctccagagaacctgcagcatgacatcatcaccagcctacctgagatcctaggggattcccagcacgctgatgtggggaaagaactcaggtggataaaccctctgtcatcatctaagtgaggctcagctatgggggttctatcactgcagtatgcaaagagcagtagtaatatggtctcttctatctaaaaagaggatgataccccccttcatgagtagggtatgggatttgacttaaaaaaaaaaggtatatatttgaatagatccacatactttctttttttttttttttttttctgagacagtcttgctctgtcgcccaggctggagtgcagtggtgcgatctcagctcactgcaacctccgcctcctgggttcaccccattctcctgcctcagcctcccaagtagctgggactagaggcacctgctaccatgcccgactaatttttttggtatttttagtagagacggggtttcaccatgttagccaggatggtctcgatctcctgaccttgtgatccgccctcctcggcctcccagagtgctgggattacaggcatgagccaccgtgcctggccccatgtactttcttttaaatggtatacctgttatgagcgtgaagtctggcttaggattagatatctaaatttggccagtggagaagttgaccatgatcccttaagtttcattaacttgttcttcagggggtccttaaccctggctgcacattaaaatcatttgtggagcctattaaacatctaccttctttgggttcctaggtgattcattctaatgcacagtcctgcatcagaccgcttgcggagacccattgcttactgtcattcatttgaaaaatagtaattggtagggaagtattgaagaaggggagaacaatatccctaggtaataaagtttccatcttaatgcaactttttattgtactagaagtattttttttaaattcagtttgtaatacttccttttgtatagttgtctgcaaagctacctccaaaacatccagtgatttcttgccctcatccttttgggcaggatgctccttctgggcaaagtactacgccatccactttacctgcctgatgccagctcatctccttttgtatagtctttttttttttttagcatctgtcaccgtctgttgggcgcagtggctcatgcctttaatcccagcatgttgggcggctgaagtgggtgggtcacttgagcccaggagtttgagaccagcctggacaacatggtgaaaagccgtctttcaaaaacatacaaaaattaggtgggcgtggtggtacgcacttataattctagctactcaggaggctgagatgggaggatcaattgagcgtggaaggtcgaagctacagtgagctgtgatgacaccactgtaactgtactcaagcctgggcatcagagtaagaccctgtctcaaaaaacaaacaaacaaaaaaaaaagcaatctatcactgtccttctcactatgttgtgctcctgtagcaccacctacatgtgtctctcatacttatcagatttcattgtaaatgttttgggttttctttttcctttttgcggggaaggatacataccaaactaaatagtggtgttctctgggtagtggggattgtgatggaaggcttcttgtttctacttttattatttgaatttttataatgagcatgtattattttttgcagtcaaaacaatttttaaagaaacatactataaacggtaacttaatggcaactaagtatgtcctttattttcatactctaataaatgattttctcaagtcattgtctgcccagctctgttcaaaccattatacaacttttttctttttctaccattcacagtgacctactgatagagaatacttcactcactgtcccaatcctggatgtcctttcaagcctccgacttgacccaaacttcctattgaaggtagaaaagactcagctttccagaaacagagccagctttccaacctcccagaacaagtgtcagtcagtcattgccttgggagtaatgaatatttcattttgaaaccatagtgaatcacatttgatatctctctttttttttttttttcccctcaatgagtttcagatgctattctatggtagagtcacaggtctgtttttttttttgagacggagtatcactctgtcacccaggctggagtgcagtggtgcaatctccgctaactgcaacctctacctaccaagttcaagcagttccctgactcagcctcccaagtagctggggttacaggcacctgccaccactcccggctaatttttgtatttttagtagagacggggtttcaccatattgtccaggctggtcttgaactccggaccttgttttccacccccctcggcctcccaaagtgctgggattacaggcttgagccaccgtgcctggcccacaggtctgtttttaagcagtaagttttgagtggaaatcttccatgttgtctgagtcatacctgcttcccataggaataatactttttatgccttactgtagccagttgagaatttaggctctaaatgtaagataatagctctgtttcacatttattgcccgtctatttttgatgaagctgtggtattaacaactaaaagattctaatttggggaaaaatctaaaattttgtttttccctaaattataagtgggaagatggagtaagagaagtgatttttttctaattttatctaacagttcagtacaaagttgaggtagtgacatgaaaacctattaagtttctgtgcttttaatttttaggttcgccagttggtgatggataagttgtcgtctattagattggaggatttacctgtgataataaagttcattcttcattccgtaacagccatggatacacttgaggtatgctcttatatcccatcacacctagataaagcaacttaagtgccaattgctcttctctgtccccagactaactgagaatactgactaatccggatagcattcagaggagagaatggagctattcaacagattcattgatctatataagctgctataagttacatttactcttcctgtgtagtacctcacagaattctgaaattttgggtatgatgttctatgacattgcattggctattctcataactctatttttcaaaatgtccaacatttaaatttttttcttcctcagtctttcaggagattgtcatggtagagagactggactgtgcctacccactatgaatgagcagaaaaccatagctaatatttactttctgcaggtaatttctgagcttcgggagaagttggatctgcagcattgtgttttgccatcacggttacaggcttcccaagtaaagttgaaaagtaaaggacgagcaaggtaaagagctcatcctcacacaggatgtcacaattttctgacatcccactgtcagagttagagcttaatactactacaaataatgatactattatgacatttacatctagtattatattgtttttcaaattacatatatgtatgtgagtatgtatgtgtttatatattttcttagccattcagatcaatcccagacagacgacagtgcaagtttattagccatcttatacatgaggttgtcatttgctccagggtacatggcaggaactccgatcttgtaagttcttttctggtacgtagaagagtaatttttttcctctctgctacttgtagttcctcaggaaatcaagaaagcagcggtcagagctgtattattctcctctttgatgtaataaagtcagctattagatatgagaaaaccatttcagaagcctggattaaggtgagatctttggaactttgattatcaaggaggaaatgagtggcaattagtgacagatgtataactgaggtagactgaaataaaaatctcaaaactcattcaagtggaaatgatagctgatggttgccagatggacacattggctcttagatgagataacagggcatgctgaataaggtgtaacgtgtttcgctgatgtgtcataatatttttgtgactctctcctgttttttcaggcaattgaaaacactgcctcagtatctgaacacaaggtaatgttcatgtactatgcattttcagtattgcagacttaaaagtaatgacattggctagcttgccttcccactgtctttctttctcccccctccagtcactcttctctctcttccctagttgctctaataaacattagctgtctggggaagataatctgaggtggcgactggccagatagcctgcccctactcactctggctataaaataagcctacagtatccacaaggggaaatactaacagtgtaaacaagcacatcaaggtgcagtcaaagaagccaggtccccactgatgagatgaagaaaataaccacctaagtctcaggtccctgtatctgcctaattgcccttccttccactcagcaccactgtcaagataatggcattccatgttttactttactttgctcatgtagacctgactagagtaaatcaatctgtccactgtcaaggcagtggtactggatcttatgtctctattaattctagaaataccttccatcaaaaagccagatgattggccgggcgcggtagctcacgcctataatcccagcactttgggaggctgaggcaggcggatcatctgaggtcaggagtttgagaccagcctggccaatgtagcgaaaccccgtctctactaaaaatacaaaaaaaattagcctggcctggtggcacacgccactgcactccagcctgggcgacagtgcaagactccatctcaaaagataaaaagccggatgattgagttccttaggtgctgattggttgcctttaaagatttttctttggttggaatctgttttgtgggatttttgttagttttgttatccaattttgggatgattatcttaaaagctttcatgatgctgaataaagcaatgaaaattcagaattttttctggtgaaaaatatcaaagtactccaacacactgtttttggttttggataaacataaatttaccaccttggctgcctgcatacctatttttacatatttgtaatcattgtataaatataatttgtattcttacttttttttcttaacattttttctcctgtcataaatatttcaaggtctgcattgtcttcattgttatctttaatgactgtattctggtctaataactcagttttggtgtcctaagaagtggagcattcagttaagataagtagtaaaattttttttgttttttcttgtttgtcctgcttgcctttttaactgtttttttttttttcctggaagcatagactcaggttgccctgaatacacgcccaatgttttctctttttttgttttgttttgtttttgtttttgtttttgagacgggttctcactctgtcacctaggctggactgcactggcgtgatctcggctcactgcaagctccgcctcctgggttcacgccattctcccgcttcagcctcccaagtagctgggactacaggcacctgccaccacgcccggctaattttttgtatttttagtggaaatggggcttcatcatgttagccaggatggtctcaatctcctgacctcatgatctgcccgcctcggcctcccaaagtgctgggattataggcgtgagccaccatgcctagcatggcttattcttcctgatgactgtgtaatattccaaaaattaaaattactccatcataatttattgaacctttcctgtattgatgtattgatgggcatttatagtctttccaacttttcacaaagtaattttccttttttttttttttttttgagacaaagtcttgctctgtcacctaggctcgagtgcagtggctcgatctcggctcactgcaacctctgtcacccgggttcaagcgattctcctgtctcagcttcccaagtaggtgggattacaggtgtgtgctactttgcccggctaatttgtgtatttttagtagagacagggtttcagcatcttggccaggctggtcttgaactcctgacgtcgtaatccacccatctcggcctcccaaagtgctgggattacaggcgtgagccaccgtgcctggcctagtaattttcctagtaatactgaaaatacatactgtagttggcaacaaatacacgctggagttggcaagtgattgaatctttcttttaataaatgtcaagatgttcagagttacttctgtagtaatatcactttcatgcatattgctctgtattctttttttttttttttgagaatggaatctcgctctctcacccaggctggagtgcagtggcgcgatctcggctcactgtaagctctgcctcccgggttcacgccattctcctgcctcagcctccccagcagctgggactataggtgcatgctgccacacccggctaattttttgtatttttagtagagacggggtttcaccgtgttagtcaggatggtctcgatctcctgaccttgtgatctgcccgccttggcctcccaaagtgctgggattacagatgtgagccactgtgcctggcctgctctgtattcttaaggggtatcaatggttaacagttgtggcactttatttatctgaaaaatatttctgagttttgtgaaaagtgtagatactcccaggggagtgtgtggaacaaatgagcattatccattctgtgttttaattagaggaaaagctgctgtttcattgtagcaaatgtactgatttgttaactgtttttctgttgttgcatatttattgacaataggtgtttgacctggtgatgcttttcatcatctatagcaccaatactcagacaaagaagtacattgacagggtgctaagaaataagattcgatcaggctgcattcaagaacagctgctccagagtacattctctgttcattacttagtaagtgtcagagactattgatttttaatctaaaacagaaagctttacagctctcatgtaaaatttcatcttatttcagtccattgttcaaacccattgagatttttgaattttgtttttgcattaatcattttaattgtctatctcaatgcagtttgcaactttgacaaactggccttccgtatcctatttaagtagcttataaaaaccttgaggggaataggaccagcctgtagaaactagtagaaatgtaaatatgtacctatttgaactatcactctttagccattcaaaactgtggactttaggtgataattcctctagaaatgtaaattattcaaagtggaattttataagctaggaatagtgttttgccagctgaacgttcaggatattagcagtatagaacttagaaaactggatgggccagtggtttggggtttgggttaggagctaatgagaatacctcgctgggtcttaaattttatatttaggaatagatttaacggttgtattattttatcttgcagttctttctgtgtttatttctgccaattatacatgttttgggctgtaattttctagatgcagaaaccacatgtaatttttcattgcattttccccaataaagcattatacccagcttagtactaaatataagatttttaaaaattatggtatcaataaggaagctatgtttattaactggttatttagtctgggtccattaatgtctatgtacattgaattattggtaggttatgatcacttctcttcttgatcttcttttaaaaaaatcagcttagttagcattgaaccttatagacctacttcaaattataaccaaggtggaacatccctgggggtagtatgattgcatggggaaactgggatttagaacatctggcctccaatcccaaattgagcagataggaatgttctattaggcttgtaatttaacttctttgagcttaaaagtcaattattatccaaacgtggaatcccattgatgctgagagtaatctcagaatgatgaaggattatttttgtgtaaaacaaagattaagatttcctaagttaaaatgagagctagggaggagaagtctgacattccaaaaggataagcaactcttaggttgtgtactaactgtttcctacagcttcttttctctctctactcttccccactcaaggttcttaaggatatgtgttcatccattctgtcgctggctcagagtttgcttcactctctagaccagagtataatttcatttggcagtctcctatacaaatatgcatttaagttttttgacacgtactgccagcaggtatgttgaaacatttattttggcaaggagggaacacagaaagggaaaataatctgatgtttatttcttgttggttggaactcactgaaggggaaggaactctgacctgggtctcaagaaagctcaattctagtcccagccttgatgaaaggaagagacttgactggtggctctaactctgtgttctgagctctaaaattctctgtctgaaattaagatccagatctagtccatttcaaaacatgagacacttttttttgttttgttttgagacgtggttttgctcttcatgcccaggctggagtgcagtggtgctatctcagctcactgcaaccttcacctcctgggttcaagcgattctcctgtctcagcttcctaagtagctgtgattacaggcacacaccaccacgcccggttaattttttgtatttttagtagacacagcgtttcaccatgttggccaggctggtctcgaactcctgacctcaggtgaaccgcctgcctcagcctctcaaagtgctgggattataggcgtgagccattgggcctggccgagacacattttaatagcatatatccagagagggaggactgtatttgtggaaaatgtttatgaaagcaagtaaagaacagtgtcttattttgtatttttacatatattcttcctgtcattaacaatgttaaaacgcatttgaatggaacttttaaaatgaagatttgtaaaaaaattttaaacatttaaagtagagcaatagttgcagctgacatgaggtagctgttgcagttgaaaatgtaattctgttatgactattatggagtgacagtataaagggagaatggcatctaagacatttctggaccctcttaatgtcttagagacactgtcataatccatgtttgcttggaaacatgcaagtctagcctgtactatatggagaaaacctttaaagcttttagctccttgagtgccatctttttgaggaatttcaactgatcttgtacaacctcaacctaaagggtaaaatttaacccatatgggaaaaagaaagaggaaaactacgccaaggagcaaaatcaggagggcttaggtagagctcactgataaaatatgggaaataggtcaagatgggatggtcaagttacactggcatattcctaaatctcctgaagccaacattaatgaaaactagataataggtgatgggtttgggttgattgtgattttaacaaagtagagattggagaggccttgggggtgaatccctttagaatggccatccatattttgttttacactgttctgttgactctcccctgtataggaagtggttggtgccttagtgacccatatctgcagtgggaatgaagctgaagttgatactgccttagatgtccttctagagttggtagtgttaaacccatctgctatgatgatgaatgctgtctttgtaaaggtatcttattggcttcttgtactttagatattgaatactataattggtgggaggtggtgggaaggaggtgagatgatgggcaagtaatataaataaaaagtgactattctatctatgtgttaattcattcagcaaacacttctttatacctaacctacaggctaatctctattctgggtgctgtgaatgtaaagtaggcccttacctttcatgttaaagactaagacacataagcaagtcactataaatacaacatggtgaattctctggtaaagtactatagatataacagagtaagaataattaaatttagcctgggaagctggagaattcttcaaagaggcaatgtgagtgattgctgaaggatgggaatgactgacaagagaaagtatgggaagtgcgttctaggcagagaagagtttgagcagaagcaaactggtgcccaagtcaatggtgtgactgaggaatgagaagcaaacaagcatgactggagaataggatatatatggagaggaatgattggaggcaaggctggtaagacataggacaggcccatgttgcaaagagtctcaaataacatgctaaagagtttcaactttattttttagacaataaggagctattactagtttttacatacagttgacctaatctactcagcattgagagataactcagtaggctatatgatgggtggattggagactgctgaaatggtctaagggagtgagagtaagggccagattttggtcacgggaatgtagaagaaattatggcttaagagacaatttggtgttagaattaacatgacttggtgactgttaagaatatgtggcggtccgggtgcggtggctcatgcttgtaatcccagcactttgggaggccaaggcgggcaaatcacgaggtcaggagatcaagaccatcctgcctaacacggtgaaaccccgtctctactaaaaatacaaaaattagccgggcatcgtggcggtcgcctgtagtcccagctactcaagaggctgaggcaggagaatggcgtgaacccaggaggcggagcttgcagtgagccaagataacaccactgcactccagtctgggcgacagagcaagactctgtctcaaaaaaaaaaaaaaaaaaaaaggcttagaagagcacagacattttgagaaggttaaagtttaagtggcagatgaaagcaaatgtccatagaaggaaaatgagaaacctggaagattaataatgtgagcttaaaggatgtcaggtagcaaaagcccaggaatgagtttcaagagtgagggattggccgggcacagtgactcatgcttgtaataccagcactttgggaggccgaggcggacggatcacctgaggttgggagttcgaatcagcctgaccaacatggagaaagccctcctctactaaaaatacaaaaattacctgggcattgtggtgcatgcctgtaatcccagctactcgggaggctgaggcaggagaatcacttgaacccaggaggtggaggttgcagtgagctgagatcatgccatcacactccagcctaggcgagaagagcgaaactgtcaaaaaaaaaagagtgaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaaattagccgggcgtagtggtgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaaaaaaaacaaaaaggagtgagggatttatctcccagtgttggacactgaaaaagttgaagatggaggcagaggctattggctttggcaattaggatacctctggtaacctctgagagaacagtgttaattgaattataagggtggaagccagagagcagtaacttgaagacttggggaatagagtcaatgtcgagaagcatcaaggaggagagaataaaaaaagtagcttgagaaagaagctggttgtgagggagatattttttagatgaggaggtttgagattgcttgtaggctgagagaaaggattcaatagagaggaagaaatggagatttttaaaaattaattaaaagtttacaaagctgttttattactttttcctcagacaaaccatgaaaggtagtatagctattattatcaccatgttatagatgagaaaagctgaggcatttcccaaggtcacaaagtaaatagtttccttgtgactccttccagatctgtagagaaaggagaaataattcattgagtagaagctgggaagggatgatatggcaaggaatagggtaaagacataacttttggtagaatattgttttcactgaaaaaaaagggaaaggtggaggtaaagaataccgagaactgggaggtgcattagaatgactaagcagtagatgattaaagcccaggattgtggttcagagtgaagaggataaagaaaactttatgtttcctgatagttagttcctagtctctgataataagagatttagaaagttgtaagaattttcccagtttatatccagtctatcaaacctttgggctctgagcatagcttttagaacttgagctttgagcttttaagggagctaaaaagttttagatacctggctatctatgtgtgtctcttttacagggattttaattttttgaattttaagggaaaaatgttagctgctagcctcattgttggcatcattttttccacagggcattttagattatctggataacatatcccctcagcaaatacgaaaactcttctatgttctcagcacactggcatttagcaaacagaatgaagccagcagccacatccaggtaagaggcaatatgttgggaaagatttttttttttttgagacagagtctagctctgtctcctagactggagtgcagttggcacgatctcagctcattgcaacctctgcctcctgggttcaagcgattctcctgcctcagcctcccaagtggctgggactacaggcacgtgccaccatacccagctaatttttgtattctccatcaaaaagtgggcgaaggacatgaacagacacttctcaaaagaagacatttatgcagccaaaaaacacatgaaaaagtgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccgcacaccgcatattctcagtcataggtgggaattgaacagtgagaacacatgggcacaggaaggggaacatcacactctggggactttgtggggtggggggaggcgggagggatagcattgggagatacacctaatgctagatgacgagttagtgggtgcagcacaccagcatggcacatgtatacatatgtaactaacctgcacattgtgcacatgtaccctaaaacttacagtataataataataaaaataaaataaaatagaataaaattaaaaaaaatttttttgtattctcagtattttgtattaattttaaacctcttgaaatttgctagaaaaaaaaaaacaagcaaatgatagatttcctagtgtgtagtagtggaaatggagtacatagccatagtactagcatttttttttcttaccacaaacattaagtgcctattctgtgccaggcactgatatattagatcctctgccctcaaaaagctttgtctgttagggtagagatgggtctgtgatcagctaaccatgaaactgttcagtttctgagtgcagtggggacacagaattgccttgttttctaagaaacatctccatctaatgtgaacttcacgtgggcttgcttttgtttgtgggcgccattcactgaaaaagccaggctgtaatcccagcactttgggaggccaaggcaggcgaatcacatgtgccctggagtttgagaccagcctgggcaccatggtgaaaccccatctctacaaaaacatagaaaaattagccaggtgtggtggcacacacctgtaatcctagctactcaggaggcggaggtgggaggatccattgagcccaggaagttgaggctacagtaagccatgtttgtgccactgcactccagccagggcaacagagtgagactctatctcaaaataaataaataaataaataaaacgaagagattagattggaatcataacttgtaactcgtttgtagctttagtgctaccttatggcagtaattcatactggactgtgactttgaacaaccagcatatatatatatatacgtatatatatatatacgtgtatatacatatatatatgtatatacgtatatgtatatacgtatatacatatatacatgtatatacatgtatatacatatatatatatatatatatatatatattttttttttttttttttttttttttttgagatggagtctcgcactgtcacccaggctggagtgcagtggcgcaatctcggctccctgcaaactccgcctcccaggttcccgccattctcctgcttcagcctcccaagtagctgggactacaggcgcccgccaccacgcccggctaattttttgtatttttagtagagttggggtttcaccgtgttagccaggatggtcttgatctcctgacctcatgatccgccagcctcggcctcccaaagtgctgggattacaggcctgagccaccgcacccggccacaaccatcatattttttatctttttttccccccctttcttggatccccagtcagcacattttttttaattaaaaaaaaaacttttggactaggtaatatacatgtgtcatacaaaattcaaaacatatagaagagtattcagtgaaaaataactctcacttctcagttctgtaggcacctggtttgtctcccacaggggcaatcactttataagcttctgagatgttctgagaatttacaaatttgtgtttacctgtagtttcctttcccttcttgttctacatcttagcttttgcatttagcagtttattttggagattgcttcaaatcagcaatataaaactacttcactattttattttatttttgaattttgataaaatatacataatataaaatagaccgtttaagctgtttttaagggtacaatttagtagcattaagtatattcacaatgttatacaaccattgccactatccatttctagaacttcctgatcatcccaaacaaactttgtacccattaggcaataatttgccatcttcctctccccaccccctaataatcactaatcacattctgtctatggatttgttcattctagatgcctcatataaatggaatcatacgatatgtatccttttgcgtctcgcttatttcacttagcataatattttcaaggttcatgtaggttgtagcatgcatcagaactttattcccattacagctataataattccattcttggccgggcacggtgactcacgcctgtaatcccagcactttgggaggctgaggcgggcagatcatgaggtcaggagatcgagaccatcctggctaacacggtgaaaccccgtctttactaaaaatacaaaaaattagctggacgtggtggcaggcgcctatagtcccagctacttgggaagctgaagcaggggaatggcgtgaacccgggatacggagcttgcagtgagccgagatcgcatcactgcactccagcctgggagacagagcgagactctgtctcaaaaaaaaaataataataaataaataaataaataaataattccattctttgtttttgttgttgttgtgttttattttgttttgttgagatggagtctcactctgtcgcccaggcttgagtgcaatggcacaatcttggcttaccgcaacctctgcctcctgggttcaagcagttctcttgcctcagcctcctgagtagctgggattataggcacgcaccaccactcccggctgatttttgtatttttagtagagatgggattttgccatgttggccaggctggtcttgaactcctcacctcaggtgatccgcctgcctcggcctcccaaagtgctaggactacaggcgtgagccactgcgcccggcccccattctttgtttataccacattttgtttatccattcatccattgatggacacttgggttgtttccaccttttggccatttgaataatgttgctgtgaccattggtttacaaatatttgtttgagtccctgttttcagttttttagggtgtatatctaagagtggaattgctggatcatatgatgaccatatgtttaccattttgaggaaccaccaaactgctttccatagcagctgcataattttacattcccaccaacaatgtatgtaggttccaatttctccatatccttgccaacatgtattttcctttcttaaaaatttcttttgatttttattaattaattaatttaaaaattattattatttttagatagggtcttattctgttacccaagctgcagtgcagtggcgtgatcatacttcactgcagcctggaaatcctgtgcttaagcagtcttcccacctcagcctcctgagtacctgggactacaggtacctgccacctccccaggccctattttttaactataatcattctgatgagtgcgagtggtatctcattgtggtttgatttgcattttctaatgactaatgatgttaagcatcttttcatgtacttcttggccatttctatatttttgtagaaatgtctattcaagtcctttacccatttttgtttgttttgtttttgagatggggtctcactctgtcacacacattggagtacagtggtgttatcttggcttactgcaacctccacctcccaggctcaagcgatcctcccatgtcagcctcctgagtagctgggaccataggtgtgcaccaccatgcccagctaattttttataattttggtagacattatgttttgtcatgttacccagactggtttggaacgcttgagctcaggagatccacccacctctgcctcccaaagtgctggcattacaggcatgagccaccgtgctcagccctttgcccatttttaaattaggtttttgtcgttttgaggtatgggagttatttatatattctggatattgatcccttatcagatatatgatttgcaaatattttctcccattctatgggttttcactcccttgatagtgtcctttgatgcactaaagtatttagtttcaataaagtcaaatttatctatttctttttctttttctttctttctttcttttttttttttgagatggagtctcactctgtcactaggctggagtgcagtggcacaatctcagctcactccaacctccgcctcccaggttcaagtgattctcctgcctcagcctcccgtgtagctgggactaggggcatgcaccacaacgcccagttaatttttgtatttttagtagagacggggtttcaccatgttggccaggatgatctcaatctcttaacctcatgatctgcctgtctcagcccctcaaagtgctgtgattacaggcatgagctactgctcccggcctccattaagttttaagatggcactcaccatctttgtgaaaagttgaacattactaacaaagtctaatcatatctttagaaggggtaaacagtgataccatttactgaattggaattactattaaaattaaaaaaaacagcatattcatttaaccacaaaccagtcttagttttaaatgaggaccacccaacaagatattctgtcagtcattcatgatctgaattctggtgtatgagatctattaaagtatggtacacataaaaaagtcatgagatatttgttttgtaataaataaggcagtgaccaattattactcattagtagcttttttgagttaagctatcaagtttgccctttctgccttcttaattccggcaaagatcatttttcttccagggatgtacttcttgggattctccaaatactccatcagtgtatcctctccccaggtgatgcctttgttcttattggtgtctgtgtaagagaatccagtggcctgacctgtcttccgcacgaagagaccgtggagattaggcccactcttgtgcttgtctcccttttccaccgtgtggcactgggcacacttctgaacaaaaatcttcttacctttctcagcatcacccatatataattctgtttttcatcgctggcaccacgaaggttgccactccaaagctgtacgacccactctctatcaattttttttcttgtgtttcttgtccttttggttgtcatgcttaagataccattgccgaatccaaggtcatgaaagttttcttttattttcttctaagagaaggttttagctcttaaatttaggtctttgatccactttgtgttaatttttgtatatagcttattttaatattttaaggatttaacgtcattcttttgcacatggatatccagtttttccagtgccaatttgttgagaagatggtcctttcaccattgaaattactttggcacccttgtcaaaaatcaatttgtcacatatatgaaggcttatctttgaactctgtattctatttcattggtctatacgtctgtccttctgccatcaccacactgttttgactgctgtagctttgtattaatattgaaatcaggaagtgtgggccctccaactttgttctttttcaaggttttggcagtttggggtcccttgaaattccatgtgaattttggtatggatctttctgtttctgcaaaacatgttgtgggactttgataaggattgcactgaatcactttgaatggtattagcaatattaagtgtcttccaatccatgaagacagtagctctttccatttccttatgtctttaatgtttttcagcaatgtttattttattattttattttattttgagacaatgtctggctctgtcacccaggctagagtacagtgatgtgatcctggctcactgtgttcttgacttcccaggctcaggtgatcctcccaccccagccttccgagtagccaggaccacaggcatgcaccaccacagctggctaatttttgtattttctatagagatgaggttttgccatgttacccaggctggtcttgaactcctgggttcaagcagtccagcagcctcagcctcccaaagtgttaggatgacaggtatgagctacttcgcccagccttgcctccatgtttaaatctttacctgagtattttattctagttcattattttggctgagcagtgatcaacattatgataattttcatatccttatagaaataataacaataaaagatattattattgaatgtctatcatgtgctaggcactgttctagaagttttttataatgtatcgctaatccttaaaacaaccttctccatttcgggccaggcacgtaatcacccctgtaatcccagcactttgggaggccaagacaggcggatcacgaggtcaggagatcgagaccatcctggctaacatggtgaaaccccgtctctactaaaaatacaaaaaattatccgggcgtggttggtggcgggcacctgtagtcccagctacttgggaggctgaggcaggagaatggcatgaagccgggaggtggagctagcagtgagccaagatggcgccactgcactctagcctgggtgacagagcgagactccttctcaaagaaaaaaaaaaaaagtccccatttcacagatgtaaaaattaaaacttggagagatgaattgacttgctaaagacacacagggctgggtatggtggttcacacctgtaatcccagcattttggaaggccaaggctggtggatcacctgaggtcaggagttcaccagcctagccaacatggtgaaaccccatctctactaaaaatacaaaataagccgggcatggtggcgggtgcctgtaatcccagttacccaggaggctgaggcaggagaatcgtttgaacctgggaggcagaggttgcagtgagccgagattgcccctttgcactctagcctaggcaacaagaacgaaagtccgtctcaaaaaaaaaaaaaaacagttagtaaacggtaaacgcctttatagtctagctatatggctcgatatccataccttcttttgctgtgccattccagcattttcatctttcttcatcatctcattgcaggatgacatgcacttggtgataagaaagcagctctctagcaccgtattcaagtacaagctcattgggattattggtgctgtgaccatggctggcatcatggcggcagacaggtacacgtggagattctgacttctgtggtttaagatcagttaatcttgctaactaagtgttacatctcatagacatcattttagcagtagaagttacaactataaatgagcaaatgtgttttgctacttttccatgttcccttctaatcgtgactgtatatattaccatgtatatgttttgctggaatgtgatcctagccattacagtctgtggttaaaaattaaggattggctagaggtaaaattctagaaatctttgcacaaaatgggaaccctgattcttttagaatgcatttttctttatctgctcctgatataggcactagacaatgcaggtgtctacattgctgtgtcattcctgtcgggaactttatacatttgatacaaataagatcttgtgtatttcccctcaccttgttccttgaggccccatttgtagaatctaaagaaatatcggtttgggggcttgataagatgttgccattacaaaccgacattggatttcagttcatgctccttggaatttattttctgagacatcaggagacatctttagaatccacattgtggaatcctaattagggaaaaggagtcacaatggtgggagcaaagaaagcaaagacaaagtatgtaagtctgccttttttcatggtgcaggacatgcagccctcctgcgcccaacttaatcaccagacacctgcaagttagctcactgcaactttggcattatcagtactgcacaaagccctcttcggcatacagcatacatcataaatactactctagaaatccccagcaagccgttgtttccttgcagtcagctcctctattgctggctgcccagtgctttcttgcaacgtacttttatactttctctaagaaatctgcctttctttacctacaactgtcttagtaaattctccctctaaccccaccccaaccgccaccggctcagatagtcatcactcccctgtgacacacattaataatgggaagaggttgcagagtgtgcaactctagttaagagttcagtcagtgaagccatactggttgcccagggtcagattctggctccattgtttattagctgaattaccttgggtaagttactttatctctctgcctttgtagactcacatcagcaataaggataataataggatttacctcatagagtcattgagaacattaaagggttagaacaatgtttagtacataatatgcactaattaagtgcttcctctaattattgctaatttgcccttaaaaaatatgtacgaaaaagaaaaaagaaaaaaatatataggataaccatcctttgctctaatctgtattttgtatggacaaaataaatactcttcgctgccttcatgcacttttatctttaccctaccctagggaagtcagaattcttaaacttattggcagttgttacaaaatattacaaaagtgaaattaaaattctgtgtttttaccaaacaccgcatgttctcactcataggtggtaattgaacaatgagaacacatggacacaggaaagggaacatcacacaccggggaatgttgtggggtgggggaggggggagggatagcattaggagatatacttaatgctaaatgacgagttaatgggtgcagcacaccaacatggcacatgtatacatatgtaacaaacctgcacgttgtgcacatgtaccctaaaacttaaagtataataataatttaaaaaaaaattctttgtttttagaagtgaatcacctagtttgacccaagagagagccaacctgagcgatgagcagtgcacacaggtgagttctttttttcctttctttctttttcctgtcttttttttttttttagagagtctcgctctgtcacccaacctgcagtgcagtggcaagatctcggctcactgcaacctccacctctcaggttcaagtgattctcctgcctcagcctccagagtagctgggattacaggcacgcaccaccacacccggctaattttttatgtttttggtagagacgaggtttcaccatgttggccccgctggtcctgaactcctgaactcaagtgatccacctgcctcggcctcccaaagtgctgggagtacaggcgtgagccacctcgcccggccgagttcttataatgtgattggatatgtttatgagtaactgaagaattgcttctagtcactgtcagttcaccagaaagtgcttcttttgtaaaagaagttttcctgaactcctacttctgtggttttctgacacttggaaactactggcttgggtagcatttatttttatgtttatttatttatttttagatggagtctcaactctgtcgccaaggctggagtgcggtggtgcttcccgggttcaagcaattctcctgcctcagcctcccaagtagctgggatcacaggcatgcaccaccatgcccagttaaatttgtatttttagtagagacggggtttcaccatgttggggtttcgctatgttgaccaggctggtctcaaactcctgatctcaggtgatctgcccccatcagcctcccaaagcactgggattacagatgtgagccaccactcccaggccagttgcatttatttctatatccatttaatctctctaattaaattataaagtcttagcaagaaagatatgccatgtttatggaataacactttggttgaagcatggggacaaataagtacataattggaaagtgggacataaagctagttcaggcagggcacggtggtttgcgattgtaatcctagcactttgggagaccaaggcaggaggatcacttgaggtcaggagtttgagaccagcctggccaacatggtgaaatcccatctctaataaaagtacaaaaaaattagctggacatggtggcaggcgcctgtagtcccagctactcaggaggctggggcaagagaattgcttgaatccgggaagtggaggttgcagtgagccgagatcacactactatactccagcctggacgacagagcaaggctccatctcaaaagaaaaaaagaaaaagctatttgagagagaaaacagagagccttgcatgtaaagcaatacatttttatttcattctttaggcagaggtattccttaagggtttcttagcatggaaatggcaaaatcaaaggtttactttagaaaaattaatctggctgcagtgtctggcagattggaaaagggatgatatcagaaggagacagacgggtcagaacattcaggaaaacttcaagtgagacatagagctttgccagtaaaatcagaaagtgaaaaaacagtcttgaaaggggcgagtggagtttgggaaagattggcagcccaaggtttaaaccattcttcctctttgctccaggtgacctccttgttgcagttggttcattcctgcagtgagcagtctcctcaggcctctgcactttactatgatgaatttgccaacctgatccaacatgaaaagctggatccaaaagccctggtaaagccaattgtcttttcttaaagcaataaagcatgagagctgctttactacactcttcaagtctttctgttgcagtgtgaaaatagatcatcctgtgacctctcctaaattctaactgggaaaggcttttctgccctaccctgtctcacggctcttctctgagggctccttcacttaataacaatcacgatagtaaagaagagattgactttgttaatgatgatggctattatctgtctgagagccctattctgtgctgggccttgtgctaagtgctttttatgcactctctcttttctacttcacaatagtgagatatttattattactttctttttagaaatgagggaactgagacttagaaaggttaagagtaatttatctagggctgtacagcaagtacactctgcactgccctttttgtttgtttgcttcctgaaggaatgggttgggcataccatctgtaatgatttccaggatgccttcgtagtggactcctgtgttgttccggaagggtaggtattgtttacctgctggcttggttgcactggtgaagttacatcaattctgtcagtagctgatacaaacttcagaatacccttcacctcagccacagctgcccagtcccacagcttctttcctcccaaccccagcacccctgcacccttagctccaaaattcctaaaaggttcactgtttgttcttctaatttctccccatgatgttgtgtttgaaattggtttgctctagtggttttccctgtagccttgcgtattcctgagctgcaacatcagattctggtttttctccgcagtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaagtcagtatagtttttcttttctaaacctgttagtgttttgaatgttcatggggaattccacagctcttggtggggaagttgagtcaaaaaagtttctctcgagacaaatggtatttggagaggttagggagaatggggcagattccttgttttttcttggatccttggcttgagatttatattgccttgtgtgagccaacagatattctgagattactttctggccaacgtggcgaaacactgtctctactaaaaatacaaaaattagccgggcagtgtggcatgcacctataatcccagctactcaggaggctgaggcaggataattgcttgaacctgggaggcagaggttgcagtgagctgagatcgtgccactgcactccagactgggcgacagagcaagactctgtctcaaaaaaagaagttgtgttccctatgtatgtggagtaatatctccctatgtacgtggagtaatacacctatgaagtgtggtctagaaatttatttctccttctcagattggtgtctccgctgtgcctggctccgtatttccggttactgagactttgtgtggagagacagcataacggaaacttggaggagattgatggtctactaggtatgggatgaagtcatcagatcctttcttctttatactcttcctttggtaaacttagggaaagggcagatcaatacatggtgtatgtggggaggaattttctaacttcagcagaatagtttatcattggaattccaaagacaaaatagtacatacagaatcccattatgttaacaaatcaattgttgcaaaaactttctagttatatttgttgattgctatatgatatgcaaatattttaatcagatcttggccttcaaatatgagttaaaggggaaagtaaatagcaaggacagctagctccagaggcaacctccaggttttattggcttgcactaaaggtagttggaaatgtttgttctctctcagattgtcctatattcctaactgacctggagcctggagagaagttggagtccatgtctgctaaagagcgttcattcatgtgttctctcatatttcttactctcaactggttccgagaggtgagcagagttaataggatgtttcacttattgtgcatagtttttctcaaaactattttcttagttcccacaagactccctagaagtcttcaccaagcactaacccccgtgtgcttctctagctgttatgtcccaccactccccagttatatgaacctccttaggtagccaaatgagaatacttagaattcacttcacattgcccatgctttattttctccaagctgccttctccctagaatgaccttctcaccttcactgtggaactactgttcgtcctggcacaggcatatgcctactgttttgattcagtgagtggtggtagtttccctcccattagaatgtatttgtgtttggtgataatgacaatgatggcaacatcttatatctctacctcactgtcttcctctctgatattatttcaggaatgtttgtgcacttgaatgagcttatttgattaccacatctctattatgatacgggcaggatagctattgtcctcattttacacatacgaatttcaatagggagttcaaagtcattaaaaatttttaagtacttacactgtaccaagtgctggactcatttctttatgaagaaatacttagaaaggttaaagactcagccaaggtcacacagtaagtagcagtatagaacttgtttcaccaaattgtgtgctgtctggctattccaccttgtaacataactagtaataagtaaaactagggtcacaagcctaatctcctttgttttttgtttttttgagacagagtcttgctctgtcacccaggctggagtgcggtggctcaatctcggctcactgcaacctccgcctcccaggttcaggcaattctccttcttcagcctccctagtagctgggattacagatgtgtgccaccatgcccagctaatttttgtatttttggtagacatgggctttcaccatgttggccagactggtctcaaactcctggcctcaagtgatcctcctgcctcagcctcccaaagtgctgggattacagacatgagccaccacgcctggctgaatctcctatattttgggccagagattttttttctgtataccacgttgttgaggacagttctattacagactaaactcaaagatcttgcttttcatagacatctctcagctctggataaataatataaacaaggttaaaatctgaacatttggaagtatgagaatgtaatttgtactttgcagattgtaaatgccttctgccaggaaacatcacctgagatgaaggggaaggtgctcactcggttaaagcacattgtagaattgcaaataatcctggaaaagtacttggcaggtaagagaagtgtcctatactggtagtactactaggccagtagtgaggcaataaagcacttagctttccctgataccaaaaccagacaaagacacatcaaaaaaagaaatctcaggccaatatccctgatgaacattgatacaaaaatcctaacaaaatactagcaaacctaattcagcaacacattaaaaatatcagctgggcacgaggtggctcacgcctgtaatcctagcacttttggaagccaaggcgggtggatcacttgaggtcaggaattcgagaccagcctggccaacatggtgaaaccctgtttgtactaaacatacaaaaattagccaggcgtggttgtgggcacctgtaatcccaactacttgggaggctgagacaggagaatcgcttgaacctgggaggcggaggttgcagtgagccaagattgtgccactgcactccagcctgggtgacagagcgagactcccatctcaaaaacaaacaaaagaaagattattcatcatggccaaatgggatgatttatcccagggatgcaaggattgttcaacatatgtaaatcaatgtgatacctcctatcaacagaatgaaggacaaaaaccacatgatatttaaattgatgcttaaaaaaattttataaaattcaacatcctttcatcataaaaaaccctcagaaaactgggtatagatccatagctactattaaactgaacagaaaaaaactgaaagcctttcctctaagatctgaacaagacaaggatacccacttatataataccactattataaaatacagtattggaagtcctagctagaacaattagacaagagagagaaagaaagaaagggcatccaaattggaaaggaagatgttaaattatccttgtttgcagatgatatgatcttatatttggaaaagcctaaagactccaccaaaaaactattagataaattcagtaaagttgcaagatacaaaatcatcatataaaaatgagtagcatttctgtatgccaacaactaagaatctgaaaaaaatcaagaaagtaatccatttacaatagctacaaataaaataaacaaaagttacaaataaaataggaataagcttaaccaaagaagtgaaagagcactataatgagtactatgaaacattgatgcaagaaattaaagagcaaataaaaaaaggaaagatacttcatgttcatggatcggaagaattaatattgttaaaatttccatgctacccaacacaatctacagattcaaggcaatccctattaaaataccaatgacattcttcacagaaatagaaaaaaaaaaagcctaaaatttatatagaaccaccgaagacccagaatagccaaagctgtcctgagtaaaatgaatgaaactggaggaatcgcattacctgacttcaaattatactacagagctatagtaaccaaaacagcatggtgctggcacaaaaacagatgcatataccaatggaacagaagagagcccagaaataagtccatacacctacaatgaactcattctcagcaaaggtgccaagaatatacattggggaaagacactctcttcaataaatggtgttgggaaaactggatatccatatgcagaagaatgaaactagacccctatctcttgccatatacaaaaatcaaaatggattatagacttaaatctaagacttcaaattatgaaactactaacaacaacaacaaaaaacattcagaaaactcttcaggacattagagtgggcaaagatttcctgaggaataccctacaagcacaggcaaccaaagcaaaaatggacaaatgggatcacattaagttaaaaagttaagttcctttcctctgcatagcaaaggaaacaccaaagtgaagagacagcccacagaatgcgagaaaatatttgcaaactatgtatctgacaagggactaataactggaatatataaagataggaaaaaaaattattcggattgaaaaatgggtaaaaggtctgaatagacatttctcaaaagaagacatacaaatagtggatatgtgaaaaggtgctcaacatcactgagcctcagagaaatgcaaatcaaaactgccatgtgatgtcatctcaccctagttaagatgcctctccccctccccctccccctccccctctcccgtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtacttttttggtggagacggggtttcgctgtgttggccgggccggtctccagctcctaaccgcgagtgatccgctagcctcagcctcccgaggtgccgggattgcagacggagtctggttcactcagtgctcaatggtgcccaggctggagtgcagtagcgtgatctcggctcgctacaacctccacctcccagccacctgccttggcctcccaaagtgccgagattgcagcctctgcccggccgccaccccgtctgggaagtgaggagcgtctctgcctggccgcccatcgtctgggatgtgaggagcctctctgccaggctgcccagtctggaaagtgaggagcgtctctgcccggccgccatcccatctaggaagtgaggagcgtctctgcccggccacccatcgtctgagatgtggggagcgcctctgccccaccgccccgtctgggatgtgaggagcgcctctgcccggccgcgaccccgtctgggaggtgaggagcgtctctgcccggctgccccgtatgagaagtgaggagaccctccgcccggcaaccgccccgtctgagaagtgaggagcccctctgcccggcagccgccccatctgagaagtgaggagtccctccgcccggcagccaccctgtctgggaagtgaggagcgtctccgcccggcagccaccccgtccgggagggaggtgggggtcaggccccgccaggccagccgccccgtccgggagggaggtcagggggtcagccccccgcccggccagctgccccgtccgggaggtgaggggcgcctctgcccagccgcccctactgggaagtgaggagctcctctgccgggccagcctcccggtccgggagggaggtggggggggtcagccccctgtccggccagccgccccgtccgggaggtgaggggcgcctctgcccggccgcccctactgggaagtgaggagcccctctgcccggccaccaccccgtctgggaggtgtacccaacagctcattgagaacaggccgggatgacaatggcggttttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgcttgttaagaatcatcaccactccctaatctcaagtacccagggacacaaacactgcggaaggccgcagggtcctctgcctaggaaaaccagagacctttgttcacttgtttatctgccgaccttccctccactattgtcctatgaccctgccaaatccccctctgcgagaaacacccaagaatgatcgataaaaaaaaaaaaagaaaaaaagaaaaaaaaaaaaagatggcttttatccaaaggacaggcaataacagatgctggtgagaatatggagaaaagagaacctttgtacactgttggtgggaatgtcaattagtacaagcactatggagaacagtttggagtttcctcaaaaaactaaaaatagaatcaccatatgatccaggaatgccactggtaggtatatacccaaaagaaaggaaatcagtataccaaggagatatctgcactcccatgtttattgcagcactattcacaatagtcaagatttggaagcaacctaagtgtccatcagcgggtgaatggataaaatgtggtccgtatacacaatggagtactattcagccataaaaaacaatgagatcctgttgtttgcaacaatacagatggaactggaggacattatgttaagtgaaataggccaggcacaacatattttcacatatttgtgggagctgaaaattaaaataatttaactcatggagatagagtagaagtatggttaccagaggctggggagggtaatggtggttgggggactgggaaaaatgagggtggttaatagcttcaaaaatataattagatagaatgaataagatctagttgtttttgtatttttgagatggagtctcgctctgtcacccaggctggagtgcagtggcacagtctcggcttactgcgacctctgcctcctgggttcaagcaattctcctgcctcagcctcctgagtagccgggactagaagtgtgcaccaccacacccagctaatttttgtacttttggtgcagatggggtttcaccgtgttggccgggcttgtctcgaactcctgacctcaagtgatccaccttcctcggcctcccaaagtgctgggattacaggcatgagccagagagcccagccaagatctagtttttgatagcacaacagggtgactacagtcaacaataacttactgtacatttaaaaataactaaaatagtataattggattgtttgtaacacaaagaaatgataaatgcttgaggtgatggataccccatttaccctcatgtgattattatacattgtgtacctgtatcaaaatatctcatgtgcgccataaatatatatatacctttcccttttttttttttttttgagacagaggcttgctttgtcgcccaggctggagtgtggtggtgcgatctctgcttactacaacctctgcctcctgggttcaagcaattctcctgccacagcctcccaagtagctgggattacaggcgtctgccagcacacctggctcatttttgtatttttggtagagatagggtttcaccatgttggccaggctggtctcaaactcctgacctcaggtgatccgcgcgccttgacctcccaaagtgcttggggttacaggcgcgagccaccctgcctggccaccatttagattttaaatgtttgttttagtttttttctgtttgttagttatatatcattatttaaagtggttttatgataattgatcatacttaatatgatatttctgtgttatctctggccattttgctatgccaaaacaatgtcagatgacttgaatatgtcttataagcattcagccatgcttggtaattttggaaactagtttttagccaatggagtgactgaatttcaagtctaatggtggtgtgtaattggtacacattgagcttcagcctgctgtttgtttcagtcaccccagactatgtccctcctcttggaaactttgatgtggaaactttagatataacacctcatactgttactgctatttcagcaaaaatcagaaagaaaggaaaaataggtaagtatgttcttttcctcttgtcttgtgtctctaaataagcttcattgaattaacctaaaagttatgtgtatcatggcatcagtaattggaacaattgtataactgaactcttcctttattagatttataaatatactgtaatttagggttataaaattacctcttctacctctaggcagtttccaacaggttgttttctgagggcaatgatatttggcaaacatgattattaattacttgagtcacttttctctttttaatataaaagaaaggaaacaaaaaacagatggcagcaagacatcctcctctgacacactttcagaagagaaaaattcagaatgtgaccctacgccatctcatagaggccagctaaacaaggtattggaatgatgggtatccgtgaaggtttgtgacatcccagtgagattaacagaaacccagctttattctcggcattttacaaagaaaaaaaaattaggaaacagcgagccaaaactctcttaggcgttggagtaatctccttagtagcaaagttcagattagacttcaggtccttattcctgccacacactgttgactgttttttctaattattttcttgactgttttactcccttttttgtaccccagcagtacattgaattctctcttgaggtacttgattatcagtagttcccttttactttacatttgtactgttcgtagaatgagtttcatgtgtttgaaattgcctgggccacatggatcccaattatttctgttgatcagccaccatttattgtatatttattaggtatagtttctgtaagagcccaagtttcatattaataccacatttaataaaggaggaaactaagatccagggagggcaagtgacttgcccaaagtcacacagttaataaatgctggagctggggtttgaagccagatcattctggcccctaagctcacagttttttgttttttgttttttgtttttgagatggagtctcactctgtcacccaggctggagtgcagtggcacgatcttggctcactgcaacctccacctcccgggttcaagcgattctcctgcctcagcctcccaagtagctgggattacaggtatgcaccaccatagccagctaatttttgtatttttagtagagacggggtttcaccatcttggccaggcaggtctcaaactcctgacctcgtgatccacccacgtcagcctcccaaagtcctgggattacaggcatgaaccaccacacctggccagctcacagttttctgtactagacctaaatgccttgatttgcctaatagatcatccctaaatagatgacctgttaagggtcttgatgtgtgacttgtatccccatcttaaattaggtgctctgtcttgggaatatttagggacttgggctagaggaagttgttattataatgaaaatgtaattttttgcattaaataaatgcatatttgtactttgaagtttttattaaaattcgattaatatagaagatttatatattctctttgttgctgtgacttccccataggagttcacagggaaggaagaaaagacatcattgttactacataattcccatgcttttttccgagagctggacattgaggtcttctctattctacattgtggacttgtgacgaagttcatcttagatactgaaatgcacactgaagtaagtgacaggctaggatctcagaatttaatcttctttcagaaagttcctcaggtctattcttatttcacaaagaacactgtgacactgaggagagaagttagactgacttttaaagcctttatatgtgaaagcaatgatgaataatcatcctcatactggtgtttgtaagtcataaggtttgtaataatgtgtcagacattataaaatatcatgccaatgatgtaatccttacatttaggttactactactactactactaataagctacctagattatttttgtagaggagcactcttctggttcttagaagtcaatgcccttttcactttttcacaacatttgttcagcacctgacagttgcttactgagtcctattttgtgtttgccactaatcaaagcacttgcatttcagtagtacatagagcatcatgcttgctttcaaataacttctaatctaatcaaagaagtggaaatagctagcaatacggtagctttattattattattttcttttttttttttgagatggagtctctctctgtcgcccaggctggagtgcagtggcgcggatctccactcactgcaagctctgcctcccgggttcacgccattctgctgcctcagcctcctgagtagctggggctataggcatccgccatcacacccggctaattttttgtacattttttatagagacagggtttcaccatgttagccaggatggtctcgatctcctgacctcgtgatcacccgccttggcctcccaaagtgctgggattacaggcgcaagcccccgtgcccggccccatagctttattgatgccaaatacggcattaatggtctgaaccaaggactagtgaaactctagtgagagaatgatgtttatatagaagttgggagtagaggacattttcacagataaagtaacttttgagatgggatttcatcagagagtagaatttctctaggtttaagagaaattgaaatagcattaattttcacctgaaatttacacgaatgtaggtaccttcagaacagaaatagtatccttttttttttttttttttttgagatggagtctcgctgcgttgcacaggctggagtgcggtggtgggatcttggctcactgcaagctccgcctcccgggttcacaccattatcctgcctcagcctcccaagtagctgggactacaggtgcctgccaccatgcctggctaattttttgtatttttaatagagacgaggtttcaccgttgttagccaggatggtctcgatctcctgacctcgtgatccgcccgccttggcctcccaaagtgttgggattacaggtgtgagccactgcgcccagccatatcttttttttttttttttaatctttctacatcatcttgcccttaggagatgccacataaatgtgtattgagtgagcagtttgcagtgagactgtatttcacccattctgcttctagcagtgtaatatagctattccactgggatcactctggggtcctgcccagagttaatagtagcaaaacattagaggaaaacaagtatgaaaggattatttaatgaacagacaaaagggaaattcccttgaattagtcttttttttttttcccaaaccctgtgtgtggcattcaaagtcattttttaaatcacaggatatttaggaaacgcatcttggatccacaactagaaaggtatacagaggaatttatagagaaaaagtatgtcttctaaactatcctgtcttgaattattattttactattctgaatatttattttggacatgcttgactttattatatgacagagcataatagctatcctttatatgagatgggtgcagtttcctcccttgcctcttttttctttttagagacagagtcttgctctgtcacccaggctgaagtgcagtggcaagatcatagctcactgcaaccttgaactcctgggttcaaggatcaagtgatcctcccacctcagccttccaagtatctagggccactggcatgccccactacacccggctagtttttttatttgtttgtttgtttgttggagacggagtcttgctctgtccgtcagtctggagtgcagtggcacgatcttggcttactgcagcctctgcctcctgagctcaagtgattcttctgcctcctgagctcaagcgattcttctgcctcagcctcccaagcagctgggattacaggtgcccaccaccacatcagctaatttttgtatttttagtagagatgggatttcaccacattggccaggctggtctcagactcctgacctcaaatgatctgcctgccttgacctcccaaagtactgggagtttgagaccagcctgggtaacacagtgagacctgtctctacaaaaagttaaaaaaaaaaagtagccaggcatggtgacgcacacctgtgatcccagctacctgggcggctgaggtgggaccatcacttgagtccaggaggttgaggctgcagtgagctgtgaacacaatattgcactccagcctgagcaacagagcgagaccctgtctcaaatataagtaaataaataaataaaagtcaaattatttaccctgctgggcgcagtggctcacgcctctaatcacagcactttgggaggctgagacaggcgttatcacctgaggtcgggtttgagactagcctggccaacgtgatgaaacccatttctactaaaaatacaaaaattagtcaggcatggtggtgggcacctgtaatgccagctacttgggaggctgaggcaggagaattgcttgaacctgggacgcagaggttgtagtgagccaagatcatgccactgccctccagcctgggtgacggaacaagactctgtctcaaaaaaaaaatttttttttcacccattgggaagtattaacatgaaatagccaggtgtggtggctcatgcctgtccataatcccaataccttgggaggccaaggcaggaggattgctcaagcccaggagtttgaaaccagcctgggcaacaaagtgagaccccgtctgtataaaaaaatttaaaaattcgctgggcccaggtgtggtggttcatacctgtaatcctggcatattgggaggccaaggcagaaggatcatctgagcccaggagtttgagaccagcttgggcaatatagtgagacctcatttcttattaattaaaaaaaaaaatgtagctgggcatggttgtgtgtgcctatagtccccgctactcgggaggctgagatgggaggataacttgggcccaggagttcaaggctggaatagctatgatcttgccactgcacatttaacaaaaaagaaagaaaaaaaattatcatgaaatgactaggacattcctggaactaatcctttcctccatgtgacaggctacagaagttgtgcaacttgggccccctgagctgcttttcttgctggaagatctctcccagaagctggagagtatgctgacacctcctattgccaggagagtcccctttctcaaggttagtgtaggcagaagcataggacttgggcatagtggatttgggaacaaaggaggtattatgatgaaaaagttgtcactttctttggcattgtgtttgggtcactgggtagcatgggtgcagccgtattgccagacaatattcatcttgctttatttatttatttatttatttagagatggagtctcgctctgtcgcccaggctggagtgcagtggtgtgatctcggctcactgcaagctccgcctcccgggttcatgtcattctcctgcctcagcctcccgagtagctgggactacaggtgcctgccaccacgcctggctaattttttgtattttttgtagagacggggtttcaccgtgttagccaggatggtctcaatctcctgaccttgtgatccgcccaccttggcctcccaaagtgctgggattacgggcatgagccaccgcgcccggcctcatcttgctttaaataggaagtctgaaggctgggcgtggtggctcacgcctgtaatgccagcactttgggaggccaaggagggcagatcacttgagttcaggagttcaagaccagcctggccaacatggtgaaaccccatctctactaaaaatacaaaaagaactagccgggcatggtggtgcagctatagttccagctacttgggaggctgaggcatggggaggaggaggttgcagtgagctgagattgcaccagtgcactccagtctgggtgacagatttcgtctcaaacaaaaaaaaaagtctacctgtgcagtggttcacacctgtaattccagcacgttggaaggccgaggcaggtggatcacctgaggtcaggagtttgagaccagcctggccaacgtggcaagagcctgtctctactaaaaatacaaaaaaaattagccaggtatggtggcgcatgcttgtagtcccaggtacttgggaggctgaggcagaagacttgattgaacccaggaggcagacgctgcagtgaaccaagatcatgctactgcactccagcctgggcattagaacaagactctgtctcagaaataaaaaaaaaaaaataggaagtctgaaacagaaaatagaaaggcacttggaataagaaatgtatttctttttttgagacggagtctcgctgtgtctcccaggctggagtgcagtggtgcaatctcggctcactgcagcctctgcctcctgggttcaagcgattctcctgctgcagcctcctgagtagctggggactacaggcgcgcgccaccacacccagctaatttttgtatttttagtagagatggggttttaacatgttcatcaggctgatctcgaactcctgacctcatgatccgcccacctcggcctcccaatccgcccacctcggcctcccaaagtgctgggattataggcgtgagcactgcgcccagcctacgaaatgtatttctaaatgccctgaacattcctgaatcctgttctttacttgaattttggtttcaacagcctcccaaaccaagcctgggcccatgcctcagtgtagtagtaagctgtctagaacgtccagaacttcagatgtgtatacagtgtacaaacgtgcacctagcatccggggaagcagttggacggtacatataacaaaatgagaaaatcttgggtcttgggtataagcatttaaacattaatatatcccgtttcttggtttcttgattcatttttcttcttcgtcttcttttttttttttgaggcggagtcttgctttgttgccaggctggagtgcagtggcttgatcttggctcactgcaacttccgcctcctgggttcaagcgattctcctgcctcagcctcccgaggagctgggactacaggtgcacgccaccacacccagctaatttttgtatttttagtaaagatggggtttcaccatgttggccaggattgtcttgatctcttgacctcatgatccacccgccttggcctcccaaagtgctaggattacaggcaagagctacagtgcccagcaattcattcttctttgtattcactatcgggtctactttttgagacagggctttgctctgttgcccaggctggagtgtagtggcacaatcttggctcactgcaacctccacctccgggattcaagtaatcctcctatctcagcctcctgagtagctaggaccacaggcatgtgccaccgcactcagctaatttttgtattttttgtaaagaagagtttcagcatgttgcccaggcttctacatttttttgtttgtttgtttttcaattataatagggaggcagggcacagtggctcacgcctttaaccccaacactttgggagtccaagatgggtggattgcttgagctcaggagtttgagaccagcctggttaatgtggttaaaccccatctctataaaaaatacaaaaactagccatgtttgttggcatgtgcctgtggtctcagatactcaggaggctgaggtgagaggatcacttgagcccaggaattcaaggctgcagtgagctgtgatcgtgccactgcactccagcctgggtgacagagcagaaccttgcctcaaaaaaaaaattataagaaggagtctattgccctacatttgtcaacctaaatgatttctacttttatgtgacctttatctgattagttatgatagggctatatgtctcaatcaaacactgttcctactctacaaaagccaatctctcagtcattggaagatggagcaagatttttatccctctgtcagaatacagtcttaggttaacaactcatttctcccatctgctcctacctggtgacacaggtttgacttgactccattgcgaacccttagtttctgagacgctatccagcagtttcttcactcataactctgcatttattatagaacaaaggaagccggaatattggattctcacatctccaacagagatctgcccaagaaattgttcattgtgtttttcaactgctgaccccaatgtgtaaccacctggagaacattcacaactattttcaggtcagaagcctagacttagaagctgctaagcaaatatgaggtttcatttttggctgagaaaaaggaaaatgaggacaattactgaagcaactgtcctaaaatcatttttatttttagtgtttagctgctgagaatcacggtgtagttgatggaccaggagtgaaagttcaggagtaccacataatgtcttcctgctatcagaggctgctgcagatttttcatgggctttttgcttggtaagtatgtgggaagtgtggagagaactgagtatatacttgcttttatttgacagtcaccaaggcactgaaatgtagaaaagaaagaaaaggttcaaaaatcttatgtgaatatggttcattaattttgtgggagtgtttttgtctgtattatttcatttgatcttgtaccctctgagtcctttggagccactatgttaacccatttgacagattaggtgacttgctgatgagctgataacagatgtggccatctgttccttagtccagtttcctttagcatgctttaattccagattgtttggtgatgagctgaacactgtgagctgggctattccatgataccttcatggaaacagtgggactcaagggaaccccagaagggtacatggcctttagagagataacggaaggaagtggaaggtacaacatggacaaaagtagaactaagggaggtgtgccccttaaatacttttgttcctcagggacaggcgttgggctctctgttctcattatacaagatttctggtcaatcctacccaagcttaaatttagccaaaatttattttctgagctataggcatttatatccaactgcctacgcaacacctccttagatgtggcattgacacctcacactccacatccaaaatggaatatgtcatccctagcatgctccttcagctttgcctggcttagtaaatggtaccaccagttgcctgaaccagaaaccaggagttattctttgtccctccctctgctctccaccgtctttttcccacatctgattgccaaatcctgttgattttattttctgttataaataacatctagatagccatctgtccctgtttctccactgcttccagactcccattatctctcaacctggactgggctaggttcacacttggcctctctcagtccattcttcacatggcagtaagagtgatcttcctaacataaacccagtttgatcctatcccaattttgatttctgattgctcttagatttttcttgagttaaaactctcttacctagcctctaggtcttcttctgactcctgctattccacttattatgttatactctgcctccagcctcactgaattaatttgagcaccctatatagcttttacgtgggaggctttgcacatgttcattctcctgccaggacccccactcttcttgatccccagctttttctgactcatcacatctcttgagatctgaacttaagcatccatcctgcctctctaacccccagttctcttctaacactctggtatccgttcgtgataaaacttaatctcattttattataattacttgttcatcagtctttcctgctagactctgagctccatgaaggcagatgtctgtcatttttatatcctcattacttaaaagcagtgcctgacaaaaactttgaacaatttatcaaagagacttatagatggcaaataaacatgtgaaaggggcctgacatcgtggcttatgcctgtaatcccaacactttgggaggccaaggtgggtggatcacttgagctcaggagttcgagaccagcctgggaagcatggcaaaaccctgtctccataaaaaatacaaaaattatctgggcatggtggcatgcatctgtagtcccagctactcaggaggctgaggtgacaggatggcttgagcctgtgaggcagaggttgcagtgagccaagattgcaacactgcactccaacctgggcaacagaaccagaccccatctcaaaaaaaaaaaaatctgggccccatggcccagtgaagttaacacagaaaataaaccatctctaaaaattataaaaacaattaaaataaatacatgaaaggatgtttattacttcttaaggaaatgcaaattaaaagcacaatgagatagcacaacacactcactagcatagctacatcaaaaagacttagcatgccaagtgttggtgagaaggtggaacagctggagctctcacatgcttctagggggactttacaatggtacatccatattgggaaatagtttggtagtttcttaaaaagctagacatgcacctaccatgtgactcagccattccatccttaggtatttaatcaagggaaatgaaagcatacgtccaccgaccaggcgcagtggctcacgcctgtaatcccagcactttgggaggccgaggcgggcagatcatgaggtcaggagatcgagaccgtcctggctaacacggtgaaactccgtctgtactaaaaatacaaaaaattagccgagcgtggttgcaggcgcctgtagtcccagctactcaagaggctgaggcaggagaatggccttaacccgggaggtggagcttgcagtgagccgagatcccaccactgcactccagcctgggcgacagagcaagactccgtctcaaaaaaaaaaaaaaaaaaaaggtatgtccaccagggtctggtacaggaatattttgagcaatttagcctgtggttttacatagtatattctaaacttgtttcccatgcttttgtgtgtgtgtgagagacagagtctcactctgtcgctcaggctggagtgcagtggcgcgatctcggctcactataacctctgctgcccgggttcaagcgattcttctgcctcagcctcctgaatagctgagattacatgcgcctgccactgcacctggctaatttttgtatttttagtagagacggggtttcaccatcttggccaggctggtcttgaactcctgaccccgtgatctacccacctcagcctcccaaagtgctgggattacaggtgtgagccactacacctggcttttttttttttcttccctgagacagggtcttgctctgttgcccaggctggagtgtagtaacacaatcacagctcactgcaacctctgactcccaggctataaatcctcccacctcagcctcccaagcagttgggactgcaggcatgtaccaccatgcccagctgatttttccttttttttttctttggtagagacggggtttcgccatgttgcccccaggctggtcttgaacctctgggctcaagtgatccacccgcctcagcctcccaaagtgctggcattagaggcgtgagccaccatacctggcccaaattcaacattttaagtacatgaagtgtattgtacatcaactatatctcattgaagctatggtagaccaaaaacctgacacctaataggccctcagaatacatttgttgaaaggaagaatgactatcactggtgatcaggaagatgcttctagaggagaagatctaggacgtcagattgtgctgggcctcaaaggtcaggcagaataatttaaatgttgtccagggaagccattttggagttttatgatcacagccataatacaatgaaagcagtggtttaagaaaacacttctggcagcagagtgcaggacagattgaaaagggatgcaaaaaagaacactcaaaaggtgtcactatgatctacacatgtattgataggggcctggccaaaatgatggtctaggcttggaaaggaagggacaatatgaaaggtaatccaaagatagaaatgtcaagacttgactcattaatgtaggagaaggggtaagtaccactatgggctggacattgatttagcagtttgacaaaattattcctgtatttttgaagaagactacatatctctaaaatatagggaatgaaggagagctttttgcccttcaaagtaaacctatggcccaggcgtggtggctcacccctgtgaaaagaaagaggaaagaagaaaagaaacctatgaagacttcaggaaagattactttggatgtacttcagtttctactctgatacttagagctgtgattgaatttggtacttcagtactttccatttcaattcttttttcttttttctttcttttttttttttttttgagatggagtctcgctctgtcgccaggctggagtgcagtggcacaatctcggctcactgcagcctccacctcccgagttctagcgattcttctgcctcagcctctggagtagctgggactacaggtgcccgccaccacacccagctaatttttgtatttttagtagagacgggatttcaccgtgttggccaagatggtctccatgtgttgacctcgttattcgcccgcctcagcctcccgaagtgctgggattacaggtgtgagccaccacgcccgacctctcaattcttttttcaaaccgttaaactattgatggtacagactggaggccaggatccttaaatactatccaagtagttttccagaaactaagctaacccctcttaccttgacttccttaggagtggattttctcaacctgaaaatcagaatttactgtattcagccctccatgtccttagtagccgactgaaacagggagaacacagccagcctttggaggaactactcaggtgagtcataactacatagccaagattgttgtcccaagaaactcctaggaacaggattggcaactttctttaaaataacctgggtgtctttcagtagttgtaaaggaaattattttcagctactctcctcatatatgagctttctcatctatgtattctgataaatcctgaagtattagaaaccttgaataatcatgctaaatcttcatgaatgcatcagcccataaactcagccttttcaagtaataatgatgaaaacattgaccatctgtaatcaactcttgattatccagggacctactgtctcccagcagatttgggtaattaggcagcagctagttatcactgatagcctgtttctttccccttgtcttgtaggaagaccttatgtggctgaggggtaggcagtggacaagggaggtgacatgatctcaggggcatggctttcggccccctcccccttcagtcagagtgacttggtctttctctcacttcccttggtaacctagaccatcactgggtcagcagtcagtgcttatcatccctgtctataggtcaggaccttatatcttcttttttttttctttgagagagagtctcactttgtcacccaggctggagtgatcccagctcactgcaccctccacctcctgggctcaagtgattgtactgcctcagcctcccaagacgctgggattacaggcgcatgctgacacaccctactaatttttatatttttgtagagatgttttcgacatgtggccaggctggtctctaattcctgagctcaggtgatctgcctgtctcagcctagcaaagtgctaggattacaggcataagtcaccatgcccggcctgtgaacccagattttacaaattattttcagtgtattgcctaaggctttaaagagcagataatttatctagggttgtacatattagcgtggtgcttgggtttctcagcatacatgaccccttcaaggccaacattccatcagtggggctgtcttctgccctggctttttccatacaaaggtatggttttctaccaagatgcttgaagagggttgctactaaagcacctgaaaataaggaggattctgattaggccgtcaaacactgaaagggacttgggcacgtcatgtggatttaaatatatctgtgacacataggatactattgcatttgtttgtttttcttgtctccttacagccagagcgtccattacttgcagaatttccatcaaagcattcccagtttccagtgtgctctttatctcatcagacttttgatggttattttggagaaatcaacagcttctgctcagaacaaagaaaaaattggtgatgggcctagatcctttttttttttttttttttaatgaataggactaatatctcacacttacaaactttgggcttcccaggacatttttacatgtaaatccccacataaccttggataggccctcttgctataccaagaaggtcattttcccagaacaacctgactgatttctgctaaaattgcttagtctgagtttggttagacaagctgagtagatagttttctctttggcttaagtttaatcatgttcttccttttcaaaaaaaaaaaatttatctgagacatttgacaaaacgagacataaatcatgaggttaataaagtaggaaataaaggagaaatcagggtcaagtataaaagaaatactggcctcttccctggcctttttctttttttttgagacagagtctcgttctgtcacccaggctggagtgcagtggtgcgatgttggctcactgcaatcctctacctcccaggttcaaacgattctcctgcctcagcctttcaagtagctgggattacaggtgcgcaccaccgtgcccagccaatttttgtatttttagtggagacggggtttcaccatgttggtcaggctggtctcgaactcctgacctcgtgatccacctgcctcagcctcccaaagtgctgggattacagacgtgagccactgtgcccagccctggcctctttcttaaactgtcttttattgtagctcttagaatgcagctcatcctagttggcagcacatcagaaagcaagataaaaatgcaaaacaaacctttatttatccctattgattaaaaggggaaggtttggtctcaatcttggaggtgaccactgctattggccagcccaggaggaacaagattggccttcccactgcccagcagcattccttttctctgtgtgtctgtatttatgttcatgtttgcatgtttgtgtgtttcaagatggggttggggtgggacgtgttgagccttaggcaaatgagtttatgtctggcaaaagggccagtggatcaggaacgtgacagctttttgtaagttgcctgttagaccgggaacgtcttagtaaatctaaactaataatccttttgatcaataatcatcctcaaaaacctgaaaagcaagaatgaggtcaagttcccatatgtaagattcctttgtcttcttttctaacagcttcccttgccagacaattcctctgtcgggtgtggccaagtggggataaagagaagagcaacatctctaatgaccagctccatgctctgctctggtgagatgtttggtttcttccaatgagccaaatagcttttttctattttgctactgttgtttgtcagagactggacaaatgacctttttagtgggaatttgaaaacaatgaagtaggttaaaaatgaacacaatttggaacatgtggatcttaagatcctctggttctgttttatactgttagctaactgcttattgttaattcagatcatagaggaattagaggaatctgtagttgtattctactttgttaattagtgggtcaaatatttgactctcaatgcagtatctacctggagcacacagagagcattctgaaggccatagaggagattgctggtgttggtgtcccagaactgatcaactctcctaaagatgcatcttcctccacattccctacactgaccaggtaagggagttctttcctccagtttttcccttaagatagaatcatcatcaggctgggcacggtggcacacacctgtaatcccagcactttgggaggctgaggcaggaggatcaccttgaggtcaggagttttgagacccacttggccaacatagtgaaaccctgtccctactaaaaatacaaaaattagccgggcgtggtggcacatgcctgtaatcccagctacttaggaggctgaggtaggagaattgcttgaacctgggaggcggaggttgcagtgagccgggatcgcgccactgcactccagcctgggcagcaagagcgaaactccatctcaaaaaaaaaaagaatcataatcacactgtccaacgtatatagcttccacacaactgccttgctcctcctcatctaattctgatacagacagtagatataatcattcattcaataaagagagtctgttatgcattcctttcaagggctctcagctaatatatttgagaggaccatggtggtttttgttttgtattgttttgttttgtttttgagaaaacttgtcacccaggctggagtgcagtggcgtaatctcagctcactgcaacctccacctcctgggttcaaacgattctcctaccccagcctttcaagtaactgggattataggcacccaccaccacacccggctaatttttgtatttttagtagagattgggtttcaccatgttggccaggctagtcttgaacccaacctcaggtgatctgcctgcctcggcctctcaaagtgctgggattacaggcatgagccattgtgcccagctgagatattttagccatcttgagaacagggtgctcacatgtatgtctcacttaatgggtgtgtgtctcagaatatcaatagttatcttaacatttgtagtcttttcagtttataaagcactttcactttatctcatttgatccttttgataattctgtgaggttggtatcattgcccctattttactgctgaggaaaatgagagctagagaacttctcaagcttacacgtgcaataaaataaacatagaaccaggactcaaactcagatcttctcactgttacttcattgctttttccatactaccataacacctcctttcataaagttaattccattgtttgacaggcaatcttcttgggcttattactgagtcctttccgctcccccatcctcttactaaggaccctagtgaaaggacatttagagaggtagggaaggaagctacttttggttcctggttcttcccaggtagttctaagcagtgcatcatggtgtgggcacgcatgcttttcccgtcttctaggcatacttttgttgttttcttccgtgtgatgatggctgaactagagaagacggtgaaaaaaattgagcctggcacagcagcagactcgcagcaggtgagtaagataatagtcacttcaagaagtggactttggattacttggaagttgctgattttttttttttttttttttttttttttctgagacagagtcttgcttgttctgttgcccagactggagtgcagtggcatgatctcggctcactgcaacctcacctcctgggttcaagcaattctcctgcctcagactcctgaatagctgggattacaggcatgcgccaccacacccggctaatttttatattttttagtagagacagggtttcaccatgttggccaggctagtctcgaactcctgacttcatgatccacccacctcggcctcccaaagtgctgagattacagacgtgcgccactgcgcccggtggtagttgctgattcttctatgtcttgggtccaagttttctcctaagctgttttttgtttttgttttgttttgagtttctgagattcaggattttttttcaaagagttcctagtttaatttcctttccctctagttagaggtgaggaatgggctctcttttccttggctactgcccagtttgcctcctgctaactggcatgaggtaagccagcctgtttgagatactgtggatcttggcagcctgctaaccagaacggagctagacaagtaagagaaagggctagcatagggaagcagagaagctacagccagtatatgttttttcttttttttttctttttgagacagggtctgagtctgacatccaggttggagtgtagtggtgcaaacttggctcactgcagcctttgccttctgggctcagatgatcctcccacgtcagcctcccaaatagctgggaccacaggtgcacgccaccatgcccggctaatttttctatttttagtagaggcggggttttgtcgtgttgctcaggctggtcttgaactcataggctcaagcaatcctcccgcctcagcctcccaaagtgctgggattataggcataaaccactgcacctggcataaaccagtgcagcccagaaggcaaaggctgcagtgagccaagtttgcaccactgcactccaacctggatgtcagactcagaccctgtctcaaaaagaaaaaaaaaagaaaaaacatataccggctgtagcttctctgcttccctatgctagccctttctcttacttgtctagctccgttctggttagcaggctgccaagatccacagtatctcaaacaggctggcttacctcatgccagttagcaggaggcaaactgggcagtagccaaggaaaagagagcccattcctcacctctaactagagggaaaggaaattaaactaggaactctttgaaaaaaaatcctgaatctcagaaactcaaaacaaaacaaaaacaaaaaacagcttaggagaaaacttggacccaagacatagaagaatcagcaactaccaccgggtgcagtggcgcacgtctgtaatctcagcactttgggaggccgaggtgggtggatcatgaagtcaggagttcgagactagcctggccaacatggtcagtatatgttgcaaaggcttttacttacttgggaattgctgaagaggaaactttttagaaagtctgtccctatgaggtgttctaatgttaccacaacatgtgcaggcctcagaaccatcttgtggatgcactggttgctacatctaaggataattggcttaaatatctgtatagctatgtaattcaagaactatatcttagtgggaatacagtaagggaagtatttggctgtgactcagaggtgcccatatatttggctgccccagattcatgaagagaaactcctctactggaacatggctgttcgagacttcagtatcctcatcaacttgataaaggtgagtatggagactgcttgacacatctcaccaaataactgcagaaaccaagtgtcctggcttccaaaatggactttccttgctcctcttcccactcttccttggggcctgctctccctgagtcgtcttcttcctttgtccccctacccatcctggataaccccttttctcactaggcatttttttttttgtcttttccttccttcctcctacttatgccacaatactatttaatgactccttccatctgtaattccctcactttttcaccttgccttggatcctctatgatctgagcgcacattccctcttctaaccctgaatgccctcgttctcctttaaacacactgtgctctcacccactccatcgtggttttgctcagcttgttcccccagcctagaatgtccttgtctctccacctctttcatgtcttttttttttttttttttttttttttgaggcagggtctcactctgttgtccaggctggaatgcagtagggtgatcacagctcactgcagcctcaacctcctagactcaagaatcttcccactgaagcctctggagtagctgggactacaggaacatgccaccacacccagctaatttttctattttttgtggaaacagggtctcattctgttccccaggctggcctcgaactcctgggctcaagtgatccaccagcctcagcctcccaaaatgctgggatatcaggcatgagccagcatgcccagcctcatccagtctttcttaagtcttcagatcaaggttttggacctctaataatgccatcttctcaacactcccagttggaatcagtttatttctctttgctcgtctcttccttttcttgaacttcagttgtgataattactttattctgctttgtaatattaatttaaatgttgacattcctccattttagaattctctgcagcacccaaagctgtgctttgcgcagcgggaaagaggctggagtgctcaaaggagcagatctcagccttggtttcttgtctttcacctctccaggtatttgatagtcatcctgttctgcatgtatgtttgaaggtgagagatttactgggccctgtttcatatttattcttcctgtggatcactctagagaggacctcagctgagataaattgctcaatttcttgcccacaagccagagtttccagaatctatgccagtttagggaaggcaatggatgcattttcccaccctagttggatgattggagaagccagttttcctatgaatttgaaaacttttggtaagaatcttagtactaggaggaatggcttcagggcagttgagtttaggagcagtagttaccttccgtgccattccttaccaggcaaaagggaggaaggaggagtagatgatttttctttaaagtctatgggtggccttacaaatgtgggatctgatatcctgataattgccaaacttctcttttgtgggaatagcctgtattagccctagatttgatgggaagtccagtcagaatgttatggggagaatgctacttcgccactcctcaagtttccttccaagtggatggtgccccattcttgtcatctcctggtcactctccctttttactccacccttgcgcaatgtgggagatgggcaagttggagagaggagtcatttatctgattgggaaatttagaaattggtcatatgctttctcagctttacccagtttttccctcttgggagtaagttatcctcagatagagctcccctctactctatgctctcactcctaagctgagcaagttccctgtccatcgactgtatctgtggtaggtaagtctgcctaattctggggcttagttaacaggcctatttgatttttgtattaagttacattctccaaataaaccttttggacccttcccaatttgttttttatatatataaataagaaaataaaacccttgggctggatgagactattctgcctcaggggcctttcagtgagatacctcagctagaggtaacagtgtgtctctcttcttcagtatgggcgtctctttgtggaagcatttctgaagcaatgtatgccgctcctagacttcagttttagaaaacaccgggtaagagctaagagcagagaacaaagatatgcactgaagagttgctcagaagatatgtccttggtgactcctgggtggggctgggagtgttctacctgggctcctctggtccacttcagctgtagccagagatccccaaattggactgaatattccaaagtaggctgaactcctcaggcccactctggatcaaacccacctttctatttcttctccagatctgacagtggtcttccttttagcttgattttattgtgctactgcactctcaggtcctcatgtatcagtgtgtcatttgcttattcctttatgcttctgtaggtatactctcagaaatgattttaaaaaaaaaaaagctcatttgtgtcataaaaccctttgctgtggtaatgaacagtcttgacagttttttagccaatggcatccagggctagagtgatgaattaaggatagaatcacattatttcctatacatatttagcaagttgaacaaaatactcaccatatttggttggtccctcacagccctgaaagagaaagggaaggtggtattttatcctaatgttgcagatgggaaaactgagacatggtaacctatgtaaaactaaaatgcaggtcttataactctcagattgatacaagggacagaaatgggagagttgagaataagaggtagctgctattcctcctatttgagaggcaaattaagatgattatcagcataggctggaaactgcagagtttatcctctttggagcttttgattgcaagggtatcttgaatctaaaatgaaatcaggacatttcatagagcatttataaacttattggttataggaagatgttctgagcttactggaaaccttccagttggacacaaggctgcttcatcacctgtgtgggcattccaaggtaagaaggggagcaggttctatcagcagcctgcctgttggcttaatctgcagttgctattgggggatccatgggctaccatccttcttcctttatatctgggactgtgtctgtccaaaggcagtttattcagagcaaatccttagttgctccttgagattgggcagtcctctagaggggaatctccgcatctgaaatttgattcaaactccaaagctctttttcctctagaaacttcttgggtgacagaaatagaatgctggtatatgtttacttctgcaaagtcctctaggtaacaggactgtgatgtaagtgatgatcctgcaggagacaggaggtggctctaaagcagccatctgtagaggctttcatctgtgccacttactttcaaggaactcatctatgtcttatgagaacatcttagcattaaaggatttttccacttgaagccttcttatagttaatgaggtattgtcacgttttgtctgaatgaacacagaaccctagagttctgcagtcactggcaaaccaaatgattcttgagtccagtttctgttacttacttcctcctctggttctaaatttataaggtcctgaacagtgatttttttttttttttttttttgagacggagtctcgctttgtagcccaggccggagtgcagtggcacaatctctgctcactgcaagttccgcctcccggctggacagtgaatgtttaaggaattctcttagctaaacagggctactctattgtttaatatcagtaaaatatatattcaagaatattttaggtaaattcattgaagatcggccagtaagaggttatgaagaggaactagaggtgttggtggtatgtcttctaggctttgaattctttagctgccattctctttggattactctgccaaactattcctgtttgatggaacataccgttggcccatactggcagggcttgtgttcttattcaacattcaaaggtttctataagaaatgtgaaggcatgatgataaactcacaaaagatggatgttatttatttccattcagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcaggtaagccttggatcctgctagtgataatcccctactcttattctttgtgacagcatcagatggcatgtaaggaaggtcacctaagccctcgtctctcagtaaggctacttttctcttaagtctgtgactgtttaactcttaaagttatggtacattactcatgggccctggtcacaggctgcacccctcatcttaggcagcaaggcaccaaaacatgccattgatataaacaatgcctcagacataaaggagtcagaccagtacaaacctctctccacagctagaggagctcctttaagccccactgagggtagattcataataacatttttgtatagggacaaacatttcttttgttattttttttcccctaagccaatctgtcttattccagaaattacaaattaatctcttattgggggacctgccccgataatcacgtaggttcttttctattttcctaagtgtcagctggcttgagaaataaagggacagagtacaaaagagagaaattttaaagctgggcgtccgggggagacatcacacgttgataggatccgtgatgccccacaagccacaaaaaacagcaagtttttattagggattttcaaaaggggagggagtgtgcgaataggtgtgggtgacagacatcaagtacttaacagggtaatagaatatcacaaggcaagtggaggcagggtgagatcacatgaccgcaggaccgaggcgaaattgaaattgctaatgaagttttgggcaccactgtcattgataacatcttatcaggagacagggttttgagatcaacaggtctgaccaaaatttattaggcgggaatttcctcttcctaataagcctgggagcgctataggagactggagtttatttcacctctgcagtctcgaccataagagacaggtacacccgggggggcccagttcagagacctacccctaggtgtgcattctctttctcagggacgttccatgctgagaaaaagaattcagtgatatttctcccatttgcttttgaaggaagagaaacatggttctgttccgcccggctcaccggcggtcagagtttaaggttatctctcctataccctgaacaattgctgttaccctgttgttttttcagggtgcccacatttcatattgctcaaacacacatgctgtacaatttgtgtagttaacgcaattattacagggtcctgagactatatacctccttctcggctgacaggattaagacattaaagtaaagacaggcataggaaatcacaagggtattgactggggaagtggtaagtgtccatgaaatctttacaatttatgtttagagattacagtaaagacaggcataagaaattacaaaagtattaatttggggaactaataaatgtccataaaatcttcacaatccacgttcttctgtcaaggcttcagccggtccctccgtttggggtccctgacttcccgcaacaatctctaattttaactaatgagcatttataaggttttttttagttgtctgattagctgaaatcttgtgttgtttataatactactttggagttacaacatttttcagatagggtagtataagcccttttctttcatgcttacaatatctgagtcttgtagtcaattatatatgaaatatataaaacagcaccacagagaattagcttcctttcttcacatcaaccttatgaggcagatactattgtttctgcataaaaattgaagctcagagaagttaagtaatttacctaatgtcattcaacagtgagtgggtggagccggagtttgagtccaaacagtcccaaatccagagctgatgttctgaaaccacctcaccatactgtcctttagcctccgcatggccattcgtgcttggtgtgatagtgcttagataccttaaggtatttgggaaattttagaaccatgttcagcatcgacttagagtcaccaatacagtctagccttttaaaatgtagtgtgatactagcatactaagatgaacctttcgttacattacttattgtatcagggccacagacatctcagaaacctggagttgagtatccctcctctagatgctgaatcacaagttggtatccatgtttgctgtgttttgaatggctaaaatatcttcctttgtattgcctgtaaactcaaccttctcccctattaccctaaatgtgatcattataacccaccattttcttggtccattcacatttagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggaggctgaggcaggagaatcacttgaacctgggaggtggaggttgtggtgagccgagatcatgctactgcactccagcctgggcaacagagtgagactccgtctcaacaacaacaaaaaagtgtacatttataaaattttgtcacaattcaggtaggttatagacaccaaaaagctcagatttaagaacccctgctgtggggcctctgtctgtaatgcaatttgagtctgatccagaaagatcatttagtatgaaaagtctggcctgatggggtggctcacacctgtaatcgtagcactttgtgaggctgaggtgggaggaccgcttaagcccagaatttcaagaccaacccgagaccccatctctacagaaaaaatttttttgagctagccaggcatggtgacgcatgcctgtggtccctgctacacaggaggctgaggtgggagggttgctcaagcccaggaggtggaggctgcagtgagccatcatcacactccagcctggatgacagagcgagaccctgtctcaaaataaaaaagttattttatttacatggtccccagttttatttgtataatataccccttctacttttttctcagaatttgaggcagacaatatcctattagtttggtactttcccctaagcagatctctcatactagtatcgtaagccagacagaacagaattttgtactggattcctgttgagatacaccagcacagcacttctttttttgagacggagtctccctctgtcgcccaggctagcatgcagtggtgcagtctcagctcactgcagtctgtctcccgagttcaagcaattctcctgcctcagccttccaagtagctaggattacaggtgcctgcaaccatgcccggctagtttttgtatatttagtagagacagggtttcaccatgttggccgggctggtctcgaactcctaacctcagatgatctacccacctcagccttccaaagtgttgggattactttggcgtgagccaccgtgcactgccataccaccacttgtaataaatatttcattctatatcgaatgccctctttgttcctatgtcatatacatgcagtagagctggaggaccatagcttatttaaaattatgcaaattgggccgggcgcaatggctcacgcctgtaatcctagcactttgggaggctgaggcaggcagatcacctgaggccaggagtttgagaccagccttgccaatgtggagaaaccccgtctctaccaaaatacaaaaattagccgggcgtggtggcacatgcctgtaatcccagctacttgggaggctgaggcaggggaatcgcttgaacccgggaggcagaggttgcagtgagctgagatcatgccactgcattccagcctggtgacagagcaagactcctttaaaaaaaaaaaaaagttttaacagtgataatagtacagttgtgtatcctctaggagctgtattccagaggtcacccagagcagtaacctaaaatgcttatttatttattctttgccccttaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttctgcctca

SEQ ID NO: 117 - DNA, 14768 bp, Homo Sapiens
cttccctttccgacagcgcgggaacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgtaagtcctcgcccgcggccccttagcaggtatgggaggcggggggctgtcgggggaacgacacacacagaggtgaaataagccccttcagcgacggcctgccgcgcaccctatgagcaggggcacccttcactgagcacttgctgtgtgcgggacatcgaggatccgggaactcgaggcacacgccttctgttcgctgtaaggtatagtgatgataagtggaggcaaatcacttttgatcgcgtacttccatctctaaaaaactggactcgtacgtccagtgtaagtatacttatgtataaagtgtacacatgtgttaaaatacgtacattttaaagtacaaaaatagatacttaaaacgtgatggtggaatacgtatccgctatcctggtggctgtatgctctgcttttcaaagcataacgttcactttaaggcaagattgctttctctaagaatggtaactgtgaatccatattttagtgttcttgataatttctggctcttggatgacattgaactttttttttaacctctctgtggctgacgaaggattcctactaggagcagaggtgtcggccctgccattttatttggttgtgtttctgttattgatattatctccaattttttggcaggcattcttttaagccacgtgcttatttgtgaggacaacttttgcttaaaaaaaaaagagtacagtatctacagatgcacttaactagcaaagttaactaaaacacacagaaaaatgagtgggtgaggtgccatgttcagctcctagtggggccagccttccactcctcttggatacccctcccccataatttatgctggaaaccatccagatgctaaatatttctaatgcttaatttcttatgttttagataaataggggaaaatgggagttccaatattttcttcctacactccactttgaatttctttcaggagatgggtcaggagaacttgtctgaatccccaaattggaagctatagaaatgtttgcccagctatctggcttattctggatagagtaaggagagggcagggccttaacctggggcccctggatagaagagtatttcagcacaattgatttcctttataatcctagatattttatcaaatgcatttaacactcattctgatcacaggtctctggcactaaaacaggttaaaatttcctggagtagggtcttccctatctctctacccccaaatatcctccccaccacaaattagccatcttttaaacttaggttttttttgtttgttttgtttttttttttgacggaatcttgctctgttgcccaagctggagtgcagtggcgcaatcttggctcactgcaacctccacctccagaagaagcaattcttctgccccagcctcctgagtagctgggactacaggcgcgtgccaacacgcccagctaatttttgtatttttagcagagatagagtttcaccatattggctgggctggtctggaactcctgatccacccacctcgtgatccacctaccttggcctcccaaagtgctgagattacaggcatgagccactgcgcccagcccatcttttaaactttgactctagtttttctctctcacatagtgtctatattccacaaagaaatagttgtctttttttttctgcctcacatcccaagtgcctctgtgttgacaaacggccctgcaaaattatgcatagggaggagtagagacgtgaggggtggtgggctagatgctgccatgacttgccacaccacgcctcaggtcacgtaggatctgggtttgtgcctcagcagaattacagatggttacattgcatcatgggcctctggagctctggggaatagtgttgaatctattttaagaaaagctgggtgcttgcaggacagagcattggttctgcttaaactcctggggctccaaaacaaaagatcctcatcccccgtctttcccctttggctctgtgcatactgtttggaatctgtaaagtgattccttctgtttcaagtttcatctctgggaagccttctgtgtccacagcagctcttgctgatctcagcacacttagagagttaattcattcaataaatgcgcaacaagtgcctgctctgggctggcgctgtgctgagtcctaggacacagaggaaggaaacactaccttcaccttttaggaactcacaatttggtgaaaggaacacaagagctggacagatgactgaccccgagagttccaggggattgccgagggcagccatagggctgcaagactaagcactgcacagcatcctggagtattatttttacctaaaatttgggaaagaacttttttcttcttttgtgtaaaacaagcatgaatctattatagagtaggttccaatatgaattttgagctgaaacagatgacagaggccaaagaatagggcctgtcatatgatagatattcaatgaacacttgaacagttctcatctttcatgttgtccctgtctccatccactgacttttttttttttcctttttttgaaatagtgtctcacattgttgcccaggctggagtgcagtggcatgatctcggctcactgcaacctctgactcccgggttcaagcgattctcctgcctcagcctccccagtagctggaactacaggcgcatgccaccatgcccgtctaatttttgtattttttttagtagagacggagtttcaccatgttggccatgcaggtcttgaactcttaaccttgagtgatctgcccacttcagcctcccaaaatgctataattacaggtgtgagtcaccacacctggccaacatccactgactcttgcagatactgcgtgccagcccccatctgtccaccgccatctagcccccagctctgcccagtctgccttgtgctcccttcagccaaacacttaactgcttgctctccctctgctacccaggaaaccactgttgctgcgattgccccggatatgccagaggaacctgatgtccctgctgatggccgttcggccatcgctgccggaaagtgggctcctctctgtgctgcagattgcccagcaggacctagcccctgacccagatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggtactttggtagggagactgggtttagagtgatctttcagcagtggtggctttatccatggggaaggctgcttgggacactttttcccaatggagttgactgtagttcctggaggaagaaggaggaaggtagggttgagggaatgtagcctccactctacagactcttttttttttttgagatggagttttgctcttgttgcccaggctggagttcaatggcatgatctcagctcaccgcaacctctgcctcccgggttcaagcgattctcctgcctcagcttcctgagtagctgggattataggcatgcgccaccacgcccagctaattttgtatttttagtagagacagggtttctccatgttggtcaggctggtcttgaactcctgacctcaggtgatccgcccaccttggcctccaaagtgttgggataacaggtgtgagccaccacgcccagccactccacagactcttaaggaggggtagggaagggagttattggaggtgggaaatgtgtcctaatgatctataatgtggggttaaagggtgccaggcaagggagaggctctggagccacccctgctaccccgtcatatgtgggtgggaagaatcatgacagcatccagtctgcccctgcctcctagtctgaggcctgggtctacccccatttgggttggatgcagaagacaattctagacagctaggtttcacatggaccttgtctagtttgggttcttaggcacttttcaagatagagacttcatgttcttgactttttttttttctcctcgagacagggtccctctcttctcccccaggctggggtgaaggggcatgaatataactcactgcagcctcgacctcctgggctcaagtgatcctcctgcctcagcctcccaagtagctgggattacaggcatgcaccatcacgcctggctaattttttatatttatttttgtagagatggggtctcaactagttgtgcaggctatcttgaactcctgggctcaagtgattctccatcctcagcctcccaaagtgctggtgtgagccaccgcgcttggcctcttgactttcttgaatcatctttgccagctagctcccactgacctggggccttttcagtagggggagccagaaccgggcttggggtcatgctgcagggggagggacgtagcagtgactgggctctcctccacaggaccagcttcccaggctgcagcagctgctgaagaccttggaggaggtgactggccccacagtgctcaccatagcctttcttccatcttctacccagaccccaactatgcccaaggaaggcccaatgcagtgatatacaagctggctgggggagggggactggagtaaaggtctgaggacagtctctgaaggagcttttcttgaaccaagtgtagacttaccatctaaccccaggtaacttcctcttctctggtagtgccttccaggatctcaggccactccttctgccacctgaaggggtggcttcagtgacttgtcactgagggctctgccagccctaacatgagatttgtctccccaggggttagagggattggaggatgcccccccagttgagctacagcttcttcacgaatgtagtcccagccaggtgagtccagatgactgcctggctctgaggttacattctctgtcccttatctttttctatttaagtttatgttttcctacctcatgtgggaaatgtgggaggggattttgttgttttctctctcagcgataggggtcaccctgtgtagtatcttttagcccttggttccttcccctagggcagctctcccagactttctttgccctggagtatctttgccctgctctgtctgctgtccagttgcttgagacagcctagcagaggcagagtgcatgtcccggtgtcctctctccccccgcactctgtaagcagatggacttgctgtgtgcccagctgcagctccctcagctctcagacctcggtctcctgcggctctgcacctggctgctggccctttcacctgatctcagcctcagcaatgctactgtgctgaccagaagcctctttcttggacgggtaggtgtattgggaggtactcagagtgccaaggacaatggggaagagcaactgggccctcagaagggtggtacttgagagaggggattcccagccttgtagacatctgggctgtttgggcagcctggggcaaggaaaggatgcctgcttaactggcagggcatggacccccaggccatctacccacatggcatctaacttttttttttttttttgagagagagtgtctcactctgttgcctaggctggagtgcagcagtggcgtgatctcctgcctcagcctcctgagtagctgggatcacaggtgccttccaccatgcctggctaatttttgtatttttatttatttatttatttagagacggagtcttgctctgtcactcaagctggagtgcagtggtgcaatcttggctcactgcgacctctgcctttggggttcaagcgattctcctgcctcaacctcctgagtagctgggactacaggcacccaccgccacacctggctaatttttgtatttttagtagagactgggtttcgccacgttgcccaggctggtctcgaactcctggcctcaagtgatccagctgtgtcagcctcccaaagtgctgggattacaggcataattaagccaccatgcccagctggcatctaacttctctttgggcaccagaacccttctagaagctgatcaagggactttcagggatttgggaactgagcaagagaggtatgtatcttttccaatgggtgggtccatgtgagttctaaataaaagaacttggttttttttttcctttgtaacatgtatcatcatctgaaatgtgcatttgataaatgctgttgaaatgaagaagaaaataattaattttttcctccctgttggctgtagatcctctccttgacttcctcagcctcccgcctgcttacaactgccctgacctccttctgtgccaaatatacataccctgtctgcagcgccctccttgaccctgtgctccaggccccaggcacaggtaattctggaaccagccccaggcccagtagctctgccctcagtgttctcagcatccttcaccccagagtggccctggcaggagttgggtattcagtgattaaagatgcctgctgcttccctgacaatgcccctgtaacaggctgggcattctgttaccgcctccctgctttctgctgtcttctgccatttccccccagacttccccttctgctgtcctctacccaggtcctgctcaaacagagttactgtgttgccttgtgaagatggagtccctggagccagatgcacaggttctaatgctggggtgagtgtgcaggcctccgtgctgtccccactgccacctgttcccccaggctagagtgacatcacatgtgttgggccctgcagggaaggcttaccttctctaggaagccttatgtgtatcatctcactccatcctctttctcctttatgagtcctctttgccttttgttctcacgatgcactttctactcctagttattttttaggggatccttgtgtctcactaccaaatactttgttgtcagctcctggggctcttgaggttgtgacctccctggcagttgtatgagctctgcaacagtggctgctggggctggtgccagcatcaagaaggctctgactacccatttttttttggcggggggtggggggtggggacggagtcttgccctgttgcccaggctggagtgcattggcacagtcttggctcactgcagcctctgcctcccaggttcacgcaattctcctgtctcggcctcctgagtagttgggattacaggacccaccaccaagcctggttaattttatgtatttttagtagagacgggatttcaccatgttggccaggctggtcttgaacttctgacctcaggtgatccacctgcctcggcctcccaaagtgctgggattacaggtgtgagccactgtgccccacccctgactacccctttgttggctggggatcttggctgtccccagggccttgccctgctgtgggagttggagcagcagatagatactcaggcttgggtgggaggccaggcatttttcactagggcctctgctttgcagacagatcttggagctgccctggaaggaggaaactttcttggtgttgcagtcactcctagagcggcaggtgagcaggctgccctggggaagagtggacaaagaagtgctgcagtccttggaagcacacggggttcctgggtttctgagtccttcagtgcatggagggtcaagcaggacagctgccctacagcagctgcctgagacagtgggagagccctgggccatgcaaagctggtagcagagagctgagcacatggtcacttcagctccacctcttaccagctgggggggccttgggggtgggatttttgatgtgtgtgtgtgaatttaattttatttttgaataggtaatagattcatatgttcacaaatttttttttttttttagatagagtctggctttgttgcccaggccgaagtgcagtggcacaatcttggctcactgcaacctctgcctactgggttcaagcaattcttgtgcctcagccacccaaataactgggattacaggcgtgcgccaccacgctggctaatttttgtatttttagtagagatagggttttgccatgacctgaggccagaactcctgtggcctcagccacccaagtaactgggattacaggcgtgcgccaccacaccggctaatttttgtatttttagtagagacagggtttcaccatgacttgaggccagaacttctgggctcaagtgatctgccctccttgacctcccaaagggctgggattaaaagcgtgagccaccacgcccagcccatatgttcacaattttaaaagctcaaaaggatacagtgaaaaatattccccttacttctcttccctaaccatccagatttccctccttagggctaaccagtattaccagtttcaggggaatccgcccccctccagagataccatctatatgtggaaacatgtctactcttactttccctcctacttttttggaaattgcaacacaccaaactcagtgccctgtaggttgctttttttacttcacagtatattttggtgatttttttcatatcagtacctgaaattctgcctcatttgtttatatcttagataactgacctaacttctttttttttttttttgagatggagtctcgctctgttgcccaggctggagtgcagtggtgcgatctcagctcactgcaagctctgcctcccgggttcacgccattctcctgcctcagcctcccgagtagctgggactacaggcgcccaccaccacacccggctaatcttttgtatttttagtagagatggggtttcaccatgttagccaggatggtctctatctcctgacctcgtgatccaccggcctcggccttccaaagtgctgggattacaggcgtgagccaccgtgcccagccctgacctaacttctttatgcctgtggtttcctcatctacaaaaggggagatataatattaatagcacctaccatataagactggagtgaggtttaaatgagataattggtgtaaagtagtcagaatggtacctgatgcacagtgtttattaaataataataataattattattttttttgagacggagtctcactctatcacccaggctggagtgcagtggcataatctcggctcactgcaacctctacctcctgggttcaagtgattctccagcctcagccccctgagtagctgggattacaggcacgcaccaccacgcccggctaatttttgtatttttaatagagacggatttcaccatgttggccaggctggtctggaactcctgacctcaggcgatccacccgccttggcctctcaaagtgctgggattacaggcatgagccaccgtgcctagcataaattattattataaagagacaggtgattaaggtggcagtgtctcttgggccctgggtcctttatatctttaaccactgaaccagatgagggatccttggcttccccttggtcctaatctgagcctttgcaatggtagccaccattttctgagacctgtgtgtcttatgtgcattatctcatttaatccttttcacagtcttccgttagatatcctgagcctcattttatagatatggaaatggaggtttaggttggttaagttacctgcccagggtcacctagctaggaagtggtggagttgggaattgaatccaggactggctgaatgaagagcccaagcctttcttgtgattactgctccatctcccaatgtgtgcaggtggagatgacccctgagaagttcagtgtcttaatggagaagctctgtaaaaaggggctggcagccaccacctccatggcctatgccaagctcatgctgacagtgatgaccaagtatcaggctaacgtgagtattgatagggccttggggctggtcctgctggcagggctgccctgggcctgccacaagggtgtatgaatatgtatgtcagggataaaaccctgagtgctggccaggcacggtggctcacgcctgtaatctcagcactttgggaggccgaggcaggcggatcatgaggtcaggagttcaagaccagcctggccaacatggtaaaacctcatctctactaaaaatacaaaaattaactaggtgtggtggtgcacgcctataatcctagttacaagggaggctgaggcaggagaattgcttgaagctgggaggtggaggttgcagtgagctgagatcatgctactgcattctagcctgggcagcatagtgagactccatctcaaaaacaaaaacaaaaacaaaaaacaaaccctgagtgctagccagagaaacaacaagttcaagcccaggactggggaatgagactgcttaggagttcattcatccagccaacacttctttaggccagatgctgtgtggggcactgggaaatcaacagcgaccataatgcaatccctgcccttgagttgaccccgtcacctaaccccaggctagtgagaggggagaaataaaataaacagataacagatattagaagtaagatctggtaggagccaggtgagaggtgtgcaaagggcatttggtggcaaaagaagaggagcaagtgagctttgtttgtggttgggaattgggacgggcttcctgacttttttttttttttttgagtcggagtctcgcactgttgcccaggctggaatgcaatggcatgatctcggctcactgcaacctctgcctcctaggttcaagcgattctcctgcctcagcctcccgagtagctgggattacctgccaccacgcctggctaattttttgtatattttgtatttttagtagagacggggtttcactatgttggccaggctggtcttgaactcctgaccttgtgatcagcccgcctcggcctccaaaagtgctgggattacaggcgtgagctgtcgtgcccagacttcctgactcttaaaaggtgaatggtagtcaagagccagagatgagaggaagggcatttcaggaaaaagatacagtgtgagcagtgagtgtctgaggggatctgcaagtagttcattgtggatggagcctaaaaatgtgagaatggatggtggtgggggataagattagagagctaaagtactaagagctattatttctacagtacctgccatgtctcagtcatggttcttttattaaatttaatttttcaaaaatagagacagggtcttcttttttttttttttttttttttgagacagagtctcactctgttgcccaggctagagtgcagtggcgcatctcggctcactgcaagctccgcctcccgggttcacgccattctcctgcctcagcctcctgagtagctgggactacaggcgcgcgccaccatgcccggctaattttttgtatttttagtagagatggggtttcaccctgttagccaggatggtctcgatctcctgaccttgtgatctgtccgccttggcctcccaaagtgctgggattacaggtgtgagccaccgtgcccggccgagacagggtcttcttatgttgcccaggctggcctcaaactcctaggctcaagcaatcctcccatcttggcctcccaaagtgctgggattacaggcttgagccaccacacccagcctcaggcgtggctctaagccctttacatatatgaacttgctagtttattccatgtgtcagccctgtgagagatattcttttttttttttttttttttttgagatggagtctcgctctgtcgcccaggctggagtgcagtgctgcgatctcggctcactgcaagctccgcctcctgggttcacgccattctcctgcctcagcctcccgagtagctgggactacaggcgcctgccagcacgcatggctaattttttttgtatttttagtagagacggggtttcactgtgttagccaggatggtctcgatctcctgaccttgtgatccaccctcctcagcctcccaaagtgctgggattacaggtgtgagccaccgcgcctggcctgagagatattcttattattccgtttcatagatcagaaaattgagactcacacaggttaaagtaacttgcccaaggtcacactgccaggactagtagcattttttctgtacgtcatggtgaggagctgtatatatgtatgtatgtatgtatgttttgagagacagagtcttggtctgttgcccaggctggagtgcagtggcgcgatcttggctcactgcaacctccgcctcctgggttcaagtgattcccctgcctcagcttcccaagtagctgggaatacaggtgtgcgccaccacgcccagctagtttttgtattttttagtagagatggggtttcacaatatgttggccaggctggtctccaatgcctgacctcacatgatccacctgcctcggcctcccaaagtgctgggattacaggcatgaaccatggtgcccagccaggagctttatttttaactttatcttgaaagtcaggtattctgggctattgcctttgtacccttatgtcgggggtgttacaggcccatttgatgatttgatgtagaccctcccagaaagatggaagtatgaacatgcttctgttgcacagtttcaggggagctcctgaatcctctggagatctaggcagaaggacctccaatgtgaggcatcaggagtcattcaagggccttcaacctgggagtaacttcatcagatctgtactattaagaagcatctggcttctgtgaggagtgggattggagggtgaagatacagggcctgagacctgtcaggaggttgtagcaacagggcagaaagagaaagtgtgatccaaaaggaaggtagctgtcacagtagagtgtctgtgaacctcagttttctcctctgtaaaatgggagggtcttgaggattatatacagcaatgcatatatatgatgtatatgtatgtttgtatatggattgatgcatataaagtgctgccacatagtaaacacacaatgattgtcaactgttactaatgtggccggcttagtaaattgtgcagctagtatttggctccaggtctacctcgttaaccatggtgaaataatgagattagattgctcaggagtctcctcctctttccatcctcctggcctcctctctcctcaatagagcccctggggtagtcgggagacgggagggatcagttgctggagtcctgacatgatttttccttctccccagatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgtc

SEQ ID NO: 118 - DNA, 3309 bp, Homo Sapiens
tcctctcacttttttctctctcagtgtatgcgtagattcctaatcttttcaagtccttaagagaaagtatataaagctctaatgctggtttcatttattcaaacactacaagtatctaccatatgctggacactgtgctaggcttctggaaataaaataaatgacagatacggcttccactttcatgttgcttttgtttatacccttgggcattttacttaatcttttagcgtatattcataagaatacagttttggtgtgaagattaaataagattatgtatgtaatgaacatatggagactaaaataacagaataataaatggtaagtataaaatagattttaaaatgttatttcttaagtctattgtcaatctttacaattttattgtaaatcatagtgtgagatacagctgcaaatatagggaagtaagttcacaaactgttattttctaaagctaaagctaacattaggccttgctatggtagaactcttcactgggttgtttcttaaaaaaaattcacgcaactgacaggaggaattgtctttattcttgcattaatgataaatgtaatctacaagatggccttcatggattagaaaaaggaatcagaccacaaggaaaaagaaattgctggttttcactcaagatttatctagaaaagtgtactgactactggaataatagtttacccctgggttgtaccacagaatgagaaattctacaagattatacaactctttttctacaagattacactactcatattgtttttattccattccggaattagaaattaactttctaaatatcatttttttctccaaaaaaatcctcttaccagctaacctggatatggacaaaaatatcttgattgctgtaaaggtctatctccctagtaaaaatgaataaattgcccttgaatttattcaaggcaatcactatcagctgtggaacacccaggtaaactaacacaactaggttcctacacacaaaacaaatattctaaactgtttccacagggcagccaccaagggaaaaataaggaaatttaactattttattctaaacacttcatttacatataaggcaactgtggccccaaggttgtgatttattaacctagttaacggcagaagctgcactaaaacctggatcttctacttaaaatgttgttttggccaggcgcggtggctcacgcctgtaatcccagcactttgggaggccaaggcggacggatcacaaggtcaggtgtttgagaccagcctggccagcatggtgaaaccccgtctctactaaaaatacaaaaaattagccgggcatggtggcctgcgcctgtaatcccagctacttgggaggctgagtcagaattgcttgatcctgggaggcagaggttgcactgagcagtgatcacaccactgcactccagtctgggtgacagagcgagactccatctcaaaaaaaaaaaagtttgattcttttatcatcaagcattaatttaatatccaaaggcatatattcgtatttactgtgctttaaacatttgtctgtgcgtcaatgctttaaagggacatactatgtggtgattcattttcaaagtaagaatttgcagaaaatgagaaacaaactttctgaacaatacaattttaatgcatactaaggctggttaactggttagaatactaggttaacaaggccaaactccagataggccaacagcttttcaaaccaatattcctgacactgccaggaataaagaaaactcttcactactgagggagggacagaaaacctagaaaaataaaccatactaaaagaaaaagggtattttgtttgtcactttaaagctgctttttctttaaacggtacacatattttcaacattcttacaaatgggccttctattaaaaagcaaactattgctaattccatggctttaagtggagtacttccaatcacttcctctatccagaaaatccgtgacactacatgccagctactttgcatatttataactgtttaataaactattcaaaattagcatctaaaataattatactttggacacacgaaggcatatatttggtgagaacattgtaattttcattttgtaaactatatattctatattcaagtaataacacagcattgcctatacagaactgaggcctgcgctgagacccaaaacttgtcttttcctaaatgcaccactacgaagagctaataagaggtctgtccagatgctaagaccaggtacttcaaaatctccatcctgcgctttacaggtctccagggcagttagaactttatctttcagaggtggaggggcctgacagaggctttgaaacctattgtgcaactcctcccagggcacatcttgggactcagttccaacccaaatgcctttctgaaggtcatagtgcaaacgttgaccccagtctgttagcagacccagatagacaggagacagcgctgggtggcggctagtcactaaagtcaaaagcccggctgggagggcgcgacaaaaggcagcaaagacttccgaattccccagaagccagtggactagcacttggctcccctctccaggtgatttgtggatgccgggttccaactcttcttggggccgacgagacaaaggcggctgcaacagcgccaccgctatcaccttcaggaagttgttctgaggcaagcgctcccacaggctgctgagaaacctggcgggacgctccgcttcggccttccccacctcctgcagacgctccagcagcagctccgcctgggtcttcatcagagagtcctcctggagatttgggttctctctatagccattgaagcgcagcatgtgcaccgcagaccgccggcgggcaaggcgggccaggctctcttggagtgtctcctcatcggcgtcccggacgcccgggccgggaaagagttgctgcaccaggtggtaacgagctgcatccccgagggcccggttctccagcaggcgcagagagagcaggacgtcacagtgaccgagggcctggaagttcgctaatcccggaactggaccccgcccaaagccgccctcttgcctccactggttgtgcagccgccgctccagagccgtgcgaatggggccatgccgaccaaagcgccgatggatgtggcgcaggtagcgcgcccactgcaaggcccggcgcacggtggcggggtcccaggtgctgacgtaggtagtgcttgagaccgccagaagctcggaaaagcgatccaggtgctgcagaagggattccatgaggtgcgcgaaggccctacttccgctttca

SEQ ID NO: 119 - DNA, 6179 bp, Homo Sapiens
ataaatatgaaattttactcgacaacagaaaaggagaaacaggaaaaaaggtgcctcgagcaaagtcaatgacttggtggtggcagagattgtttcctccaaaacgagaatggtagtaactagggcaaatttcacaggcctaccaccaatctcaccagtccaggaattatataggaatggtcacattcctaatgatggtgaagcagaaagccctccccacagagagacagcccactggggacccagctcaagctcttcaaaacgtggcagctacaggtcacaagactttggcagagatgtccgaaattcttcaaggaaggcgtcacgatcagagggacggatccagctcaaatagctttctaggtacagggggagagacctggagagaaagaaggatgatgcctaagggtgaaagattggcagaaagctgggcagccatacccccgctttcagtgttcaccacccacaataggtccaaggactctaggacaccaactgcccctcagccccaagccagcaggcctgagcctcaccacagagcatcttcatgtgaccccttagtttgggcctccagcctccaccagagtgcagtggcctcatccctccgatctagcctcttcagagtctgaagcaggtgaaagtaagtgtctcgattacctgtagccccagcccagagtacagagtcttagaacttgacatagtcttaggcattgttttataaaaagggaaactgaggcctagagagaggaagtatcttgcctacactcacatatggaagcgggggcagatcattcacaaccattcccatcccagtgtccatcatctgccccctactcctgtgcaacccacaacagcagagtcatggtctttgtgtctgaggatatcggggaaaccagggaactcttgggagccctgcatacacactgtgtatatttgaacacctggatatatccctaggtatatatagcacaaccccaatcacccctcctgtctgagaacaccactcttacacttacgcccaagtatttcccatgggcctctctgtccttgcacatctatgcatagccgacgtcatgcaagtatacatacctgggcacatctgcacactgaggaggaagtcctgtaaggctttggtatcctggccgctggctacccattccagtccacgactaattagggcggctgcccgaagctgctgcagtgccgcatctgacttacatccctgctcacagttgaaagctgcccctggggaccactcccaaagtcaagaagtgtcttcccagcctcacagtcaccaaaaccccaaatcctcctctatttcttcttgtgtccacagtccctttctcttaagtctcctggtgggctgggacacattaaagggaacccacttccaccactaccacttccaggaggtaagaggaaaactgaaagtttagatcaccttgttctttttcctcaggtgtggcccggaagagcagctcgaggcacctgaagtaggacacagaacaggggtgaagaggaatcaatttcagaaactctagggtaagtaggtgaacatggagctcaccaactcaggtcccaatcagaaaatcatccctccacaccccctctaggaccccgggctcacctgctaaattcactaattgccactttttgggcacccagttgaacccaggcctggccctgaagcaggtgggtggcagagacccagagtgggcagtatggcagttccttggttccttttctggcatcttcccacagccgggacatcttgggtagcagagatgatgtgcggctgagcaactcctcacatagagtcaaggcatcttgggctctgcctgcctggatcagtgctaccgctgcctccaaaaacacctcaggcatacagggccctggaggggaggggggtggggagaactggagtgggaagaagaagcagtgtcttgaaaggcatgagccaccatccccaacctcttcaccaggctctggtaccatgcagagtcctgggcccccagactggacagacagaatagaggaaaaaacaaaaaattgcagtcttgctgtatttcaaaggggacaccaacccgtctaccccattgcagagaagcttgaagacacacccacccttggctccgagctatccagcaacagggccagcaggtccaagtaatgctctgcagcgtctcctgccctgaggagtaaaagcccataagcctcaccctaggccctagcagggaacctgcaagggtcctgagaatgttctctcttagctaacagatggatgttcatgggccctgaggaggagaaagggagggaaggtcttagggctccaattttggctcagtatggatctaccccagttacagaatggactggggaagagacttcagagtgtcaaagatagagaaggttaatgtcttagagaagagtcctcagttcaggtctagaagcaaggtaagaggctgaggagtggcgacctatgtcctgccactgcctcattcatcccccaagtcacaagaacaaaagcagagtcacaccccaggggaggcatcagaagtgggaagagaagctcaggtgagcaaggggaacctcacctccccgtctgtaggcacctgcttgctagtatgtgcttggtctggctctgagtgccacaatgaaggggtgaggctaggtcaggtggtggcagtagtaattctacctcaatgagaaactgcggggctttggaactgcatgggacattcaaggcctaaaagagaaagaaaaaaattgtatctataatctttgggagccatacttccttatacttggatcttgactagtcaagtcaccccatcacaagcacctcaggaatcctccaccccacatcttcacctggcagttccctacctcaactagcagctccagactctccagctctgctgttgtgtcccccagttgctgatagagcctagaggcctccagaagtggaggaccccaggctgatccctctttcagggctgcaaccaagtacaacagtgctctctgtggatttccctaaagggataggaggacacgggcctcagctacccttacaaagcaaaaagctatacataatgcttgtggtttccccaatccaccctaggactgtctttaccatcttacggtgacaggaccccagtgctgtgtacacctggaccaacacaggccgtggacacaggcctgaggccgcttcatgaaggctgcttagtgccttgtctgggttccctgtgatcagctcctggagacctgaggacagtcagggtgtgagcttggagagggctatagagcaggggtcatgatggggaacaagggtctaagaagcccatggaactgaatgggacaagagagagggcatgagtctggaggaccacttaaaggtagaagagatgagtcaggttgctagctgaccttggcggtaggcaaatgctgtcaggaggacatccttcaatccctgggcatcctgcagggtcaatggagcatctaattcctcagctgggggactccaagttttcagaagtaacagcagatccttagaggctccactctggggaaagaaggacaaccagaagctccaagcctacaacctcctcgtcttctcctatctccatctatcctggctagaccttgagctcaagggtcctcttgatccttgaggacacaggcctcagctacccttacaaagcaagaagctatgcataatgcctgtagtttcccccaattctaagagatagatagctatgaggcaagaattaaaaaaaaggaagaaaaacctggggcagtgatgatctattccagcgtgcctcctcactcagggcaaggaccatatttgagttactaataaggagactaaggctgagagctgacttgagcaagatcacaagagccctatccctatccaaaaaaaaattttttttttttttgagacagggtctccctctgtcacccaggctgcagggctggagtgcagtggcgtgatcatagctcacaactcactgttgcctccacctcttgggttcaagtgatcctcctacctcagcctcccaaagtgctgagattacaggtatgagccaccatgcctgtccaatttttaaaaaacactcctaagagaatccccacaatgagagaccaaccagggcaaggtcacccaagagtcccagagagaatccaggttttccgaccaccaacccagccgcctgtccagtacatgatgatgctactgcagctggagagaaaggaggaggaaggaaggaggagaccctcagcttcaggtcactttccctattacctggctgccattcagggtctctagtaacaaggccaggtccccaagacggtcagcactcaaccagagggcagcctgcaggccaaccaggcggtgcagggcagacagcagctccggcagaaggcaggaagcacgaaggacagagtcccacagctccctgagcccctgttccaacctgggcccctgctgctcctgtgtctccagcactgtagagtatacacacacacatagacacacacacagctgaagtagcacctcatcctccatctccccacacactctggctttcctctcctgcaggaccccaaaggtcacaataataatacctcaacctggtctgaagagcacagagaagggcacctctctccatggaggtgacagatgttgtttatcctcccatctccctgcaataacttaaacccagactgaagatggcaggggaatcagggacaatctctggccctcacctctctctaggctccgctggatatcctgggcctgatcctctgtgaaaccctgggccaagcttgccctcaggataatgaagttgcaggtgacagtcagctccaagggaagaacaggaacagctgcagggagccctggagcaacaatgttggtcttacagactgctcccccatggaagatcctccaaataaaatcccaactcagagatcaccccactccaaccaaaacagctacaataaagaacccaccctccagccaattagctaaggatttaaaaaaagaacccaacctttggacagagagtctggaaagggcaaaaaagttatccagatcagaccatcttggaaaccatttttcaaatgccactctgtgagtgtgtaaggaagagagggatttgcctgtacaaagatgattccactccagtctcctctgtgccttaaacaggactccctgccccgagtaattatatcgatcccaaaaacgcaggagcggatgtttctctggctatggaagaggggaactgaccatcctggggaggacccgcctaccttgcagactatggaggagccctctgagcccttccagtgcatcctgagccaactgctgtcgcctcagagtcagaccggagttctgagccacctgccacatgagggaggggttgtcactgaggatcaatccttttttctccccttgcagcagtggcaagggatgcattctccagtcatttctggctctttggtcaagctcagtccctccccatcggttggggtaaatccactgcaaacccgctttcagggatcttgaggctgcaaaccgagggtgccagcaaccgtgttaccttggcctgtcgaacgagccggtcattcttttccctccacaggtccaggcagctggagcccacagaggtggtctggcgggacatggtggccgaggctgggcccggagaccagaagcggacttaggaagggtgaagctggcctgcccaagctcccaaccccagcggggaggggcctgggcacttctgcaccccgccgagctcccctgcttctctcggggtcccaatccacccgcccaggctttccaggacagatgggacgctctctccccgcggcccgccgggctctcaacctcgcctctggttggccgggtctgcgaagctctgggctgcggttggtcctcttgaagagttagttcccgcgggaaactcggggaggaaacgagtcagcaaccccaaacaggcttaggcgggctagaagccggggtcgtgtctgactggggcagtcgcacggccggcggtgcggcccgctcggctctcgcggaggccacagcctcgagaaagggtgggcgggagcgagtttcggccccacagtccgtggctcggcccttcctcgctgccacacccccaggtcctcct

SEQ ID NO: 120 - DNA, 73179 bp, Homo Sapiens
gggggcggatcttgttgttacgggtaacggaagtgtggcggcgttgggttgagcgggctttttggaagtttgtggcggaggtgaggccgaggtgactgcagagcggctcgcgaggtgctcgggctgtgggactgggcccctgggagggagcggttctgtgggggaaaggaggctcctgtcctgacttggcgttctggtattttctctggcgtggaaagtaggcgcgctccgctgtctcccgccgcctgcctcagctttcgcggttccctcctaggggtgtgcctcagtcggagccccttctgttaaattcttcccccttggccgagggtgagctcttacttctgagaaatttcccttaaccttgctttgcatttgttgtccggtcgcggtctccatcaccagctgcttcgtgttatagtttttgtatttgcgctcacggcttgttaactgaagaacccggaagggaaggccgcggcgtttcccgccggcggggctctgccattctcggatcttggcttcagatctctgatgctccccagcgtctcttggcaaggaatctacttcgcgttcagggaattcacagccacccgcctctggtcttacctctggttttaggatgattttagcaaatgtgcctaggttgatttaaacgtatccccctccgaagccgcctgccccttctggctggacacctttttaggttggtgtgtcctgtttgcatccggtagttcaaagcatgggatcttggagtccggagctggacagactcgggtttcacttctctctctgccacttggtagccttctaatcttgggggaaattccctaatctctgaatcccaaaagttgttcatctaaaatggggctaatattacacctacctagtaggtggtgttgtgggagtcatgttaatgaatgtaaagtgctgggttcagtgttttccctattataggggttcaataatttgttcaacaaacatttgttacctagtttgagctaggtactgtgctaagtgctggagatacaatgataaacaaaaccagctacggcccgtgtccttaggggacttatagtctagtgggagataacatttgttaatctgataattacacatgtaatattaaaaattggtgacagtatgtaagagagtttactggtgccatgagaggatgtactaggggaacgtttaacaacctatactgagcttttcttttcttttcttttcttttttttttgagacagagtctccctctgttgccaggctggagtgcagtggcgcgatctcggctcactgcaacctccgcctcctgagttcaagtgattctcctgcctcagcctcacaagtagctgggactacaggtgcgtgccgtcacgcccagctattttttttttttttttttttttttttttttttttttgtatttttagtagagacggggtttcaccatcttggccaggaaggtctggatgtcttgacctagtgatccgcccgccttggcctcccaaagtgctgagattacaggcgtgagctactgcgcctggcctagactgagcttttgaggagatgtggattgagctaagatctgaaggatttgtaggaattagtaataaaagattggggggcagtggatggaagcaggaatatttatttaagttccagatggaaacatgtggaagggcctgtggcagaaagaacttggagatttgaaggactggaagcaattctgcatggctggagcagagtgatgaaagggaggtaggcatgggtcagaacttgcaggacttattttatccttacttaagggttttggactgataaagcaatggaagccactgaagagctttaagatgaggatggcatggagggaagataagtcacataatcaggtttgtgtttcaaaaacatcactttagttgctgcgtagaagggaacaagttaggaaacgattgcagtagttcaggtgagagatggtggtggcttggggtaatgtgtcagtagtggagatggagaaaagtagacagatttgggagatatttagtaggtaacattgacaggacttggtaatggatgtggtgaaggatgaaggcaaagttgttaagaatgttacctaggtttctggtctgagcagctgagtggatgatggtaccatttatggagacgggaaacacaggaggaagaagaggaggaacagattttctttctactaggctgtacttcccccttctattttcatagctactcactgaattctatctgcttcatgtgcctccatttcatcccatcttttctgttctccagtcaccaccctagtacaggtctttatcatttccactaaaataacttccaaatggtctcttagcatttgctgtttcttcttaccttctccccactttaatctgcacaaagatgctaggttctgtttcctcaaacacttgcaatcttgtgagattgtcttttgctcaaattttttaatggttctcagtaatttacgaaatagaatctaaattccttaacctgtttacttccagcctatctttccagacttcctactcactattttcctacttggattctacctcagccattttactcattttcccccaaagaaatttctcatttcccgtatgaatgcctttgttcatgatacccttctccataatgtatacaacctggttgtctggactacctatatttaatctctaagttccagttcaagctttcctctgctgcgaaaccttgacatttaagaacacagttacatcttttaccttgttaacttctcagcttttctttctttctttcttcctttcttttttttttttttttttttgagacagagcctcgctctgtcgcccaggctggagtgcagtggcgtgatctccgctcactgcaagctcctcctcccgggttcacgccattctcctgcctcagcctcccgagtagctgggactataggcgcccgccaccacgcccagctaatttttttttgtatttttggtagagacgggggtttcaccgtgttagccaaaatggtctcgatctcctgacttcgtgatctgccctcctcagcctcccaaagtgctgggattacaggcatgagccacggtgccggcctctttttttttttttttttaagagacagggtcttaccttgttgcctaggctggagtactgtggcatgatcatagctcactgcagcctcacactcttgggctccccttctcacttgtttttataccatttaattggcacatagcatttatagtgctattggtttattcatttatttgtcaaatactttattacatgcttatggtaatatataatgtattacatacttgatatgctgttaaatggaagctttgttctaggtagtatggtgagtagatggtaacaagtgtgggcaaaaattatgaaaccacttgattagaatacagattcctaataaggcaattccagggaattttcaggattattttggttaggttaagaatcatcttgccactgagcttaagaagaagaagaaaaaagaatcagctacttaaagatagtcctaagtttgttgagcacccattgcataataggtatgaaatattcagttaacagggaaggaaaacaaatcaagtttgtttatttctggaatcttcacccacctctgacgtttttcccttgtagttctgtgatatgagcaacaatggaccagaagattttatctctagcagcagaaaaaacagcagacaaactgcaagaatttcttcaaaccctgagagaaggtgatgtgagtattaggaagcatgttctgctaaaagtaaatgtcaggcatgatgacacattcaaaggacatgtgagaaagaaaaattacgctgcttcttcatctactccccattcactgtaggagacaaggatttatttaataataatttatagatgtaaagaaattggggtgagggaatgagagaaatagactacttgagggcatttgtgaccaagtttaaacctgaaatagtttaagaatagaatgcttttacaactgtatttataaaagcaattagtatacttttatggtcctcagaacaatcctatttgatgataatatccagactatagttactgattgagacattagttttgcattttgatgcttctctgtatttttccgtaaagaaattaagtttataagcggcaaaatattttgaaattattagtaaaaattagggcctctgttttcactataagtgtaggattataaaatgggatagtaattgccttatatgttaggctgtttcttctccctaatgttctttctcagctgatatactgctcctttttccataagtgatctcatcctatccaggtccctgcctggaaaagaatccctcttcaaggtatatgtacaaacaagtaaagacattgagtatcatgggatttttttcctttttctgtcaattgatgagtattatgtttttaagggaatttctttgtgttaatgttgtagttattgaaggaaggtgcatcttagtgtgtgttatctgacatactaactaggaattgatgcagtgttgctctttgatttttttttctttgaaattatccaagattgcctttatagctattttttgagatgacttgttgcatgagttgtaacttgaatcattctatagacaagatttgattgaaactagcatttaaattatttatttaaagtttcatgcctcaaattgaaggcgtgaacactgtcaaattgaagacagtgttccagatgttttctgactctaggatagagtaatgctaatatttccctcatttttccattaatgcaaaatcagctttttggcagcaacattatattgtagtctcattgctcttatatttatttttgtatatgttgataagttgctaagtttcctttatctctgaagtccttttagaatccatgttaaaaactatatataggccaggcatggtgacttacacctgtagtcccagcactttgggaggattcctttaggccaggagttcgagatcagcttaggcaacatagtgagacccagtttctaaaaacaactaccaaaacaacaaactttatatctgttaactgtcaccttttttagattcatcttgttttactccatcaagatcattttgtatgattctgctgaccgtattaatcagctttttatcctctacaaatttgttaagcatgtcagtaatatatgcaggcagttcatttgataaaatgtcccacagaagatgaactcagagtaaaaaattataaaacacataaagaagtcctgtggcaagaaagactcaaacagaaatgggaaaattcatattcaaggatttagagcaatctgaaaaaaatctttaattatttaacacaaatacttaatacagtatttaactttatttatttaaaggtgggatctcacccttgcacaggctggagtgcagtggggcgatctcggcacactgcagcctcaacctcctgggctcatgcgatcctcccacctcagcctcctgagtagctgggagtacaagcatgtgccaccatgtccgactaatttttgtatttttagcagagatggggtttcgccatgctttccaggctggtcttgaactcctgagctcaagcaatccacccacctcagcctcccacagtgccgggattacacgtgtgagccactctgcctgacctagtatttaaaatatttgaagatgtaaatgaaggaatagaactcacaaaataagggatggatttagaaaacaatgaaagacaacttcttgaaatgaaaacctcagtaggtggtttaacagtagacaaaacattgctaaagagaaaattagtaaagtggaatacagagctgaggataactaaataaagcacagattgtaaagaggtggaaaatataaagaatatttaaaatatatgcagagaactttgataagaatatattatcttcttaaacacatagaatgttcataaaaattaatcacatgtcatatactagagcacaaagaaaacatgggtaggtcccataaggtagaattattacaaactattctctgtgatcacaatgcaataaaactggaaatgaaaaccgaaactaaaagtcaaaaagcaaagacacttttacttggaaattaaaataccttctattcaaccattgtggaagacagtgtggcgatttctcagggatctagaactagaaataccatttgacccagtgatcccattactgggtatatacccaaaggactgtaaatcatgctgctataaagacacattcacacgtatgtttattgcggcactattcacaatagcaaagacttggaaccaacccaagtgtccaacaatgatagactggattaagaaaatgtggcacatctacaccatggaatactatgcagccataaaaaatgatgagttcatgtcctttgtagggacatggatgaagctggaagccatcattctcagcaaactatcgcaaggacaaaaaaaccaaaccccacatgttctcactcataggtgggaattgaacagtgagaacacttggacacgggaatgggaacatcacacaccggggcctgttgtggagtgaggggaggggggagggatagcattaggagatacacctaatgtaaatgacgagttaatgggtgcagcacaccaacatggcacatgtacgcatatgtaacaaacctgcatgttgtgcacatgtaccctagaacttaaagtataataaaaatatatatatatataaaaataaaaaaataccttctaaataactcttggaggaaaagagatacaaacaaattacaggatttttgaagaataattacagataacaaaaatactacatgttaaaaatccatggaataatgttaaaaacaagtgtttaacaaatgaaataatgaaatcaatacaaatgaaataatgaaaataaataaattcccaactcaaaaacctagaaaaaagagaaagtaaacaacaacaaaaaaacacaagaaactactaaagataaaagtggaaattaataaagtagagaacagaaaaatagtggatcaaattaatcaaaatcttggttctttgtgggggaaaaaaacaccattaattaatataataatcaaaacagtggagtaaaaacatgcacaaaatgagaaatgacaagggagaaatactgttaatacagagaaaatctcaaaaaatactgtgagactacagtagattcctgtgcaaataaatttgaaaacctagaggaaatggataatttcttaggcacgtacagtttaataaaattgagccaatttgagatggaaagcttaagcagaccagtttccatagaagaaaagagaaagttatgaaggaactacttcgtacaaaaacaccaggcccagatagattggcaggaaacttctgtcaaacctttagagatcaggtagatagtcctaatgctacataaattgttttagagcataaataataaaggaaaacttccaagttctttgaatgaagcaagtataacattgaattaaacaaatataacattgatttttttatgctatctttatcaggtataaccttaaacctcataaagatagcatagaaaaaagaggatatagactaatgtaacttacgaatattgatataaaagtcttaaatattaggggacagattgcaacaccacatttaaaaaaagtacaccatgatcaagtgggatttaatagcaggaatacaaggttggttcagtatttgaaagtatattactataaagattatacgattatcttcatggatcagagaaagcctttgacaaaattcaacactcattcctaataaaagcttgagaaaaatcagaatgggtggctgtttcctttacatcataaaatgtatatatctaaattctagagtcagcatcttagtgggaaaccatagagacatttcctctaaggccgggaacaaagcaatgatgcctactgtctccattactatataatgttctgattggctagcctatgcatttaacctagagaaaacaatcacaggcataataatggaaaaataaaggctgagtgcagtggctcacacccataatcccaacgctttgggaggccaaggtgggcagatcacttgaggtcaggagttcgaaaccagcctggccaacatggtgaaaccccttctctactaaaaatataaaaattagctgggcgtggtggtgtgtgcctgtaatcccagctactcgggaggctgaggcagaagaatcacttgaacctgggaggtggaggttgcagtgagcccagattgcaccattgcacttcaacctgggtaaacaaagtgagattccatctaaaaaaaaaaaaaagaaaatataaaacgtctctctttgtagatggcatgatagtatacctggaaaaccctggagaatctgtgataaaaccatctataaacgaattcatcaaggtagcagaatataaaattaatatgcaaaaatcagtagcattcatacataatagccagttagctcacgcctgtaatcccagcactttgggaggccaaggcaggcggatcacctgaggtgaggagttctaaactagcctggccaacatggtgaaacctcaactctactaaaaatagaaaaattagctgggcgtggtggtgcacgcctgtagtctcagctactcaggaggctgaggcaggagaattgcttgaacccgggaggtggaagttgcagtgagctgagatcacgccactgtactccagcctgggccccatttacaatagcaacagaaaagttaaaacaggaataaacctgagaaatgtccaaaacccatgcgaaaaaaaactatgaaacacttctgaaggacaaagtagaaaactaagaagatatcccctgttcttgattggggagtctcaacatcacgaaaatgtcaattcttccaaagttaatttatcaatttaataccagtaaaaatcccattgagctatatatataagttgactgcaaaattcatatagcaaattgtacacacagggatagttagggaaaagctgaaaagagctctgagagaggattaaccatagcagagactaaacaccacaaaaacttttataaataagagtgcagtactggtacatgagtagataaacagaaacggaataggatacaaagaatagaataggtaatgcataagaatggaaagtctcaaaatagacccaactacaagtaaaatctagtatataataaaattacatcttaaaacactgaaataaagataatctttgacaaatgatattggaacaactggatggacatttggaaaaaatagatgaaattagatgtgtttctcatattcaagagaaagctccaaatgaatcagaaatttaaatgtaaaaaacaaatctaaataaatgttagggctgggcacaggggcttatccctgtaatcccagcactttgggaggctgaggtgggaagatcgcttgagccacgaggttcagattacagtgagctatgattgtgccactgcacttcaacgggtgaaagtgagactctgtctcttaaaaataaataaataaataaataaataaataaataagtatatgttagaagaaaacatggatgaatttctctttaagctcagtgcagtgaaaagctttctaactgtcatacaaagtatagatgcaagaaaagataagtttgtctacatataagttaaaaagtttgtgtggccagaaataccataagcagagtcaaaagacaaatggcaaactgggaaaaaatatttgtaacgtatcacagaaaaaggattaatatccctaattcataaataacttgtgggggggggggggaagataaactgtattttaaaaaggcaaaaaacatgagaataatcactaaaagatatataaaaatggccttaaacataagaaaatatgctcaacttcactcataataagagaaaaataaaataaaagatagtgatccacctgccttggcctcacaaagtgctgggattacaggcaggagccaccatgcctggccccatgtatatttttatgtgtataaacatgcatacatttcctggctctctccaatgaaagaaccatgaagcaaagatgccatagttgctcggtgcggtggctcacgcctgtaatcccaacactttgggaaactgcgtgggtggatcacttgagtccgggagttcaagaccagtttgggcaacgtggtcaaatcctgtctctataaaaaaataaataaataaattttaaaaagatgccttagtaacaacaaacacacccatcacctagatctttgctgtttcataaccattcctcactcaagggaaccagggctcttcagagaaacggataagtttatgcgtgggcaggatggatacaagatgaacctggaacatcttgctataccagaaagtaaagaagtgctcaaaaaagacagtgggggcgtgtcacaaagacagaagagccagcttgaagggtttccctttggccaaatctgggactatttgagcatcaaaataagttcaataatgaaccattgaaaaatacagagatttataagtccatactcataattaataaataaattactttgggagttcgaggacggaggatcacttgagtccaggagtttgagaccagcttggacaacatagtgagaacccacctctacaaaaaaataatttaaaaaattagcatggcatatcagcacacgcttgtattcctagctaactggagggttgctgaggcaggagaattgcttgagcccaggagtttcaagttatagtgagctatgactgtgccactgcagtccagccagggtgacaaagaagactctgtctctaaggtaagtaaagtaagtaaatgaatacatgggtagaaaggagttctcttgcttacagtgcaggagttggaaaatcattcctttgcaattgtaatggtaaagattgaaccagacaagaaataccaatggatgttaaatccagggggactttaaaaacattgatacgatacaattaatgaagctaagaaccttattccaactctccccagtaattatttcactaatgttctctttatgttccaggatcccactcagcatcctacattgctcttagttgtcatttccccctgatttcctacactctgcaatagttctcagtctttccttatctctgttgatcatgatagccctgaggagtattgattagttgttttgctgaatgtgtctcatttagggcctgtttggtggtgtctcatgattggaccaatgtcttgtatccctggcataaggaccacagaaatggtaccatgccctttttagtgtatcaaatcactgagctcttgatgtcagtgttattcctggtgatactgactttgataacctggtaacagtggtttctgctgggcttttccattttacaggaagaaaattagatgaggagcaagatatttgcatgatcttaaagtgtctccctataaattgcttactggtggcaaagggacagggtgggggaagtaattataaagtgggatcagaatatcaccaatgagggacagatggacatcatgtgcttcctgatgtgatactccgagaatgacatgatatcacctgtgttcttgtgagaccgcataaactcaatctagccacaaggaaacatcagacaacacaaaatgaggaatgttctattttttaaaaactaaaatttatttggattatgctgttaacttggtagttacagtctgccaattaattttaaagccttctgaggtaacagggatacttaaatcttacttgctctatttctgagttttaaaatgtagtaaaaagcataactgaacatggtcaaaagaaagactgaagatcacataagtggaaggaggaagaaggggagtagaggacagagtcaatagaagaaaattaacattcgttgagtacttgtcgtgtgttaggctctgtgcaaattcttctcccctttatctcagtcctttgaggtggggaaatggacacacataacagattaagttgcctgaggttttatagctagtaaatggcatagctaggatttacatccagggcttctgattctggatccagctttttttccctcttcctatgccacactgctttctgttgaaactgaactatttcaaaaagagtcaacagcttctcagccttggcagtgctcacgttttggctcggataaatctttgttgtggtgggctgtccagtgcattgcagaatgtttgatagcatctcttacctctacccactagattccaacagcatccttccagttgtgacaaccagaaatgtttctagacattgtctagtgtcccctgggggacaaaaatcactggttgagaactgctgctctaagggttatgtcaaggaccaagtactctgttggaaggtataggcaagagtagtcagatacttctttattatatatttaatagagagatggactccagctagaaacaccagcctcatgtacttgtggaagagagagtttattgttttattagtcttggcttctgtgacacctctctctcgagattatcctccaatgttattgacttcactttctccattgtctttgctggcagctgcttctctttttaatgactgactcttggtgtttctcttctttatattctttcctggatggtctcatctgtttccattgatgctccacttggcatatttcattgtcatctatttggcacttccacttggatatctcagagtagtggttctgagcctcacagcagacccgaatcataaactgtgggtagatcctggaaatttagtaagctctcagggtgatttagatgcttccttaatcccaaattttcagcacgtaaacagatggtgccactatccaccagctagctgcttaagccagaaatttaggaatcctccttgatttctttcttttttgttgtttttttttgatatggagtctcgctctgtcacccaggctagagtgcaggggcgtgagctcggctcactgcaagctccgcttcccgggttcatgccattctcctgcctcagcctcccaagtagctgggactacaggtgcccgccaccacgcccggctaattttttgtatttttagtagagacggggtttcaccgtgttagccaggatggtcttgatctcctgaccttgtgatctgcccacctcggcctcccaaagtgctgggattacaggcatgagccaccacgcttggccagatttcttttccttcatcaccaccccctacttcccttccaaactaaggaatttctattcttagttctcaaatatttatcttagatctatctacttttcttcatcgcctgtattagtgtgctagggctgctgttacaatgtatcacaaattgggtagcttaaatagcagcaatgtaatgtttcacagttctggagactagaagtgcaagatcaagtgttgtcagggttggttccttttgagggctatgagaatttgttctgtgtctctcacctagcttctggtggtttgttggcaacctttagcattccttggcttgtatcacctgatatctgctttcatcttcacctgacattccccctgtttgtgtttctgtgtccagagttcccctttttataagggcattagtctttggattaggacccatcctaatgacctcaactaatctcacctacaagaagagcccaatttccaaataaggtcacattctgaaatactgggggttagagcttcaacatatgaaatttggggttgtggggaggacacaattcaattcataatgcctctattactttggtctaggccactgtcatctctctcttaaacatggtagcagtctactaacaggtatccccatttcactcttaaacccccataactcattctccacacaaggagcaaggatgatttttgaaaaatctatcatcccatttccttcttttctctttagtaacttccgttgcacttagagaaaagctaaacttcctaccatggcctgtaagattcttcataatctggtcctttcccgtttctcttcaaactcatcttctactactcttttctttattattctccagccatgttgatttttttttttttaagcaaggctttggcctcaaatatgccaagttctttgctgcttcttggacattgcacgtgatcatacttccatctggaatatccttctctaacgcctttgaataattagctccttcttgtccgccaggtctctacttaaatgtcacctacttctgagaagcttccccttactaccctagaggaaatttccttcctttcctcacttattgtctatctcagcctcttatttggttcttttacaatttttttctgccatcctttcccctcctgctctgttatgaactctgagtcaaattactatgtctgttttgttcatctttataacatgcctaaggaaaataacatgctcaaaaagtatttgttggatgaatgtatgttcccaacttagtgctaagttataaacataaatgtttatagaatgagtaagaatagattttagtcttgacaatccaggatcatattaagatataccctcctctgtctaaaaattatggtgtttgtaatacttggcgtctctgaatgatctgaacgtgacagaagagtactttttcatattgagtgtttaggtcattggggtaaaagactgttgccagagacttgtacctttttctttctttgcagttgactaatctccttcagaatcaagcagtgaaaggaaaagttgctggagcactcctgagagccatcttcaaaggtaataataattaatgtcacttctgtctgtctcctgcattcattggtagatttgtttagttttcgtacttttcttacggtttgaagccccactggaacattttccatgttttgaggattctacagaatcaactacagcagcagtttcctgtctagtggacttaagtaattttactgaagggagtttgaagtggctacctgagattgcgttgctgatttgggggcctataattacagaatgtgcttttcgtaaaatctgctttggtttacttgtgcttttaagattgtggagaagagaacagcaatgtttaatacataatccatgcttagcaaggggcaagtaacctctggggtttaatgaaatggggtatcttaaggtgccttatatagagattcttcatgcccgctgagacgtatttgttttcttgtcttgaacaagggctagtttaaattgttgcagattgtgatttatagtggttttataaattctggtaggataaaattttacaaggcaaaaattaaaagtgtctttggactcttaattaggtatgttaacttggtttatttttcttcccccaagtaaattagatctctgctgcaagggtacaaaaacacatcttcctattcatgaaagaactttcaagattggttgagtcaacctgtatggaaacttgctaaatattttatagaaatatcagagaaaaggaaataattaaagatcaatagcaactgcctacgtacactactactaaatggaagagcaattctatggcttttagtatattcagagttgtgtatccattaccacaattgattttaaaacaatttccttacccctgaaagaaggtttgcatctcttagatgtcacctctccaaacccctagtccattccagtcctaagaaaccacgaatctactttttgtctctacagatttgtctattctggacatttcatttagtggaatcattctatatatggtcctttgtgactgacttctttcgtttataatgttacaaaggttcctctatgttgtaatatgtatcagtactttatttttactgctgaataatattccattatgtggatatacaacatttttccattcatgagttgatgaagacttaagttgtatctattttctggccattataatactactatgaacatttgtgtataaatttttgtgcggacatgttttcctttctcttggatatatatctaggagtggaattgccggatcatgtggaaactcttatgtttaactgagaaaccgccaaactgttttccaatgtggctggattaggatgccaattttttcacatcctcatcaacacttgttattatctttttttttcagttttgatttattttcatcactttttctacatgatccagatattttaaaatgcaaagaaaattaactttaatgatatgttccaggatcggcactaaaaaaaaattttcagactgcaaatgaattatacaaatgaaaatatcaaatggagatccccttatccaaatgaaagcactcaacttattaaaagttcacaagtatttgtatagagcacattaaaaaagtcagcttgctaaatgttttgattttaaagaacgattgcagaagtctgaagaaaatagattagttattaaatttgggttactggacttctcaaaagctgtaagacctattagaaggttacttcatcctgtaattattaaaataataggtagatgaagaaaagatgacattttagtccctttattttggctaaattaagcactttttcaaagcccttaaccattgctgttctaagcaccgtagtaatcagtcgtttgataattctgtttttttgtatttaactacaaacctgttcgtttttcctatttacctgtcaatgttgtaagacttgtttctgaaccccctgtttaaaacaataaggttccccctgctctgaggaagctggaacacttaggagacgtaagatatacacttgttgtatccagttggtggaatcgggggatttgcagaaagaaatagcgtctgagatcataggattactgatgctggaggtaagatggcaaacaaaaacttttatttgggggtaggtttttgagggtttgtaatttgttgagggaaggaaaacttaagtgcccaacctagcatagtccttatttatgagtaagacctgttgttaaaaaacaaagaagcaggccgggcatggtgactcacacctgtaatcccagcactttgggaggctgaggtgaggatcgcttgagctcaggagtttgagaccaccctctgcaacatggtgaaaccccatctctaccaaaaatacaaaagaaaaaaaattagccgggctcgtggcgcatgtcagtggtcacagctacttgggaggctgaggcaggaagatcgcctgagccagggaggcggaggttgcagtgagccgagattgcaccgctgcagtccagcctgggcagcagagtgagaccccgtctcaaaaaaaaagcagatgaatgggttataatccacttaggtgtatatattacatttctggtaccatggacatatatctctttgaagagctggcatatctgaaaacatcagggaaccgatacaggattctaacttttgaagcccttcacaattataactacgtaccagacagagcagaatgattccataaatcccttatgggaccagttctggatctcggtcaattcatttatttcagcaaaagactttatttcttagaaagatttatcaaacattggatttctgcttgagatttcctttatcctgtgaacttttaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtaattttcttccgactttagtggctttttctctatgcacataatcaaattcattgctcagtatattttgcatttctaggtgtactgagtggggaagaatgtaagaaacagttgattaacaccctgtgttctggcaggtgagtcttgttaatatgtataactttcttaggaatacaagtggcggaaaaaaaaccactttatttcaggaatttatgtctggaggttttaagtccttcttttttgttgtttttaatataacactataaaactatttagtctgcaatgaattagtgagaaagaaatgatttactatattctgtcctctaagactgttcatatagttttatttgcttgactgtatcttcttacagcaatttagtgtgttaagatacacataattaaatgttaatttagtgtgtttaatgctccaatctaagcattattggagtctcaaggtcgtgaaggctgggaaagtcaccctgctgctgcatcttttctttttttcttttttcttttttttttgagggagtagaatatacaagtgatgtatcctttaaccagtaattgtatttctgggaatctacattaaagaatgactgcaacatacaagaaaatcctcacatatgaacatgttcaacacagaaatttgtgaccagtataagcatacagtaatagagacatgtaaactatgtaagttaaggtagagccactccatgacatttatacctattaaaagtgaaatgtatacatcaaagatgaaaaattctaaccatataattaacaaagagattactatgttatataatactgtgattgcgtgtaggtttgttaaaaagaacaagaagggaatacccaagattatctaaaccagagataattgcttttatggttccttacataagatcccttacataaatcattttaagcatgtatttgtcaattaatttgtttttaattacacaagagtttattcaatacatactgtaatataccttgcattttttatttaatacaactgtccatgtcagcatatacaactctacatcattctttttaatggtttgcagtaatctattatttggctaatctacaattgtcagattatttggttatttccagtttttgtgctattacaaagagtgttgcaatgaatgtcttttttaattttaaatagagatgggaatcttgctttattggccaggctggtctcttgaactcctggcctcaagggatcctcctcctttggcctcccaaagtgttgggataataagcatgagccactgcacctggcctgaacatctttatatatctagatgaccttttataagcatgtacatggcatatatttcaaatagtaaattgggtagatctgtgattatgtgcatttttaaagttgataactactgccagcttgtcatacattccctaaaacggtatgtgaatagagtttgttttccacaatctcaccaacattgggtatcatcagaattttgattttgcgagtcgggtaggttaacaactgctatttcattgttttaaatggtatttatttgatcttgtttctcggtattgcaaaatcaaacttgaattggccctgtttttttgtcctcattaattttacaaagttatatctaaataagttgtaaagaaataaactttgtcattttcttctaccaggtgggatcagcaatatgtaatccaactcacctccatgttcaagtaagcatcatcttttcccttttctttgtgtatcctgctttgtgaacttacttgctagaaattaaactatagcaaacgtaaacatcactctctcctgattgtaagaatattagtagttatgttttctgttacagattcacagattccctcctcactcctgcctcctttttggctttacttacttatttaaaacataactttattttttttataagaatgactttgcttaggtaaggttattggttcccttaaaggttcttcattagagaaaaatcaaaagggacagttataataatctattatctctttaattctctgctcccaagtttcatttcttaaaatatgtttaatggaattttaaccactgtaaagccctgaattgaatttctgaaaacaaggcagttagacactgtctatagcctttagaatctttgatccacagggatgtccctctgactgcagaagaggtggaatttgtggtggaaaaagcattgagcatgttctccaagatgaatcttcaagaaataccacctttggtctatcagcttctggttctctcctccaaggtacaaatggaaaattgtttctccttagttctggtggtatgaccagttatgaccattcaacttattcatacccttggtttatatagcagagcaaacatagccgaacatagatgctttcatttcacgtgagcaaacatagccgaacatagatgctttcatttcacatatagtggtttggtctggtaaaaggatcatacttctcatccaaggaaaacatgcattatctcttgtattgccacattttctttgcggaggtaaaagggataaagatctcagaaagggtagactataggccccataaattcttacagtaagaggtatttcaaatcttgtttcaacatgaaagtgttctatacattcttagtttgagtctaagtcatagattatttatttaaatttgtactggagaattctttaagctgaaaactactttgaattcaaattggttattttgctgttaattgggagaccttaccaattttgtattgttttcagggaagcagaaagagtgttttggaaggaatcatagccttcttcagtgcactagataagcagcacaatgaggaacagagtggtgacgagtgagtaatatagtgtagaaataaagatcatttttacaaattcatcttctcattgtgtattttagctatttcattttcttctctctcaccgcctaccttcacctcagcacaaaacttttctaatcttctcttagctactcagtaataaagagaataacatgatctcttcagctctttcattttcacctttccaggaaaataattgtcctataagctgcaagtttaaaacctatttattaggtgtcagctctctgccaggaactgtttagccttggggctaccgtgctgaaccagtcagacaatgtccctgctcttgtagaacttcaattttagtgagaagaggaaagaaaataaataacaagaaaaatgttatagtaaaagtgctatgcaggtaattcaaatggatgatctaccactgacagtatagctactttagattgggtcagggaaaacctctctcagatgtgctattttaactgaagcctgaatgataagatccataatatatagatcagagaacattctcaggtagggaaataatacaaaggcagaagaacagtgtgacatgtctgagaaagaggattttgggttttttttgtttcattttgttttgtttttgagacagagtgtagctctgtggcccaggctggagtacattggcatgatctcagctcactgcatcttccacctcccaggttcaagtgattctcctgcctcagcctcctgagtatctggtactacaggtgcgcaccactacgcccagctaatttttgtatttttagcagagacagggtttgccatgttggccaggctggtctcaaactcctggcctgaagtgattcaccctcctcggtctctcaaagtgctgggattacagacatgagccactgtgcctggccaaggatttttgttttttctttctttctttttttttgagatggggtctcactctgttgcccagactggagtgcagtggtacgatctcggctcagtgcaacctccacctcctgggttcaagagattctcctccctcagcctcctgagtagctgagattgcaggcatgcgccaccacgcccagctaactttttgtatttttagtagcgatggggtttcaccatgttggccaggctggtcttgaactgacctcaggtgatccacctgcctcggcctcccaaagtgctgggatcacaggcgtgagccaccgtgcctggccggattttttgttttttaagcaaacatttgtaggatgttcattctgtgccaggggctattctaagcactttaaacctcacaaccctattttacctctactttatggatatggaaatcgagagacaaagaatttagttagtttggcttgagcaatttattagaggtggtttcttatttcttttttttttttttttttaagagtgtcttgccctgttgtccaggttggagtacagtggcaccatcatagctcactacagcctccaattcctgggctcaagtgaccctccagcctctgcttcccaagtagctgggactataggcacgtgacaccaagcctggctactgttttttttttttttttttgagatggagtctctgtcacccaggctggagtacagtggtgtgatctcggctcactgcaacctctgcttcccaagttcaagtgattctcttgcctcagcctcccaagtggctggcattacaggcacccaccactatgcctggctaattttttttttttttttttgagaggaagtctcactgtgttgcccaggctggagtacattggcatgatgtcaggtcactgcaaactctgcctcctgggttcaagcgatcctcctgcctcagcctccctagtagctggggttacaggtgcgtgccaccacgcccggctactttttgtatttttagtagagacgggctttcaccatattggccaggctggtctcgaactcctgacctcaagtgatccgcctaccttggcctcccaaagtgctgggattacaggcgtgagccactgcacctggcccaagcctggctaattttaaaaattttttctagagatggtctcactgtgttgcccaggctggtcttgaactcctagcttcaggcgatctcctgcctcagcctcccaaagtgctggaattacaggagcaagctgccacacccagcagagaaggtggtcttagatactaaattagaataagctgacagagaatcagattttggagaaaataattagctcacttttttttttttaattagctcacttttgaccacactaggtttgagatatatattagggtcccataaggagatattaagcaggtactctggagtagtagggagagggctgaactggggataagactggaagggactaaagccaagagactggatgggattatcaagggaaagcatgaagaaaaacctaagactgagttcagaggcattccaccatttcaaggtcaagcactttgggaggccgaggcaggcagattgcttgagctcaggagttcaagaccagcctggatgacatggtaaaaacctatctctacaaaaagtacaaaaatagccaggcgcagtggctcatgcctgtagtcccaactacttgggaggctgaggcaggagaatcacttgagctcaggaggcggaggttgcagtgagctgagattgcacctttgcattccatcctgggcaatgggagtgaatccttgtctcaaaaaaaaaaaatttttttttttttttttgagaagaggccagtgatgatgccctggaagctaagagaagaaaatttttcaagaaagaagtagttaattgtgtcagatctgagatgttaattaagatgggactttattgtttttgacaacttggaggtcatttgtgacccttgaaaaaataatctaatgttattgtgggggtgagggtagaaagaggatagaagcctgattgaattggattgtactgggaagagattgtgagataaaaaaggagaaattatgactatacacatttattttacgaaatcttgtaaaaagaagcagagtctgggcacagtgaatcgtgcctgtgatcccaacgttttgggaggctgaggcatgagaatcacttgagcccaggagttcaaaaccagctgggcaatatagtgaaactccatctctaccaaaaaatagaaaaattagccgggcatagtggcacatgcctgtagtcccagctactcaggaggctgaggtgggaggatcgtttgagcctgggaggttgaggccacagtgagctatgatcatgccattgcacaccagcctgagtgacagagcgagaccctgtctcagataaatagatggatagatagatagacagacagacaggagcagaaaattgggcagtagaatttctagtaaacacctgccttcagtgattgtatgagtttagcttgagttggtctacttgctcatcgtagcacctgtccttgtctctcactcaaaaaccatagctcataccttttttttgttgttgttgagacagggtctctctgttgcctaggctgaagtgcaatggcacaatcttggctcacggcaacgtccaccttccgggctgaagcaatcctcccacctcagcctcccaagtagctgggactataggaatgccaccacatcgggctgatttttttgtatttttagtagaggctggtcttgaactcctgggatcaagtgatgcgcccgccttggcctcccaaagtgctggcattacaggcatgagccactgcaccttatagctcataactttctgttgaatcttttaggctattggatgttgtcactgtgccatcaggtgaacttcgtcatgtggaaggcaccattattctacacattgtgtttgccatcaaattggactatgaactaggcagagaactcgtgaaacacttaaaggtagcatcaaacttgtaaggtgatctgggtctcttttgaatgaaagtgtttgaacttaagccactgttatgccagttaatgacaggaaataaatactgtaaaatgaccctgggtgtggaggatctctttttttttttttactttaaaagtggaaaatacatgatgttaccacactcccttttttttaatgtcctcactttagcagtataccacatccttaagcaagccagaaagttctatttaaaaaaaccctcaaaagttctaacgcaaaaaagtgggaaaaaaggtgagaactattcagcaggaaactcaaaatctaattctaagtagattatgtgtcactgtcttatgtgaccttcagctatggcctctgctttctcatttatgaactaggatgttgcatctagtagtatatcgtggagttgtgtgatgctaagtcattcatcatgaagtatttgtaaagcagtaaaataaaactcagaagtgttttaaactatattaaaagtagtgtacagatatatttgttcctccaactttttagtttgaaaattctaactcagaaaagttaaaacactacatagcgtgaagaacacctatgttcccttcacctagattgaccaattattagacactttgccacatttacctcactttttctctcatacatattctttttctgaacatttaaaagtaagatgcagaaacccaaaccctaacacttcaatgcctgaatatttcagcatgctaagaataaggacacattatcacaataccatcatcacatctaagaaaattaacaataattccataatattatttaatttatattccctattcacattttcacagttgtctctaaaatgtcttttgcagctgtgttttttttttcctctgctccaggctctcatcaggcttcatgcattgcatttggttgttctttctttctagttttagactgatttttttgaagcatcagcccacttgtcttgtgtaatgtcccacatttttggatttatctgattgtttcctcacgattgggttcaagttaaacatttttggcaagaatacttcgtaagtgatgtgtacattttcttgcaagggccagatactaatattttacactttgcaggccatgcaggttctgtcacaactactcagctttacggttccagcaagaaggcagccatagacaaaatgtactaacgagtgtggctgttttcccatttatggacactgaaatctgaattttattccgtttttatattgtgggatattattcttcctttgatttgttttttttttttggacagagtctcactgtgtcacccaagctagagtgccgtggcccaatcttggctcactgcaacctccacctcccaggttcaagtgattctcatgcctcagcctcccaagtagctgggactacaagtgcgtgccaccacgcctggctaattttcgtatttttaatagaggtggggtttcgccatattggccaggctggtcttcaactcctggcctcaagtgatctgcctgccttggcctcccaaagtgctgagattacaggcgtgagccactgcactggccttcctttgattttttttttcccccaaccatttaaaaccataaaaaccagtgttagctcatgggttgcacaaaaacaggtagtgggttggatttggccaacaggctgtatgtagtttgccaaccactgttctgtgcattacatcaggaggaacatagtattagctaccttactatttgtgaggctgaatcatttgcttttaagaaaatgaccattgattttcttcatttataggtacatatgtatccctttgtattagaaagaaatctataggatcatagttcgagatagtattcaaaatccttttcccaacaacatttcacagaaggttttcgttttcccatctattgatgattcttggcctaaatcagtaattataccaggaattcaaattttatatcttattttttttttcttttttttgtcctcacaatctgttcccaaggaattctaattttaattagaaaattttaattgcatctttctttcggcattattagctggcattcttctgtaaaaagagcctctcctttccctattgttttgaatatcattatgcactcatgaacctttttaaattcaatgtacttattattcattactgtcattatttgttttgagcacaaaattacccaaatttagccagttggatccttcaagtcagcttatgtgttcttttgatgtgaccccatttagtctttgagcttgtggcatgatatgcccaaggctcaccatagtactttctttgccccatcctgatgctagccatgtctctaaaaagccctgggtcccttctgtaggaaaggatatttaaagaccataatctgagtaggctttaaaacttctttatcttctctgtatctgttcactctttttttaaatttaggttcgtagtaactatattgctggcctttttaccagctttatgtattttgatccagtctgttgttttctttttgttttccatttgattgctgttttattttacattttttttgttttactagtatcttttctaggccttgaaaatgtattctttaaactttttgaggcacaatttacatagcacaaaattattttattctaagcatgcaatccagtgattttttttcataaatttacctagttttgtaactgtcactataatccaattttagaacattttttatcaccctgtaagatcttttatgcccatttaatctgcattagcactcccagtcccaggtaaccactaatctactttctgtctctatagatttacctttcctagatattttgtataaatggaattatatgatatgtggtcttttgtgtatgtcttctttcattaagtgtaatgttttcaggattcacctgtgttgtagcgtatgtcagtatttcatttctttttattgttttgtttgttttaggagacatggtctcactctgtcacctagggtggagtgcaatatcatgatcatggctcactgcaccctcaaactcctggcctcaagtgatcctcccactgtagagttctgactagctaggaccgcaggcgcacaccaccatgcctggctaatttgtaaacaatttttttaagagatggaggtcttgctgtgaactcctgacctcaagtgatcctcctgcctcagcctcctgagtagctgggattacaggtgtgagctaccatatcaggctcatttctttttattgttgaatagtattccattgtgtggatatatatgagttttgtttagcagtctcccagctggtggacatttgaattgtttctactgtttggctattacaaataatgctgccactaacattcaaatgtaagtctttgtgtggacatacattttatttcttttgtgcatatatccaggagtagaactgctggcttatatgagaaatttatgtttatatttttaagaaactgcctgttttccaaaacggtatcattttacattcccactatcactatgtgagggttcctatttctctgtgtcttggccaacatttgttattgtctgtcttttttattatatccattctaatgggtatgaaacagtacctcattgaggtttaactttgcattttcttaatgactgatgataattgagcatcttttcatgtgctcattaactgttctaataccttctttggtgaaatgtctattcaaatcttttgcccgttttttgagtgtgttgtttgtcttcttaattaaaattctttgtatattctactgacaagctcttttttattttttcaataactttgttatgaatggtgacaagttctttatcaggtatataattagcaaatattttttctcagtctgtgacttgtctttttattttcttaatggtatcttttgaagtacaaaagttttaaattttggtgaggtccagtttatcaattttttcttgtagaaattatgcttttggtattgtatgtaagcaatctttacttaatccaaggtcttgaaatttttctatatgttttcctctaaaaatattacaatttttgctcttacatttggatttctgatccattcaaggacctatttttattttttattactattaaaaaatgttttttatgtctctcgagtcataaggacttttttgggggatgcagtggcgcaatctgagctcactgcaaccttcgcctcccagattcaagtgattctcctgcctcaacctcccgagtagctgggattacaggtgtgtgccaccactcccagctaatttttgtactttacaagacagggtttcaccatgttggccagactgatcttgaactcctgacctcaagtgacccacctgcctcagtctcccaaagtgctggcattacaggcataagccaccacacccggccaagggacttactgttaaataggctgttatacttttaagatgtatgtaatgggaccaggtgtggtggttcacacctgtaatcccagcactttgagagaccaaggtgggaggatcacttgaggccaggagtttgagactctcctgggcaacatagtgagacttcatctctccaaaaaaattaaaaattaaaaattaaaaaattagccaggcatggtatagtcccagctacttgggaggctaagccaggaggatccgttgagcctgggaaatcaaggctgcagtgagctatgattgcatcactgcactctagcctgggcaacagagagacccaatctttttttttttaaaaaaaaaaaaaaaagaaaaaagaaaatgtaagtaaatgacttccttttggttgctctcttctaggtaggacagcaaggagattccaataataacttaagtcccttcagcattgctcttcttctgtctgtaacaagaatacaaagatttcaggaccaggtatttttttaaaatgccattttgtttctttctgtagttggtaaaaaaaaaaaaaaaaaaaaaaaatcacagtaatctgtttttgttgtatccgttcctaaacaattttatccccttcctgccagcagcaaagctgcaataagacatgtatgtcccctctgttctctggggattgatggaaaacttttacaggtttttggtttattcctccgtttcctgttgtgtggtaagctaggtagtgaggtgggaataagagtggaaggataccacacagccccagttggaggaagggacaatttagctggatattcaccagcagttttactatgttgtagctttccaagagtaggttagttgcaaggatgaaatttacaatttttttcttatatgtgttccaggttgtgggtaatatttatattgacttttagccttttttcccccttttttcttaaggaaggcttgtcttcagctccttaaagttcccactgaatgtcataatttttgtaacatcttcatctagttaaaatagttgtcatagggatatatgtgaatggcagctcataggaacagttataaggttaagatttatagcatgagctatataatatttgctttattttcttatttctttcattctgttaggtgcttgatcttttatttatttattttttcatttatttttattaactatactcaaggtgcttgatcttttaaagacttcggttgtaaagagctttaaggatcttcaactcctccaaggctcaaaatttcttcagaatctagttcctcatagatcttatgtttcaaccatgatcttggaagtagtgaagaataggtaagttggtgaaccatatctcaaaaggtttataaggtgtttaatgttagaaaatgcaatgtgatatcatacttgcagcctgtgaggggaaactgatgacttaacagctgttgacgtcacacatcgaggttcattttcttaaaactggtagaggatactttttccctatggaaatatccttgaatctcaggccctggtttcttggccaccttgacagcaagcatacaaaactgaattagttgcttttgtttattccatgatattacaattctctattttccttttctttctttcctttttttttttttttttttttttgagacagagtctcactctgtcaccgaggctggagtgtagtgccacaatcttggctcactgcacccttgacctcctgggctcaagcaatcctcccacctgaacctctcgagtacctggtattacaggcatgctccaccatgcccaagtaatttttgcgttttttgtagagacagagtttcgccatattgcccaggctggtcttgaacttctgagctcaagcaatccacctgccttggcctcccaaagtgctgggattacaggcttgagccaccggtcctggccgtttcttttcctttttaaaggaaacagtctcactatgttgcccaggctggagtgcaatggctattcacaggctctattatagcacggtaaagcctcaaactcctggcctcaagtgatgctcccacctcagtagctgggactataggcatgtagccctgtgcctggcttggcctttcttcttttttttttttttttttttctgaagacgtaggaacttttcactatgttgcccaggctagacttgatcttctgggctcaactgatcctcctgcctcagcctctcaagtagctgggacaataataggtgcatgccactgcatctgactcatggcctctttttaaagtgagtaaaaaacattaagagttttatttactttgttgaaatttggagcgtacagttggaattcaattattgattagccagtttagagaaattcatttaaaaccacatggaaaacatcagtaactgtcctggtttttattttaatttcaggatatacattagctgttgtaacagtctttactatgtcatgctttcactgtgtattaaatatattttaaagtttcataatttaagcataatttatggtaggcctcttctaggcctggaattcttgtttattaatagattgaatttacatgagctttgcagtagggcaaatttgaaattagagtttattgtttgagtgttttacccattgttaggccttaaagctttttaatctttgtatctcattattctttttcctgaggtttatacttgtgtctccagtattttcccaacccaatctcttaaagttgggctaaagaaggaggtactcactaaccaggaaattcctggaaagcttcccatcttctggaaatctcaactgtcataggacttgaaagcatctccatgtataattagcctggagtgggtacttgccactgggtgggaccaaacctcagctgggagagatttggatagccttattagatcctctaaaataactggctggttagttacacatgcttgccccagtcagttaatgaacctttaaataatgcattctccattttatgtaattgaatttttggctcttcagagtatgaatattgttaactctgttaaagtcttataatttatccataactgtctacttcattctgtagtgctgcattataatttgttgcaatttaacaggtagatataatggataaaggttatattcacattatttccactgtggggtataacattaagtggtataaaaccaccaatgattctactcttttacaaaagattatttgtagttttagcttatgctgttgataccagatcactcatccatttatagtataaatatctactgagtgtcttttatatgccacccttgtgctaagcaatgtgggtaaaaatatgactatactatgacctctctcctagagaatctctgtctttggaggggagctaatttgtaagcctctacataagcgttgtcagtgctgtagggtaatagaagaggcagcaatgaacttctcatcatgaaatcttgaataggaatctttaatttttttaatactctctagcttctggattttcccagtattctgtgtgtcattggagaccacttgcctgctgttcccattatggtacatttaggaattcagaattctgtcagacgatgtgtgtaaagaaaaggtttatatgcagagtacgttgattatctaggtcaagtttgggaaatgtataacagggcaatgagtataaaggtaagaatatctcactaagtttttcttttttaactaagctttgtgttcttgtagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaaggtgagacactattttggcaaccactccctaattttgtttaaataatccaagtagggcttggcatttgcctgggagtttggtggacaaggaaatttgagtatgtattagtttgacagaggatatatgacagagattaggataatattgaaacattatagatccagtttgatggaatacttacttacgtattcttctatgtaagtttttcatttattccacttaatccaattgtttctgacctagaagtttgaatataagacagctttttcatgatttttccttcttcttccagaagtaaaccatttctagtttttgttttgttttgttttaatgctgttcctttacacagaagaaatttttttaggtcactgtagagcatcaagcttaaagaatcatgcttaagaatttttactgaaaataaaacaaaaaaagaatcatgcttggtcgggcatggtggctcaagcctataatcccaacactttgggaggctgaggtgggcagatcacttgagctcaggagtttgagaccagcctgggcaacgtggcgaaacctcatctctacaaaaaacacaaaaattagccaggtgtggtggcacgcacctgcagtcccagctacttaggtgactgaggtggatcacttgagcccaggaagtcaaggctacagtgagctgtgtttgcaccactgcactccagcctgggtaacaaagtgagatcctatctcaaaaaaaaaaaaaaaaaaaaagaatcatacttattggttcattgtttctgaagaaaccaaaatgggaaatgtacatttttttgacattattaccaaattatcactgacatctcaatcttaattactgaaacagttttcaaaaatttattttctcttgaataaaaaaatgctagatcatatctgaggttaaacaacttttctagtaattcctctaagtcttcttgatgttcaattgtttaatgtagctacacaccaagagtgtctgctgaaaatgtttatttgggaggctgatctaaatgtaaatctagtgttctaatccagaactatgaagtaaatgtcagaatagttcttgagagttatcagtgtatttgatgatataaattaccctgcttaacagtgatattgttaaagacattatcttagagtatgtttttatatttaaattattatttttcaaaactaaagaggctccatttgatttcacatggatgtcggctttatcaaggcatctttataaattgctactaagtcactaacagtctgaggtctgaacgaattagtctgtaccataaagtaatcaagttgaagtaagaattttaactacaattcaagtgaaaattcagaatgggtctttttaacagcaactgctgtgcttctagaaactgagaaaggggttagggaagatcttttaagtttctagaaatcttcatgggcttttacattttaatttttagaataaaagttatgtatactgtcaggaatatggatattgtcaggtaatggatacctaagtagaattgatcctgtttgatgctgaaccttatatgtagcaatagtttaatgtgatctgtacttttaggctaataaacatggtatttatcctactaatgaatcatctaagcacagaacaaggggaaagttgagtgattctgtctttccagatgattcacattatattctgattttttgagttttactcatatccaaacggttcttcatgctgcctgacatgcattgatatacttaaaagctgaagggtcacccaggaatattttatttattctgttctttttagatccatgagatgatcagacaagaaattttggagcaggtcctcaacagggttgttaccagagcatcttctcccatcagtcatttcttaggtattcaactttgaaagaatgaataaagtttttagaaatattttcatttcaatgtcataatcatttggtcctgggaaaaaaattttaatgagcatttaaatgcagtatctttgataggatgccaataaaggaaatccatttatgttgtctgggattgtcagttgtcaaaaaggctgtagctgttagtaaggaaagcaacaattaaccaataagtaaaacttccattttgctcaacattttctctttttgttaatacctctcaaatgagtgctgtcctgctgctgccactcattgacttcctagtccttttagccttgacatttggactgcacagtgtttctctctggtaacctctgaatttgctgttttgttgttgttgttgttgttgttgttgttgtttcttttttagacacagtttcactctgttgcctggagtgcagtggcgcaatctcagctcactgcaacctctgcctcctgggttcacgcagttctcgtgtctcagcctcctcagtagctgggattacaggcgcacgctaccacacccagttaatttttgtattattagtagagacagggtttcgccatgctggccaggctggtctcgaactcctgacttcaggtgatccacccaccttagcttcccaaagtgctgggattacaggcgtgagccaccatgcttggcctgaatttgctgtttttaatacataactcctaatgtctaaatttactagccttcatcacaaattttaaaaatttctccgtgtcattcatcactgtttataactcccctgaaactttttaggtaagttctctgattactgtaagagtctgcttcttttcctgcctgtgaccagttttccttttacctcaaatataatacagttcccttcaaacaaattttccttttcattgctcctatttccattatttgaagcatggttctccaggtcctggaggctggaattaccttttattttctcaaacacaagttctgtcatttttctccctcatactgtcattgtttctatctttttattccctcctcctcccaacctcacatccagtgtctaattcctattcttactaccttgaatttagactactgccacagctttctaactggtttcctggctttttcttctccctgcagcaatttaacctgcatattaccacacattagtattcctaaaataccaccttatgactacagaatcatcaatatgttctttagtaaattgtcagctctttttgtttgtttgttttttgagatggagtctcactctgtcacccaggctggagggcagtggtgtgatctcagctcactgcaacctccgcctcccgggttcaagcaattctcctgcctcagccttgagagtagctgggactgcaggcacgtgccaccacacccagctaatttttgtatttttagtagggatggtgtttcaccatgttggccaggatggtctcaatctcttgacctcgtgatccacctgcctcaggcttccaaagtgctgggattacaggcgtgagccaccacacctggccaaattgtcagctctttatcctggcactgaaggtgcttgacaagttgatcccaccctacctttccattgttaaagtcagttatttactttcctggattcttcaccccagcatcattgatttccctaccatcttctgaatatgtcttaaacttacctttctcatacctttactcatacttttccctttatatatgtaggcctttctggtgctttgtgcatttaaatgttccccatcttttagaacctagtttaagttccttctcctcattgctttcctaatatataccaactcataatgagctcttcttcctttgaactcctatttaaactctccctttaccatttggtaggcaataaactatgtttggaattaatagatatttgatattgctctgtgatttacctctttaattctttaaaaaaatttttttacttccaactaaattattaaaatttttgaagaaagactatgttttatacttttatgttcctaataggaccatattacgcttgtgcatagtaaaaattcagaaatatttattgatttattttagcttagaagtaagaagatgtgtgctactacttatgtctaggcagtgtaatcggtttcttcctttcttttaggcagtttaatttttatagaaattgaaactatcatagaaaaaagctaaaattatcctggttacattggagaaaaagtatatatagaatcagtagaaatttgtattgcagtatacttgacttatttgagaaaggaaacaaaagacttcacatttctttctccgtatttttcttttatttcagttatctttagttatttgagacaactgattatagattctgtttttcagacctgctttcaaatatcgtcatgtatgcacccttagttcttcaaagttgttcttctaaagtcacagaagcttttgactatttgtcctttctgccccttcagactgtacaaaggctgcttaaggcagtgcaggtaagtcttcagattcccaagtaacttgccaaaactgaggtttaactgtctagtggaagtctgatgcatttttgtataaatatatatgtctaagaaattctattccactttagtctgaaacataaaatttgcattaaaagggcaagagcattgagcaagactgttttccaggtttatttcctatccataacactattctctcaactcattttcaagttaatgaaataattaaaactctcttagaacattattgactacaatagatttacagaggcatttgcaaccagtttcattttagtgtttcagagtatactattgtccttgttaactgtaataaacattaaaacgtatataaaacagaagtaagcttccttatagaagccatatggtaacagtattgggtagaaatgacctaaggctaataagcaaacttgttctgtttttacccactgattctttttcagccccttctcaaagtcagcatgtcaatgagagactgcttgatacttgtccttcggaaagctatgtttgccaagtatgtagcatctttttctatcataggaagacgttgtcttctaatgttggagctaaagttatctctgccatctcctagtaccacctgttcacagtgatcatgagaattcctagccccgcagagcaatttcatcaaataaggcattttgctaagtgctttatgtgcttttttcatttagtcttcagagcaaccctatgaagtaagaattattgcaattcccattttacagataagaaaagttaggcttagagaagatgagtgactttccaaaagtaaaacagtagttggtggtggagcaaggattcaaagtcaggtctaacatcagagcttgtgatgtcaagtactttgctctactacattagaataatcttcagggtaatgttctagtgtcaaatactctgaaacctgagctggcagcagttccaaaggggaaagtaccttagtcaagaagattatacttaagaatctcattttagtgaacatctgaattatgatctagaggctagtagatcaaattaattgttgaggggaatgagttttatttgtagcttagccagtccctcctaacatctcttcctttatttcttagtatataagctagagatgatcttgccatctcctaaaaatataagacagtaatatgtgaaaagcatttggtactttgaggataagatgcccaattaatatcacattggccatattataatatattcatgggtgtccagaggaacaactaagccatatgctattatctttgttctagaattaaaagtttttgttactcctcacccaaaggcatagcgaatagactgagatattacgttgtaacatctttaacatgaattaatcattgcgcctcagtgagaagacaagtgtgacattttctggatggacagtttacatggcatcaaatattacattatcctatgatgaaagagagcatatgaagggaagcactccttcaaacatggcaaaatcagcaatttcttacatttgagtaaccagccaattttacagtctctcagcagtcttcttattcctcacatagacttgagagcaggatagaaggaagtagagtatcatgagttaagtattgaaaaaagtcagttgaatttctgtactataaattgctttgaacagctgataccttattttgagtacataaattcactttgttttgctctacgcttcattgtttatacatatgccttctctgtatgcaactagctggatttttctgacccagaagcatattcctgtgaaatagtactgtttgttaacttctctatttctgagctagccagcttgatgcccgaaaatctgcagttgctgggtttttgctgctcctgaagaactttaaagttttaggcagcctgtcatcctctcagtgcagtcagtctctcagtgtcagtcaggtaaggattatttacgttaacttgcagtgtgtgcgtatcattcatgtgcatcgatgaaatgcacgctgttttcttttattcctgttatggttgtaagaatgatcctagaactaaagagtctgatgatgatgatggtgctgatgatgatgatgatgatgatattggctaacactcattaatggcagatttactgtatgctaaactgtgctatccagtatggtagccactgtcctcagtgtggctattgaatggaacatttgattgaaatgtggctagtccacattgtgttgtgctatacatgcaaaattcataccagattttgaaataaaagaatgtaaaaatctaataatttttaatattgattacatcttcagagagaattttgtatgtgttgggttacagaaaacattaaaatttgactttatctctttctcttttttaatgtggctactagaaaatataaaattacatacatggcttgcatttgtggttcatattatatttctttctttttttttttttgagacggagtcagtctgtcacccaggctggagtgcagtggcgcgatctcggctcactgcaactcactgcaagctctgcctcccgggttcacgccattctcctgcctcagcctcccgagtagctgggactacaggcgcctgctaccgtgcctggctaattttttgtatttttagtagagatggggtttcattgtgttagtcaggaggtctcgatctcctgacctcgtgatccacccgcctcggcctcccaaagtgctgggattacaggcgtgaaccaccacacccggcccatattatatttcttttggatagcacggtgctagatattgtgccaaaatgctttacatttattatctcatttaatcttcacagcagtcctctgaggctagatactattattatcccattttcttacgtcattgtatttactttgcacaggaacatatattacaccttgtaatctgggaaaacaaaactttttataataatctggtaatctaggctttggagcaataaaattgtcttcataatttaaatgatgtactataagatttataaataggagacatttatatataacagtttgactaggaatcctcactttattgctttggtataactacataaagctttgtctataacatatagcatagattaaatattaggaacactagatatcatttgtgtgttattatccccattttaaagacagggaaactgaggctgagccaggttaaataacttgcccaaggttatataaccaagaaagggtggaagaaggatttggcctcaggcagtatgaactacattactgtgatgcctggagtaaggattaggaattcttggtctataattgctgattttattatgtaatttacacaaaggatgtcagttctttgtcatgtccatttctaaacaaaagactgtcttcctctcaacctttctagaatttgtggaatagtgagattcttctagctattgaagaagtcttagaccttttaaataaaattatgtatattgttactactggattctagtggcttgaaataagcagtgtaccttcctaagcaattgatattgtcaaggaaaccttaaggaatatgaacagttaattttgttaaaatgcttaaaaattctcttattccaaaccagaataagagtgacacttactactgcatggtaatgattatactgtgtgtctcacccctggggtttggcatgtggaggaagctaagttttttcgaccaagaacataggctcatttagctccttattggaaacagctttggtaagatagacgtgaattggcctgtcttcctttcaggttcatgtggatgttcacagccattacaattctgtcgccaatgaaactttttgccttgagatcatggatagtttgaggagatgcttaagccagcaagctgatgttcgactcatgctttatgaggtaagtccgtagaatggaaagaatgtagcaaaaccccaactaataatttttattttagtaatttttttcctgattataaaagtacaatagctatgctcttacttgatgtagtcagcaccagtagctagtgatgtttagtcaaaaagttgtttaaggcagggcacagtggctcacacctgtaatcccaacaccttgtgaggccaaggcaggaggatcaagcaagactctgtctttacaaaaaataagaaaataaaaaacattagctgggtgtggtggcatgcgcccgtggtcccagctactcaggaggctgaggcaggaggatcccagcagtgaggctgcagtgagctatgatcacaccactgccctccaacccaggcaacagtgagaccttgtctctcaaaaaaatttttttaaggtgagaaatcataaaacacagttgatagaccttaaatattttattttaatttgaaatatttaaatatactataaatttgccagtcttaagactaagtccttttttttgctttgttaatgattacaagtttacttcctgcctctcatacaaacccatacccttaatttattgcctatagtttcaaatttgtgtttacctaaagtggtatgaaaactttaagctacctcagatacagtttagcacaaaaatcttttagatagcttcagttttttctctttttacaattgtgttacctctaatttatcagaaattggtttgagagactgactttccaaacattgttccaaacttagtttttttttttctttgggacagagtctcgctctgtcacccaggctggagtgcagtggcacaatctcggttcactgcagcctccatcctccatctcctgggttcaagcagttctcctgcttctcaacctcccaagtacctgggattacagccatgcaccaccatgcccagctgatttttgtatttttagtagagatgggatttcaccatgttggccaggctggtcttgtactcctggcctcaagtgatccacctgtctcggcatcccaaagtattgggattacaggcgtgagccaccatgcctggcctaacttagtttttataaaagcaacttctttttctttttgcactgggttttcaacagtttactgaacgtctgattaaatcactagttattatgacagtacagctaagagaaatacaactactgacttgtgattagcatataactcacccagaggatattgtggtagcatatgtgaaaacaacattcatctttctgtacatttccatcagagctcttagatgcctaggtgcactatcaatgagcagtaatattttgagaagaatctttttttttctgagcagtaggtctcaacagtgggcttaaaatattcagcaaaccatgctataaacagatgtgttatcatgcaggctttgcttttccatttataaagcacaggcagagtagatgtagcataattcttaagggccctaggatttttggaatagtaaatgagcattgatttcaacttaaagtcagcagctacattaacccctaacaagacagtcagcctgtcctttgaagccaggcattgacttctcctccctagctaggcaagtcccagataaagtcttcttccaatataaggctatttcatctacattgaaaatctgttgtttaatataaccacctcgatcaattatgttagctatatcttctggataatttgcctcagcttctccatcagcatttgctgcttcaccttgcactttttttttttttttttttttgagtctcactctgtcacaaggctgtagtgcagtggcacaatctcggctcactgcaacctccgccacccaggttcaagtgattctcctgcctcagcctcccaagtagctgggactataggctcacgccaccatacccagctaatttttgtatttttagtagagactggggtttcaccatgttggccaggatggtctcaatctcttgacctcgtgatctgcccgcctcggcctcctaaagtgctgggattacaggcgtgagccactgcgcccagccccttgcacttttatgttatggagatggcttctttccttaaacctcatgaaccaacctctgctcgcttcagcttttctttggcagcttcctcatctctttcaggctttatagaattgaagagtttggtccttgctctggattaggctttgacttaagggaatgttgtggctggcttggtcttttaccagaccactaaaactttcttcacatcagcaataaggctgttttgctttctaatcattcatatgttcactggaatagcactttaaatttcctttaagagcattttctttgcattcacaacttggctctttggtgcaagaagcctagcttttgacttgcctcagcttgtaacatgccttactaaactggatcatttctagcttttgatttaaagtgagagacgtgcgactcttcctttcacttgaatacttataggtcattgtaggggttattaattgacctaatttcaatattgttttgtctcagtgaatagggaggcctgaggagaggtggagagatgggatgatggcccagtcagtggaaccagtcagaacatacacagcatttatcaattaagttcactatcttatatagacacaattcgtgactcttcaaaccaattgcaatagtaatgtcaaagatcatttatcatagatccccataacacatacaataataaagagaaagtttgaaatattatgagaattaccaaaatgtgacacagagacatgcagtgagcacatgcttttggaaaaatggtactgagagacttgcttgatgtagggttgccacaaacctttaatttgtaaacgtaatatctgcgaagtgcaatcaagcaacttgcaataaaattaggtacgcccatattctgtataaaccacattgtttaaacagttaaggcacagtgagccactcttctttagggtgagctttgtgtcagtgtaagtaactgtttaccagctaaattctcagccaccagctggcaaaggtgcactaaggataggcagtcttagacttcatgtgttaactcttgtgcagtccttgatatgccccttcccccccaaaaaaaatcttcacccttatttagctctaaagtaaaaaaaattaacatgaagtggatcatagacttaaacctattagaatattgctgttcatttattcatcagtcttagtatatcattggtatataaaaataccttatgtagtgataaaacttgtcatatttgttgcaagtgtatgccagattgccatttgctttttttttaatatgatccttttacacttaaataataatttttggttactaaatctattgattttcttcctctgagatgtcttctattactttttttttttttttaagagacagagtcttcctctgttatccaggctggagtgcactagtgcagtctaactcactgcagcctccagctcctaggctcaaataatcctcttgcctcagccccatccccaaacgattgggaccataggcacaagccactgcacccagctaatttttctgtttgtttttttttttaaccttttgtagagacagggtctcactttgttgcccaggatggtctcaaatgccctggcttcaagcgatcctcctgcctcagtcttccaaagtgctgggattaaaagcatgagctaccgtgcccggcccatctttattattattttatctgtagaaagtccaaatccttccaatgaatattcactaacattttctttgaggtttttttttttatgcatttgtttttgacgtttagctacttaattcatcctgaatttgtatgataatatatatgaggagcttttcccccaagctaaccatttgttcagacatcattgcctccttaatgtgtactatgtatctctgtatgccattttaaaattttgcctgtagatttttgtgccaagacaaagtgtctttttattattattacacattcataaaatattttaattgctgttaggattaattttcctttgttccgttcctttcccctttcccctttttccgttttcctttcctttccgatggagtctcactctgttgcccagactggaatgcagtggtgcggtctcgggtctcagctcaccacaacctccccatccccagtttaagcgattctcctgcctcagcctcccaagtagctgggatcacaggcgtgcatcaccatgcctggctaatttttatatttttagtagagatggggtttcaccatgttgaccaggctggtctcgacttcctgacctcaggtgatccctcctgccttggccttccaaagtgctgggattacaggcatgagccaccgtgtctggcctgtttcttttctttaaacaaaaaaatttttttgatcaattctcatttgcttttactcacagatgaactgtataacctcttttccaggttccagaatgaaagttctccccaggattttttttttttttaagacagagttttgctctattgcccaggctggagtgcactggtgtgatctcagctcactgcaaccttcatacctcagcctcccgagtagctgtgattacaggcatgtgccaccacacctggctaatttttgtattttttagtagagacagggttttgctgtgttggccaggctggtctcgagctcttggcctcaagtgatctgcctgtctcagcctcccacagtgctgggattacaggtgtgagttacttcacctggcttccccaggattttactctgagcagttcttaactaagactaggacattttgggtgggaaaaaaatatggtcatttatattagggcatttaggactgtcaaatatggtctcaataggaaaaaactgagaagaggataaagaaagtgttatttttaagttatgattgtccagatcactagtatctctgttaaagtgcttatttcttctctttgattcctcttaggggttttatgatgttcttcgaaggaactctcagctggctaattcagtcatgcaaactctgctctcacaggtaaaatacatttttatggatatatggaaaacagaccatcaaggatcgagagacagttgatggttttcagacctttcaaaatataaaataattcccaactagtacattagtactttgtgaacatgctgtgggtatgttatgctgttctgggttgtcttatctcggtcaccacttacctgtctgccataataccatcatctagcagttatccttgtgaattaacagtctgtatcctaagtcagaaggacattttgaagaaccatttatataaggaccattgcaactgtatccattatgttatatttctgaaagaaaaaagaaatccaaaacaaatatagcaaaatattatttcttaaatctgggtaatggatacatggatgtcttttacattcctttctgcacttttcagttaacaaatttttaaattagaagattaaattcttctaatcttcaagactagaagaattcatatagagactctctaccaggagggttcctttagacccctagtctatcattttgtttgctgtctctcaatgccattgctttgtgatagttatgaaatttcatttaaaattaaggtctcagatgtgtgaaattattggaagttcccatactgtccatcaaaagcttttcatctggccttaggcttgatcctatataaaatttatattctgtcagctatattgtatctttcaaactgtaatcaacacatctacattcacacgtttaacaaaaatagaaaattatgtttgaaggcatagaatagcgctttctgactcaggttaatatgcaggacagtaaaattctgcagactccaaaagttaaaaggagaaaaataataactcatattttttttggctgtcttatatgccaaatactgtttgaagtactttacatgtattgtcatgtttaatccttatacaatgattattaataatatcctcatttttaagatgaggaatcacggtacagatacttttataaaaaccagtaataagtagtggtactgggatcttggactcagccagtctgactctggatcctgtatttttaacctccaagttaactgaaaatgttgattgcatgtacaagtttaggaatagaaggaattggaataggaaagatgatcctaatctgtacaatatccaaagcaagagcacaggatgtgggtgagccaaagaaataaaaacttggctgcattgttctttgaacagttgggaaatgtgtgttagaaggcattagacattaaagatacctttcacctgagaagttaaaaaagtaaaaagcatttatgagccaagatgtcttttttttcttactatacacagttaaaacagttctatgagccaaaacctgatctgctgcctcctctgaaattagaagcttgtattctgacccaaggagataagatctctctacaagaaccactggtgagacttttattcttccttcaaccattatttttagtattaaggatagggttgaactttgcaaagagatacctttccctgtgaaactctcttcctggttcttccaatgaatgtttacttttaagtcttccctgcttatcatttctgaaccattatcattttggatctattggtaagttatctccatgttagccctttactaaatcaaggcttccatcacttcccccagagaatattttatctcatttatgaatctttgattacattcactaaataaatgtactttagaatggggagagggatgatgtcacctacgaacagatgaacctaggggacctgcttcattagtctagaggaagtatatgatttaggctgaactaggattggcactgttgaaccttcagaggagctaggcctggttgactttctgttcttatctagcctcagaaggacagcgaagaggataaaaatggaaactcccaccccaagtgacttataactcatggcagaagaaaggaggaagtctttcagttgtcatatcttgccttcatttttgtgccttctgtgacatgagatgtcctcagcctagatctaagatgctgtgttggtctcctaaagattccctcaacataaacctctatctttagaatagcctctgggactcaaatgaactagagaagatttaacttcaccacctagctccagggttatttatcagaccagagatagcacatctaatgttgcattttgaggtgtcagccacttaggccaattttcggggggaagcattagaaaaggatgctgctgttcaattaattttcccagttttgttaatttagatggacttaatttgtaacgccaatgaatcattttctttagccttatagataagaattatttgctggttatgaacaactttataagttatccatcaacactcaagagtatttaatttacttattttctcctacaggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggtaattgctaagtcctcagctgtattgaatgatggagttctttagtagcttgttaatttttatcttgtgtcttttaggataaatcagcagatttttctcagagcaccagtattggcataaaaaataatatctgtgcttttcttgtgatgggagtttgtgaggttttaatagaatacaatttctccataagtagtttcaggtaaggttttgctataactccatttgtaatttgatgaattctccattttatttacatatttttactgtagcagtattctaggcagtaaacagaccacagacgatgacactgtctcttaaatgagcacctagtctaagactaaactgtgttctttccactagagagcgctgaagtatatgcttaccaggcctataaaatgaaagccttccagcagggtttcacttactcagaatttcccagaccctgaattcaagaactcctaattttaacatggaaattttgattggtggtagtattggactttaatactctgcagggactggtataaataagggaggggaggccaggtgcggtggctcacgcctgtaatcccagaactttgggaggccaagctgggtgtatcacttgaggtcaggagttcaagaccagcctggccaacatggtgaaaccccatctctactaataatgtaaaacttagccaggtgttagtgcctgggacctgtagtcctagctactcgggaggctgaggcaggggaatcacttgagcctgggaggcggaggttgcagtgagccaaggtcacaccaggggaaacaaaacccagatagattgctgtgacctgggagtattatattaatgaagttctattcatttataatgttacgtctaaaatatgacatttaaagaagcattgtgattattatcatatgtaaaagtaaaccacaatattctgatgtttgtccttagcggtctcttttttgttttttacagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcaggtaaggttctgctagagtgcttaaagacagccactccctgaggatcgtatacctacctaggctcacttgtttcacctcgtttggattgtttacagtaagaaataagtcaggaggttttatttttcttgaaataaaagctggacaatcctaggtaggtactttaagtaggtaccttgaattattaaaggacaaatgagaaacagtgggccaataaatgaaaagatagggatgaattccagcagggtgttttaagaaaatctatgtaagtagcttgtacaagataacagatataaaaaggtagggggtgccaggcatggtgcctcactcctgtaatcccagtactttggtagactgaggtgggtggatcacctgaggtcaaaagttcaagatcagccatgaccgatatggtgcgacctcatctctactaaaaatacaaaattagccgggcatggtggtgcgcacctgtagtcccggctacttgggaggccgaggcaggagactcacttgaacccaggaggcagaggttgcagtgagccgagatcatgccattgcactccagcctgggcaacaagaacaaaattctgcctaaataaataaaaaggtagggggggtgactgaattaaaaatacaaagggacaaaaaaaaacctaaaagactaagactgacatttaaattttatcaaagtaaaggatttggggagggagagaaaatgaggaaccactaagaataacgattataaaagggcagccatagcagtgactatagcttgggctgcctagagagtctgccagtcggaacttactggcaagctctgttgggtgctgctgttctgaacaatttctagaaagcttaattccatataccaatagcagtaagggaatcttcctttttctttctctctctctgtctctctctagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcggtaagccactcccaccccttagaaacttattccacttggctgtggtgtctccaagagaacaaactgggaacagaggatgaaggtaatttgaggttggacatattttaggagtgaaagaatataaaacattagccaggtggcaggcacttgtaatcccagctactcaggaagctgaggcaagagaatcacttgaaccaggaggtggaggtcgcagtgagctgagttcataccactgcactctagcctgggtgacagggcaagactctcaaaagaaaaaaaaaaaaaaaaaagccagacatggcagctcatgcctgtaatcccagcactttgggaggctgagccgggtggattacctgaggttgggagttcgagaccagtctgaccaacatggagaaaccctatctctactaaaaatacaaaaattagcctggcatggtggcacatgcctgtcataccagctactcgggaggctgaggcaggagaattgctcgaacctgggaggcggaggttgcagtgagcctagattgtgccattgcactctagcctgggcaacaagagcgaaactccatcttaaaagagtgaaaaaaagtgcagtcattgacatagggtcttttttctagtcttgccttcccctggcgccccccccacctttttttttttgttgttgttgttgttttggctttttttttggctttttttgagagagtctcgctctattgcccagggtggaatgccgtggtgcaatctcggctcactacaaccccttcctccgaggttcaagcagtccttccactgcagctttctgagtagctgggactacaggtgcacaccaccatgcccaactactttttaatttttaattttagtttattttatttactactttttttggagacagggtcttgctctgtcacccaggctagagtgcagtggcgtgatcttggcttactgcaacctcggcctccccggttcaagtgatcctcctgcctcagtctcccaagtagctgggattacagggcaccaccatgccctgctaatttttgtatttttagtagagacagggtttcaccatgttggccaggctggtctcgaactcctgacctcaggtgatccaccaccctggcctcccaaagtgctgggtttacaggcgtgagccactgcacctggcccttatttttttttttttaattttctgtagagataggatttcaccatattgcccaggctggtcttgaactcctgggctcaagcgatacgcccatctcagcctcccaaagtgctgggattacaggcctgagccactgtggcttttgttttttcgttttttttgttttgttttgtttttgtttttgtttttgtttttccatttaaccctgagtggacacagcacatgtttcagagagcacggggttgcgggtaaggtcacagatcaacaggatcccaaggcagaagaatttttcttagtacagaacaaaatgaaaagtctcccatgtctacttctttctacatagacatggcaaccatccgatttctcaatcttttccccacctttcccccctttctattccacaaaaccgccattgtcatcgtggcccgttctcaatgagctgttgggtacacctcccagacggggtggtggctgggcagaggggctcctcacttcccagtaggggcccctcacctcccagacggggcggctggccaggtggggggctgacccccccacctccctcccggacggggcggctggccgggcagaggggctcctcacttcccagtaggggcccctcacctcccggacggggcggctggccgggcggggggctgacccccccacctccctcccggacggggcggctggccgggcggggggctgaccccccccacctccctcccggacggggcggctggcctggcgggggctgacccccacctccctcctggacggggtggctgccgggtggagacgctcctcacttcccagacggggtggctgccgggcggaggggctcctcacttctcagacggggcggctgccgggcggcagggctcctcacttctcagacggggcggccgggcagaggtgctcctcacatcccagacggggcggcggggcagaggcgctccccacatctcaggcgatgggcggccaggcagagacgctcctcacttcccagatgggatggcggccgggaagaggcgctcctcacctcctagatgggattgcggccgggcagagacgctcctcacttcccagacggggtggcggctgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgtggttaggagctggagaccaacccggccaacacagcgaaaccccgtctccatcaaaaaaatacgaaaaccagtcaggtgtggcggcaattgcaggcactcggcaggctgaggcaggagaatcaggcagggaggttgcagtgagccgagatggcagcagtacagtccagctttggctcggcatcagagggagaccgtggaaagagagggagagggagaccgtggggagagggagggggagggggagggggctcgtttgtttttttgtttttgtttttttttcatttaaagagatggggtttgcagtgttgcccaggctggccttgagctcttgggttcccagggcttctagtcttgctttgatatggattgttagtcacatataaaatgttatgctattattggggaaaaaaagagggatattacataatggttaagtgattcaaaatacttaaagcaaaaactgatggaactgaaggaaaaatagacaaatccttaattaatgtaatcagccctctctccatagtcaaaaaacagaaaacaaaacaaaaaaaaaccagtagatagaaaatctactgaaaggaggtagaagaagtgaacaacactgtcacccagcttgatttaattgacacttataagaacactccacagcaccttcaaaatacacacttctttttaggtgcacatggtgtattcaccaagatgagccatattttgggccataaaactcagcaaattaaaaaaaagtagaaattctctgaccaaacagaattaaagaagaaagcagtaacagaaagatatctagataatccccatatattagaaattaaatgcatttttaaatagcccatagtcaaaaagtcgtcagggaaattagaaaacatcttgaatagaatggaaacaaacagacaacatgtcaaaagatatgatccagccaaagtgctattgaggaaattaaagcagttagtgatttaaaaatctcagatctcccatataaacttccacattaagaaaatagaaaaagaagagcaaattataatgaaagtaatcagaaggaaggaaatagacaaaagcacaactatgaagaagcagaaaattaaaatagaaaacattaaaagaaagctggttctttgagaagatcaataaatttaatgaactttagccagactaatcaggaaaagagaagacacattacaaattgcagaattgaggaagaagggacatcactactgatcctacagatgctaaaaaatagataatagaatattaacgattttatgccagtaaacttttaagtttaatggacagatttcttgaaagctcactcaacaaaaaataggcaacctggccgggcgtggtagctcacatctgtaatcccagcacttttgggaggccgaagcaggtggatcacctgaggtcagcagttcaagaccagtctggccaacatggtgaaaccccagctctactaaaaaaaatacaaaaattagctgggcgtggtggtatgcacttgtagtcccagctactcaggaagctgaggcaggaagaccacttgaatctgggaggtgtgagtttgcagtgagatcaccccactgcactccagcctgggtgacagagtgagactctgtctcaaaaaaaaaaaaaaaacctgagtaatcttatctctattcaaaaaaacctgagtaatcttatctctattcaaagaaattgaatttgtggttcaaacttttttcacaaaacttaagatctaggtctattccgtggtaaattcatccaaacatttaagggagaagtaatgtaaattctgtgcaaattcttccaggaaataggagagaacatattccacctcatttaattaatgaggtcagcattaccctgataccaaaccagacccagaccattgcaagaaaactgcatagcaatatccctgatgaatatagagtctgctgtgttaaaggcagactcagaaggctatatactgaatgataaccatttttgtatgatgtttcgtagaaagtaaaaccatagggacagaaattagatcagtagttgcttggaaatgggaggagagaattgactatcagtgagcacaagggaacttttagagtgatagaaataccttgattgtggggagattacacaaccatgtaagtttttttaaacttctagaactgttcacctacagggtaagaattttactgtttgttattttatctcggtgaacctgtctttaaaaacaataccactttctcctgcttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctgggtaagcattgcagtatcaataaataggcttgatttaggtttctccttagctcaaccccttaattccatttgttaacctaccagaagacacttgagaacagtcctaatgttgctaaggagtgacatctagtggattcaggattggtacctactggattacattcaaccacaaagagtggctggaaaatggaatatagtattaagaaatcacaaaattttagaaatttaagtctgcctttagacttttttttggctttcaaaaattttagctattaaaaggccaaaaagtatgagtttatatcaaagaagacaagagtttcttttccattcctagatgtcacagataaggaaggagaagagagagaagatgcagatgtcagtgtcactcagagaacagcattccagatccggcaatttcaggtgagaagccttgcaaagctgctgtactggcctgagaggctttgcaaaggaactgttagcaggggcagctggtaagaatgggcagacagtgaccaagtaggagaagaattttttctgggtcatacaggcaacaggacatagctctcagaatggaagataatgtatttaaaaggaccctagtgaggataggtatttagccaccccaacctgcaatactcattacttctaaggaccactgtttgagttgatgtaaacagaaaggagtcttcaaggcatagagtctgtgtttttgttttctgagtctgtggtataatttggcttggtctgacagacaacgtaaacactggacaataaagtttgttagtttctaaccaatagttgtcaaaatatcaggatgttctatcacaggagttttttatttaacaagtaattctgaagttcctaccatgtgccagaaacagttctaggtgctggggatgtagcagggaacaaaagagacaaaatattcctatccttatggagcttacattatagtagaaagacactgacaaataatcaaatacatagttatttcaggtaacagggaaggtatataagcattgctgggtttggtgccttgtctaagcctgagatcaatggataggctccagggagctgtgagccaccagaaattgggtacatagttcattatctacattttgcatggggttggaacggaaagagtcagttttcaggagcattctcagagaggtttatggtcaaaaacagcttaggaaactactgctcaattcaggtgtattttcagattttatcctcttagaattttggtagctttgaattctttctgtcctagtcttaggagtctctgactagatgcctcttcttcctgataggaacgtgtctgctaacattgcttgctgtgtgtgccttcctttctcagaggtccttgttgaatttacttagcagtcaagaggaagattttaatagcaaagaagccctcctgctagtcacggttcttaccagtttgtccaagttactggagccctcctctcctcaggtactagtaccgctaacttaatcccatttagcattcctcagaaggcaaggattattgcatcataaaagtgtatatctaaatgtcctcttgaaattgagcttattttacataatgtgtttaattatacacctgagttaatataagacctataagatgtattctttcctgtgtaatgcgtctaccacagcatacttacatgcagccatacagggcaagaacatactgcttttgttttgtttgttcagggtagagtgaaacaccacagaaagaatcctgtgttgatctttggtgccttcaaccttcttaaacctgtgttctttgccactcttggtgtttacttcttttctaagaagaaaatttgttaattatgaagaaggcagttgacattcagcagttgactttctcagcacagttacctggtactgactttggaggaaattcaaccaaagatgattaattcagaaagtgtaactatagtcccaaagcagaaacacctctgcagagataggttgtatgtatgtttgtgtaagtgtgcacacgtagatgtagagctgtgtacccacatgagcgttcacacacagaagaataagagaaggaccacttgttgggggtctgtaccattcaggagtaattttcctgtaggatgatagagtaccttcaggagcccaggactgtgtgctcctaccacatctacttcctgggcttgagaaagacaatgaagccctgcggtatactcctctttatgtgagcccttgcctcagaagactgtagcctgggagtatgaaggcgtttgggcactagaaagcagagctgcttcctgtcgtcctacttccaggtttgcccaaagaaagtccctttggttacttcatcccagttccaaacagctcacccccactttgctctcatcatcgttctttcatactgctgtttttgctgcaaagaggaaaggactgagaaagaaatagctaattggggcagggggaaatttgagagaaaataaatggatttaggaaggctaaaatgttcaggaaaatttaaaaatttttcttttttaaacttttaaacttttagatttttaaacgttttaccacctaccccttctcccttaacttcaggtagtctctttaaaaaaaaattttttttttttttgagacagagtctcgctctgtctcccaggctggagtgtagtggcgccatctcagctcactgcaggcgccgccttccgggttcacgccattctcctgcctcagcctcccaagtagctgggactacaggcgcctgccacaacacccggctaattttttgtatttttaatagagacggggtttcaccgtgttagccaggatgatctcgatctcctgacctcgtgattcacccgcctcggcctcccaaagtgctgggattacaggtgtgagccaccgcgcctggccaaaaatttttaattttaattttgaatgggtaataaagtcctatgatttgaaaaccagagattatcaagagatttatggtaaatggtgtcccccacccatgtcctccatctgttcagttcctcctctccccaaataagtaaacacctttagttttttgtgtccttcaaccttctttattcccttccaagtaaatatagagttttattcccaatcctacccctcttcacacaaaaacttgttctgcatcctgcttatttcattgagcacggtattctgaagatcttttaatatcagtttgtagagagctttcagttagcctcttaatttaccttttcctcaacagatcaaaactgcatttttgttagtcatttacacttaagtataacggcatttcggtgcctttgtagctgaaagaactgctgaagcagaaagttgactgtgtgtctggtgatgcagatgcttgctatctgaagaccttaagtctccttcacttagctaagaaaatgctgtctggtttcttgcctcttttatttctcttttttctgcccttctctcttctaacctcctttgttcttttggcttctaaatgctaattctactgttcttatagctaggttttctctttcccacacctttctgataacctaatatcctcaagtggagagtctgggggcatgggaaagaaaagagggcgctttagccctagaccactatggtagaagcagaggaagttcaggtgtaaggaccctaaaacttttggacctcagtaaggacatagacattgagaattaaattatatattattctcataattcttagaattttggacttatttttatgcccttcatcatatattaccacttgagatctaaggacatgttttggcagctgatttgcttagatatggaaaggtctagaactcttctgttctgacaacacctaggtctatctctggcatgtttctttaatatctgaatgatctctaatttagtttgtgcagatgttatcctggacatcaaagatttgcaaggaaaacagccggggtaagtttactgccatgttttcctaaaggctttatataaaatcactatcctccagtggcatttggaaaagaaaaggtattccccattcattacacattcaccagagtggccaaaatgaaacagacacctaataccaagtcgaattgttggcaagaatgtagagtagttggacctttcattcactgggggtggaggtagaaattggtataaccactatggaaaactgttcagcaatatctactaaaattaaacatatgcctatgactcaacaattcgaatcacaacagaaaaatgtggaagaattctcttagcagcactattttagtaggtaaaacaaacctaagtgttcatcagcagtagaaaggataaaagaattatgatatattcacacagtggaatcctatacagcaaataagcatgaacaaactacatgtacacacaacttggagaggatctcacaaatgtactgtaaaacaaaagaagccagacacaagaaagggtacttactgtagaattccgtttagatgaagttcaaaattagacaaaatttatctgtgatgttagaagtcaggatagcagtttccttggcggggcaagttaggagggagtccctagaatactcgtaatgtacttgatctggatgctagttacacagtaatcttaactaatgatgggaaatgtctgccttctttgggcatgtggataaagaggcatcattgcagactagctgcttggctgtagtatgtgtaacactgggatgttgtgcctgagacacgacaagctacctcctgttctggttaggcactccaccccacacaccctgtacacatacctgagggacctgactgggttataacttaacttttttttttttttttgagacagagtttcactcttgttgcccaggcaggaatgcaatggcacggtcttggctgaccgcagcctccgcctcctgggttcaagcaattctcgtgcctcagcctcccaagtagctgggattacaggcatgcgccaccatgcccggctaattttatatttttagtagagacggggtttctccatgttggtgaggctggtcttgaattcctgacctcaggtgatccacccgccttggcctcccaaagtgctgggattacaggcgtgagccactgcacttggccacaacttaccttttaatttgcttttcttcctattcctagaggatgccttgttttgcaagagcttgatgaacttgctcttcagcctgcatgtttcgtataagagtcctgtcattctgctgcgtgacttgtcccaggatatccacgggcatctgggagatatagaccaggtactataatgagccttcagtacaataccctgtgtggggatgggggtcaagggaacaaccttactgtcattaggtctcacctctcttcttttccccaggatgtagaggtggagaaaacaaaccactttgcaatagtgaatttgagaacggctgcccccactgtctgtgtaagtgttgtacctgagccatggggaatagctttgtcattctttccattctactccatgtgaagtgacttgtgtcctatagcggcttgtgtcctgaggcctgtaacccacctgtaggtggccaggtgaccacagttattatattacccccacagctgtgtgtagtgaatcacaccaggcactcttttctttcagttacttgttctgagtcaggccgagaaggttctagaagaagtggactggctaatcaccaagcttaagggacaagtgagccaagaaaccttatcaggtaagataagttcaactgggattccaggaattgacatgagcaaggtcaaaattcatattgggtcggtgcataaaaatggagcccctgagctaaatttcttatttgcctttaagctagattttttcctatgtgatgaaagaagtagaagatcatatgtcttatcacagcacgattaattcactctgcatattgaatgttcgtttttccataaagactttctagttagtagtaatcaatttctaaatctcctttactcttaattagaaaacgaagttgggtttgaatgtgccaattttatttccctttagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatatgtgagtatttgagacaagcagattcgccccaccattctaccccagtgagccaggagatgaggatggggcagcagcccactgctgcagaatgcccctaaacaagagagcatttgcctccatcttggcaggtcatggtttcattttagtttggtcagtaggtggcaggcatctccacaggccagggaaaaacagtttataattctaatctgcttttgggcctgtcacggtggttcatgcctgtaatcccagcactttggtaggctgagacgggcggatcacctgaggtcaggagttcgagaccagcctggccaacatggtgaaaccccgtctctactaaaaatacaaaaagtagctgggcgtggtggtgggcacctgtaatcccagctactcaggaggctgaggcaggagaatcgcttgaacccaggaggcggaggttgcagtgagctgagattgtgccactgtactccagcgttggcaatagagtgagactccatctcaaaaattaaaaaaataaagtaaaaatctgcttttggaggcccttaattctttggcatgtatgtggcacctgattgagaatgaatgcctcttttaaataccttctaaggtttaatctaaactataactatcctagaattaaatctgggcccataatgcatagaaattataccatttctaaccagtctggacacttaaagagatgtttattccttttttcattcctttaacatgtaggtgttaaatgccttatagatcaaatactaaggtggggaagaaaattattttttataaaaatacaaggcataccctgcccttactgtttatgttcctagcaatgatccatattaaatacttagaaaggcacagataatccaagaaagatgtggaccaccccgcatcacagcagtgtggctctctcagaatgtgtagctctagctacatgtggctaagctgctgtagtggaaatactgagagcctcttctctttattggcatctttaaaaggaaaaacagcaaagttgttggttttttacatgcagggactaccagcctgaggaatttttaaagaaatgagcaaatcagaaacaaacccttcattacttattgtctgggaagcttaggagctttggaggagaggaataaggaagcttgtgtcttggcttctctgtgaattttgtttttcctcttcagtcagaatgatgagtcacactccataggctcactgcagcagtcacttgtagtttcataggacagtctactaaatctaggaatctttttttattagtatctccaggtgtgtcagagctccggaggaattccaaaaaatatggaaaagctggtgagttgagaatgcctttcctaggaatgggggaagcacttttactgctggttacattggtttccttctcccttgttgtgcaggtgaagctgtctggttctcatctgacccccctgtgttattctttcatttcttacgtacaggtaagagattcagaggcagtacccaataggtcttcaagaaaggatttcttacatgcccaggggactattgatcacctgaactgagcatatataaacttttttccctgcttaccacaagctggaggcacccatcagagaccaagccaaggcttgagggctttgcagcaaggacatctttatgtaaagaaaactgtttcacttaatttggagaaaggaagcatatatgtttgcatttggagcaaggaaggaacaagcatgctcaggctcaaggacttggtttattcctgggtgactgaaagtccatgccatgaggcatcctctgggaatgtgagcagagtagcagcaagcacatgaagaagggttgtgatgagacggcagtgcagtgagggcactttcagggaagtggaaggacgtggctttgtaagtgtcatttggtcctaaataccatcagattcctgcagtacttgaatctcctttactgtttgcttaaaccagttttttaacctcaccactattgacatgttgcgctagataattctttgttgtgggacctgttctgtgcattttgggatgttgagtagcatccctggcctccacctaccagatgccagtagcagccccctagttttaacagccaaaaatgtctccagaaattgccagttgtccttaagggacagaatcacccctcgttggaaagaggaagaaacgagagatctactgtctcctaaggccacttagtcatgcagtaaatgtatcacagggctgttactgatctttgaggaatcaaagagaatgggtccactaagtgtcaatctcagccaagattctagaaccaattattaaagcaatggatcgtgaccactttggtagtgatgcttcacttgttttctgcctctgcatcacttacaggcacaatatcattctatcagtaacttgcctcattatgtgtattcagggtgcctcttcccctccctttaagaatcagcaatcagctgggcacagtggctcatgcctgtaattgcagcactttgggaggccgaggcgggtggatcacctgaggtcaggacttcaagaccagcctggccaacatggtgaaaccccatctctacaaaaaatacaaaaaattagctgagcatgctggcgggcacctgtaatcccagctacttgggaggctgaggcaggagaatcgcctgaacctggagggcggaggttgcagtgagcaaagatcgcactgttgtgctccagcctagcaacaagagcgaaactccgtctcaaaaaaaaaaaaaataaagaatcagccatcaagtgggctgtcatctgggtttagctgaaggagttcttagtaatgggctgatagttgagactctctgtcaccttgcctttgtatcagttttgtgatctgggtcaggaatgcatcatccattttctatatccagccatccagccagtagtcaactgtcataaagctattacttctggtcctctccttttatctcacccaaatgcttgcaggaatgctttctcaaacctcatgcttgtaaattttcatgtgggtgccattcgtcaaacaaatctgttgtctatatataggatatatatctgtccattcccatatttgggttttgagtttcctcatctccaagtcttaatgatacctataaagacacatttcacaaaatatgctatatagactgagacagtcctcaaaaaaaaaaggaattcagggagagatgctcataccgtatatctctcaccttagagattcgtggtgtccatttgcatattaaaggtgctgagaccagtcatggtggttaatggaggctgaggtaagaagatcacttgaggccaggagttcaagaccagcctgggcaacatagtgagaccccgtctctacaaaaaatttaaaatttaagccaggtgtttgcctatagtcccagttacttgggaggctgaggcaggaagatcacttgagcctaggacttgaaggctgcagtgagccatgatcatgccactgtactccaaggcaacagcgtgagaccctgtctcaagaaaaataaaaacagtgctgagagttccaacagtatgttcattagtagttttcagacctattcaagaacatttttaaaaaaataacaaatgttactatttggcagaataatgttccatagagtacagtttgggaaatactgctgttaaatgctatttactacccttgttatgattcaaaagtcacattgtctaataattttattagaacaggtaatgcttagagaacctctaccttgtgtctgatgtgttaagctcttttcatacatcatctcattcatcctagctataggttatgattagtagttatccccatatgcatgatgagaaaggttaatcagaatgcccaagaacagaccatgagtaaaaggcagatctgagacttgaacccagctagttagactcgatagcaggaattggcacactttttctgtaaagggccagatagtaaatgtgggtcatacagtctctatcacacctactcaactctactattagaacataaaagcagccatagataacttacaaataaacgagcatggctatgttccaatgaaattttcttatcaaaaacaggcagtgggccagatttatactatgggctatagtcagtcaaccattgctctagagtcatacctggtacttgttgacatgtaaaatgttggaaggttttgattttcgtgtttctgaccccattttcaagcattttcttctgggaatcactactacttcctagactgctattattttcccctcattacacagtaatcagtttcatttcctccctaggcattttcctcctcctccatccatatttgacttaaagccttactgacaagtcagctgatctgcaggcaaacattttacatttttctgtttttgtgagatgtatttaatgagtgccccctgggcaagagcccatgcatggttccattaactccagctcttaactagaaatggggattgcattttccacacctctcagtgaactgttaattctcttgtagccccctcttcatttccccagttccttagatctcaatgggaagaaagcaacgaaaaccattgctgcaactcttagcatcctgcccagaactgtatacctttaaaagatgcttctcaagggtcggacatggtggctcatgcctgtaatcccagcactttgggaggccgaggtgggagaatcacaaggtctggagtttgagaccagcctggccaacatggtgaaatcccgtctcaactaaagatacaaaaaatagcagggcacggtggctcacacctgtaatctcagcattttgggaggctgaggcaggcggatcacaaggtcaggagttcgaaactagcccggccaacatggtgaaaccccatttctactaaaaaaaatacaaaaattagctgggcatggtggcaggcgcctgtaatcccagctactcgggaggctgaggcaggagaattgcttgaacccgggaggtggaggttgcagtgagatgagatcacaccactgcactccagcctgggcaacagagcatgactctgtctcaaaaaaaaaaattagccgggcatggtagtgcgtgcctgtaatcccagctactcgggaagctgaggcaggagaatcgcttgaacctgggaggcagaggttgcagtgagctgagatcgcaccattgtactccagcctgggcgacagagtgaaactccacctcaaaaaaagatgcttctcttctggctctaattttagtcctgcccgcccggatcagttggaatgggcagggaacagggttgatctaaggagttccaacagggccccatcttggacacaacctctgggaagatggttcacttcccacttggtcagtgaggtcgatccgtgactgcttccttgccctcttctgctgccttcaccctcttccatgctctaccctgccttccagggccaaaaacagattactgcataccagcccctctggaatgtctgcagttccttattttccagaacgtggcatgtggaacaagtctcctgtttctctcatggctccagttgcagagcctctctgtattttcaggtctgtttctttattctgttgccctcgtggagcatggtatgttcccttcctaagaaggtttagaactccccttgaggtaaaaagctgcctacatttctgtaccgtaccttacatttgggtggtttttctccccagtctctcctgactcaagtcttgattttcttttgctttatcagaatcttacactttttggttccttttattagttattcatccctctccaggagctctttattacccaataatttacaacacagggaagtgttctgtgacccttttaacccttcttgagcatgataacccattgcacataaaatatatctggttttggctttgctgagtaacgaaaataaaatatatctggtgattgcctgtaagtgggaagactgcagggccctgcagcagcctcctcagcttcctctcctttatgggatccttctagcccactggctaaaatagaaatagaaatgaatattcctgctaccaccttgacagtccccattttaaccattctttagtacctcaccagccccttggctgacccactgcagtaatagtcctgccttcaacttccatgtgccagctctaagaacaacagattgtaaacctctcaacaactaaaaaagaaaaaatatctgaggattacaaagcatccattttttccctatcttctaacatctgttgcacagatagtcctgtttactccagacttggtcctcataccctgtgtaattaccttctaagaaaattgccactagttggtgggcatggtggcttaggcctgtaatcccagcactttgggaggctgaggccggcagatcacctgaggccaggagttcgagaccagcctggccaacatggcaaaacaccgtctctactaaaaatacaaaaattagctgagtgtggtggcacgtgcctgtagtcccagctactcgggaggctgaggcacaagaatcacttaactcggggcgcagaggttacagtgggtcgacatcacgccactgcacaccagcctgggtgacagcaaagctctgtcttaaaaaaaaaaaaaaaaaaattagcactagcatgctagctccacagaaaaatcatcaggaataagagaatgtgtttctatttctttagaataagagtaagagcctgaactatacgggagagaaaaaggagaaacctgctgccgttgccacagccatggtaagctgctgacactgaccgttaaaatatgcttgttggtgaacccgaaaacatgaagcggaagaagccagtgacaaaaagaccacgtgttgtatgattccattttcatgaagtgcccagaataaatcatctaaaaaggcaaactagattagtggtagcgtagagctaggtgggttggaagatggggagactggggtgacagctaaaaacggtatggaatttcttttgggggtgatgaaaatgttttagaattgactgtgatgatggttgcacaactctgcaaatactgaaaaaaaagtacattgtgagtgaattgtatggtatatgaattacagctctatcaagctgttagaaaaaattgtgtgtattatatacatggctgcttctcaactcagggattttatgatcagatggagcatcttatttttcctctgaaccaaaaacatgttttattcacgaagcaccagaaaatcttgagttgaaatggaaatagtaaaataacttacgatactcaattgggagaaattatttttaggtaaagttggtgaatgcaaaaggtgctccctaaaagatgtgtaagagtcagcgggggtacaggaaaggaggcacttagtacattgctggcaaaggtgaaaattagtacagcctctccagaggcttagcaatgactactgaatcccattctgatgtagcagtttcacttttaggatatacaggcctgtgtacaggatggtcctcacaacattatttataaaagtgaaatattagaaacaaagatatccattaatagaggactggctaaataggttataatatatttatactggagagatatgaaaaaaataaacatctaaatgttcagctctctggaattatctccaagataatgttaaaaaaaatttgtacagtatcctcatgggttaaaaatacacacacacacacacacacacacacgtaggacctacaaattacaattcacgttagggggaaagatatataatcacacacacacacacacacacacacacacaaatgtaggacctacaaattacagttcacgttagggggaaagatatataatcacagacacacacacacacacacaaatgtaggacctacaaattacaattcacgttaggaggaaagacacacacacaaaaacgtaggaccacacacaaaaatgtaggacctttcgttagggggaaagacacacacacacacacgtagaacctacaaattacaattcacgttagggggaaagatatataatcccagcagtgaaaattcatacccagaccagaacaaggaaatagagctagggccaaaataggcttaagaatttcaagtcagaaaagcaactaaatttctacaagtgatcctgccctcctcagccattttctagataacaacaaatactggaattataaatgaaatggatcagtgcaattatctctactggcatttgggtccttccagattgaactgccaaaaattttagattactggtatacaactgcatttgattgggagacagactagttttcccctaaagccatacagttttgtaagtgacagcttcagaggaaaacttcaaaaaccattgaacctgaaatttaagtcttatgttctttgcccttaggccagagttcttcgggaaaccaagccaatccctaacctcatctttgccatagaacagtatgaaaaatttctcatccacctttctaagaagtccaaggtaaacattctcttattatgtgctaccattcccatttaccttcttgacagatctggcaaactgaagcagcacaactacaatggaggaaaagagactctgggccatttgtgtgtttgccatcccccctctccccccccccccctttttttttttgagactgtgtctcattctgtcacccaggctggagtgcacattcaagtgatcctctggcctcagcctccagagtagctgggactacagtcatatgccatcataccccactagttttttgggtttgtttttgtagagatggggtctcactatgctgcccaggctggtctcaaactcctggcctgaagtgatccttccaccttggcctcccaaagtgctgggattacaggcatgagccaccacactcagcctctttgctgttcttgatctgatgacctgaaccccagcatacagaaggaagtgggtgcgtgcttgctttaggtagaaatggaaaggtttctcagaggtgaactaaaaatggcttaagctgttctggcaggacctatgagtagggagatgtcccatgcttacaatcttgtcataggtgaacctgatgcagcacatgaagctcagcacctcacgagacttcaagatcaaaggaaacatcctagacatggttcttcgagaggatggtgaagatgaaaatgaagaggtcagtgctggcttctgtctggagcccagccactcttcctagctggttagcagcctatctgggagcagtcacagattagtggaagggcaacagaatgggaaagggctaaaaggtgatcaggcaaagatgagagcaaaggactctcagaagggttgtaaactttggaccacacaaaatcctatgaagttgccccgacttgtttgataaacacttccaggaagcaggtggtaacaaaacaatgtcctgctgtgggtcctcttcctgttaatcttttaaactactggatgatgaccagctatagcagtctggctcagaaactagtttacctctcatgtcatgccctcattcaaaggccactcattagtttgggttaaggcttcttccttcaattcatgccaatgtcttgtccttttcccttgtggtttgttcctctccctttactcttagcaagtgacagtaccgcatccccatccctgcaccacctttgaaacagaacccaatgtttccttacttctagcacctaaaattttcatcttaggtttgtctaataagtagcaaatcagtagcccactcccatttcaaaactggaagtttacatacaagtgccctggatttcagaattttgaacatgcattcttcagatgatcacactccaggctctaatgtacctggccccatccactctctttacccacttggcagctgcactcaggagagtcatgtagcattttgatgtcaatggcttcttctcttgtcattttgtcccataagtatcctcagtatagcaaaagtcctaaaaggaggtgccactgtcttattactctacactttggaggactccttcctcttcttcaacaacataattacctcctgtgagtgggaaagtggggaaagcatgactaacaaaggctttgatgagaagatagagtcttttttttccttctttttatttccactgccttggagcaggtttatcacgttagagcattaattctttccccttctagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacattt

SEQ ID NO: 121 - DNA, 184935 bp, Homo Sapiens
ttgcagaaaaataacggggaaaagctttttgttaaaattaatgttttgaatagaaagatcttaacaacaaagccttatagaaacttagaaacagtgccaaatttaaacccatgtaataactaagtgcatagaaacatagtaatagttttataacacaattctagacagttttaaataatttaatcaagtcatgaaacatctactctttacattgtacctttattccaagaataaagccctgtctctaactggtagttttcctggtttgcagcctgtgtgctctatatactttcagtccttgaataaattcagtattagataattatttcatatgcattgaatgtgtcacataaattatttgataaacaatctctaccttatacatctcaaaagcttaaaaaataagccagccaaataatttttctttcctcaaatctttattgtcagtctatcacctatatatctatagttagggaagctttcatatagagcaagggtgcactccagatatatgattcatctactaattaataatgaataacttgcaatgtgccaggtgctcttttaaaagcatttagatgttttaacttatttaaatctgtaaacatttcttttaaaagtatgttatcagtaatgaaaatggcctacatcctactctataaaggccagtagtttacttcttggaatatcatcttggtcagtcatgatctgaggagaatatacacctgtttcaacagtgattatcattgtataaaatttttgaaacaccttttggaattactaaagggttgtgacacatctctatgtacattctcagtaatgaaaatttttaacttcagggagaattaaattttggaaagaataaaaaatatctaggccaggcatggtggctcacgcctgtaatcccaacactttgggaggccgaggtgggcagatcacttgaggtcaggagtttgagaccagcctggccaacatggtgaaaccctgtcgatacttaaaaaaaaaaaaaaaaaaaaattagctgggtgcagtggtgtacacctgtaatcccagctacgcaggaggctgagacatgagaatcgctttaacctgcgaggcagaggttgcagtgagccaagatcgtgcctttgcactccagcctgagcgacagagcaagactgtctaaaacaaacaaacaaaaacatatctagctagggaaaggggaaagtattggagatgaagttgggtaataacactaagatatgaataatatgcttaattttctcatgtagtttaccaattctaaaggtaatttctttttttttttttttttgagacggagtcccgctctgtcgcccaggctggagtgcagtggcgcaatctcggctcactgcaagctccacctcccgggttcacgccattctcctgcctcagcctcctgagtagctgggactacaggcgcccgccaccacgcctggctaattttttgtatttttagtagagacggggtttcaccgtgttaaccaggatggtctcgatctcctgacctcgtgatccgcccgcctcggcctcccaaagtgctgggattacaggcgtgagccaccgcgcctggccctaaaggtaattttaaaagtcctcaaaatgttttaattgtagcattgcgaaaataaatatctagctttccaagttattatgcacatataccatctgtgtcagtctgttctcatgctgctaataaagtcatacccaagactgggtaatttataaaggaaagaggtttaattgactcacagttctgcatgactgaggaggcctcaagaaacttacaatcatggcggaaggcaacttttcacagggcagcaggagagaagaatgagagtgaagcagggaaaagctccttataaaatcatcaggtctcataagaactcagtatcacgagaaccgcatgagggtaaccgcccccacgattcaattacctcccactgggtccttcccacaacacgtcgggattatgggaactacaattcaagatgagatctggctggggacatagccaaaccacgtcaccatcgttccctaaatgtaaatgagtaagagccactttactttttaaatgaaataatatgctttattttaaccgttctggaacaaaagcaaatgaaaatcgactcagaatatcaacagacattcctttatagattctcaaagcacaaagaaatttgtatgattttatagtactaaccgctgcattttacagatgaaactaattccctgaagggtgtggtgattgccaatatgacttagcaaatcagtggcagagccaggtgtagagcccaagtctcttgtcttctaccaggtatttattcgtttcactaccctactatccctatctgtggtttaagaataataccagaggagataaattgtttcaccctttcaaaacaatgtaaaaattaccttctaatcgagtatttggtatttactgctcaatgatcaactagaaaaaatatataatactagatgggatctaatatattctaaattctttaactggtaacttgtcaatttaaatgtctttgaactacgcttagagttgtaacatcaaatgctatagaaacaggctgtaaaaatctaaatgtctcaaaatggaagcaaagacatacctatataatgattcatttatccaaatgaaatgtaaagtaaatccttactggaaattttgacttgaaaataatagaccatacagaattcttggatagctcataaaatttcaattcaaattactcacaaaaagtcccaatgcccagtgaataacagatgtttcttaaaaagagatcaatgaatgtatttttggaatgatgtcagagatgagcctcttttataatcatttttgattagacatatagcttcattcacaaaaacacaaacaaggtcaaaattcacagaaaggattactgtgccctaaggaaacatattttagctgcagctataaatgtgggtttgcttatcaaatttatatatgaagttttctatcttaatcattgtataactaaagcttatgctagaacaataccagaggggataaattgtttcaccctttctaaacaatgtagaaattaccttctagtctagtgtttggtacttattactcactgatccactaggaaaaatatataatactaagcaggatctagtatttttttccacaatgatggtgaagctaaataattagaatagaaaatttggaatacttcatttggcattttatatctttacgtcaatttgtttatgacatgtttggttttaggtttattatacaaagaatgtaaaacaatttcaattaaaaatgcatactactttcttaatttctcttaattacttataagtaggcagtttaataacgaaataaacctttcaagacaaatggtgatctctgaaaaagtcttggactgatttgaggtaaaatctatagcgaaatatgactgaggtgtcactagattagactgctgttaatttttatgtatcagtgtgaaaacaaatggatgaagagaaccacctaatatgaatatttacgtgaaactagaagtgccctaggatctttgaataattttaaattgcatttagctaaggaagacttatttgaggacagtactttgtatgaattactttatcaaaactcaagaatgggccaggcactgtggctcacacctgtaatcccagcaacttagggaggcagagaagggcagatcacgaggccaggagttcgagaccagcctggccaacatggtgaaaccccatctctactaaaaatacaaaaactagctgggcatggtggtgcacacctgtagtcccagctactcagaaggctgaggcaggagaatcacttgaacctggaggtgaaggttgcagtgagcccagagcacaccactgcattccagcctgggcaacagaccaagactctgtctcaaaaaaaaaaacccaaaaactcaagaataataacatttacatttctgaacataaaatagttttttaaaaagtatgccacttattcaatttacaaattattacttacaacagagtttaacataagcatgatgacatatttttacttagcttgagagttaagtattattacttaaaaccaggaaacatgcctttatttttggaaggagatggtttaaagttctttatttctatttcatgagtttttcccagttccagttcatttatccaagttgtttttacattaccatcaatgtcatcaattttactttcttcaatatgcagaattccattcaactttgtatctatgcaatcctcagctttcacttctctggctgaatctacttcttttatagttctaatttcaaaaaggtctttagctaaaatgcaatctgaattgttagccaatctatttcctctatcagtttcagctaggtcatttttttcttcatctgtatcttcaggatcataaagttcaggtgtaaaatagatagattcatcttctgcttctgtttcaaaatctctatttgaagtggactgtttatcttcttcacttactagagacaattcaatgtctggatccagggcttcttcagaacagagcggatgttcagaatgattttttctagtaagggtggcatcaatctttaatgatgaaataatggtttctgattgagggcatgatccaaacgatgtgtttactgtcagatttgaggattcacatttatcagtgaagggcaaaacagttttactttccatcttctctgttttgaaacggggaggactagaggcactattctctgatgacccgagctcaggtgttgccttcggtattttaccagtaaaatactgtcccaaagaattaaagcttgaccagctaactctctttgtttgtttgttgaaagttgggcttgtggatctggaaatcacaattttttctgctttccctgcttcttccaggaatactggatcatctaagaatacaagaatttaagagatttaactttctgctcctagctaacataattgctaggttaaaataattatttattagaaatacctaaataactgtataggatacataacttagagcccccaacgaatactagtggattttcatcttggaacagaatattaactctgaaagaaatcttaggtctctaatgtttcctagcccaagttataatgctgtctggtaaactatcaaattccacagcagggagctcaagaatgaatgaggaaagaaggggtaaaagggaagaggaagggagctgaggaaaggagggaacaggctgtaaacatttgccttgaaaatccactaaccagtgactgagaaaaacttacctagactaattcttttatttaataaataaggaaagtgacataaggctaagttatttgctcaaagttataaaactggttagtaagaagaccaagactagaaactaggtttcctgattaccaagttaatcggcttgaattcactatttatagtgaattttgtattactattttgtagtatttatatacaaaattgtattactattttgtagtacttatatactacaaaatacatgtttaaaaattgatgtttttcttttttttagtccgagttttgcttttgttgcccaggctggagtgcaatggcgcaatcctggctcactgcaacctccacctcccagttcaagcaattctcctgcctcagcctcctgagtagctgggattacagacagctgcctccacacccagctaatttttgtatttttttagtagagacggtgtttcaccacactggtcaggctggtctcggactcctgacctcggatgatccacccgccttggatatatgaattaaaacaactgaaattatatccaatggaatagaccagagtttggcaaaccttttctgtcataggccagatagtaatatttaggctttgtggagcataatgtatctgttgcgactactcaattatgctgttctagtgcaatacacacaaatactcaactctgctgttgtttctaaaatgtaaataaatgggcatgactacatttcattaaactttatttacaaaaacaggcagcaggccaaatttggcccatgggccacagtttgccaatctgatacagatgattatttcaaaatattttaaaatattatttttcatcacttaaaataaatgtctctcacctcctaaaaataagttcataagaactatctatataggaaaagtagttcatatagaagtatctacataaaaattaggccaaatttttatatagcctttagaataacatctaccacttacatggtactttacaatgctgtgatatttataattttgacctttacaacccaacctgaagggatagctaggcaggcattttttttttcctattacgactcaaaaaggacaaatgacttgctcatgatcacaaagctagtaagtggcaaagccagttagtggaaaaccagaaaatatgctctggtctcctgacaaaagtttgttcccattacagtacaccatactgtttcactattttatgataacaccttatattacaaaccaccatatttaaggaattaatctatacccaaataaatatcatttcactaaatataatgaaagacttctctatcaaaggtaaatgggaagaacttttcatacttttctcctttctggagataatgctacttggtagaggtgaatttttggtaataattttaggacactgtagttcctggacacatatctttgcttcatcttccacaaaattttctggtgatagatgacttgctgcttccagtaaataaggtgaggtactgtactttaaagaggtcacttcaagtgtagactcattgtcctgtatattggttctgtcctttatggatacattaagaactttttgatgctttttggaaaattcagccaaggattccagtgcactttcaaaggttgaatggtgctgaatctgctgccgtacccatttagaaagtcctaaagaaaaaggtaaacccagggaaaatttggttacttagttattaaaatattacatgctaaggtaatacacttgctttttctagtgaagtaacctaatttgtattttgaatatacagaatggttctccatatgttttttctgcaattcagcaattttactacatatgtatcagtaacatatgagtaacattctctttatatacagtaattgtcaaatggagagagcaaagaggcagtagaagtagggcagagatgggaaaacatattctctggttaagaataactggtgaacatggcaaatttaatttcatcataattccccacaaaaattgccttttttttttgtagggaaactagaagttgtaaacaatacaactttccattctaatattctaaattttactccttttgcaaaaataatttcaagattctagtctcaagtttttttgttcccttcctccaccaattccaaatatatcttaaattaaaattattctggaggtgaaataaataacactgtcttatgggtaaatcacatcccttctgaatttttatgatataattatttttaatatataatcaagttataaaggatatgatttgacctgtgacataaaaactgcacaaaaatgaaacctaagagtttaaggtgttttctagtatggtgtgcttccaaatgaaatgcaaaatcaggtatttggacttttacaaaataaatattccctgctaacactactaaaactagcatcatcttttggaggaattagttttaaaagtcactatagggtaaaaatttaagttctagattttaaaactaaaaaaattttaaataagccatttcccttgaagttttttattttgttcatttggggaatatgattagaccataaaaatatgtgaaattctctaaaattgaaaatttttaggctgagtgtggtggctcacatgtataatcccagcatttggggaggctgaggtgggaagattgcttgaggccaggagttcaaggtttcagtgaactatgatcacgtcactgcactccagcctgggcaacagagtaagacctgtctctaaaaaagaaataagtaaataaaaataagaattttagtactatatttacctcttcatttcaacctttttataatcaaagaaagccttttcaatgtaaaatatcattgtctgcttttgaaaacttgaaagaatctgagctccacctgctgactagacaccagcacttagcatttttgcctttagttactgtttgacctatgctactgcacactttacgtggaaagggaagataaaacaaataaagcaatattttctgctttatgttttaatatcaaaccaaatacagtcattaagctctgaaattgaaaaggtagagtctacacccacacatggctaatctaaaacaaaatttaacatctctttattataataaaatgtattttttttttagctaaaaggtaataataaagatacacatgtatcccatagctctttagtaatcactcctggtattgactctgaaaactgtttactgttggatgaaaccatcgagtgagaaaaaaatgatactactgcctgcatcaaagcggtaggaaaatttgtggcaccctcttgtcatgatccccacttcagaatatacctggctgcttcttcctggggagaaaagagaaaactggaccttatgtctttttctgggaggctgccccagggactggcttctatcttacctgtactgaagagctgacatgagctggcataccctacatgcccaggggccactaagaacaaaagcgctgtgcagcaagtttctgctccacaggaaccacagtgcaacagaggcccatatagtttgatggccactccctcagggggacagaaaagcctggagtgtgcatccaacatcttggcttttcaaggagctgtctagggactcgtttctgtcttgcttgtcatagagtactgactggacctagcatactctgtatgcctggaatctactaagaacaaaagagagtcaggcgtgatggctcatgcctgtaatcccagcacttagggaggccgaggcaggcagatgacttgagcccagagcccaggagtttgagaccagcgtggacaacatggtgaaaccccatctctacaaaaaatacaagaattaactgggtatagtggtgtacacctgtggtcccagttacttgggagactgaggtgggagaatcccttgaacccaggaagccgaggctgcaatgagctgagattgtaccactgcactccaacatgggcgacagagtgagaccttgaccaaaacaaaaaaaaaccaagcaaatatttctaataaggaatttacagagaagtccaaagaagacagatccacggaaaaggtttgagaggctcccagaatgcctaccagggctgatgagtgaaggtctttccctgtacaaaaccagttagtaaacactgtgagaggtggctgttttttcaaatgtgtggataccatacaaggttacaagaaacataaagaaacaggaaaaaataaccctgtcaaaggaacaaaataagtctccagaaaccaacccttaaaaaaaaaaaaaagctatatgaattacctggcaaggaatttaaaataactgtcaacatgatgctcacaagttcaagaaaataatatagaaaaaaaggagaatttcaacaatgataaagaatacaaaaaagaactaaagagattttggagctaaaaaatgcaataactggactgaaaaattcactacaggggttcatcagcagacttgatcaagcagaaggaagaatcaggaaatttattttattttactttattttatatattttatattctgttatgttatgttatgttatgttatgttatttttttgagacagtctcgctctgtcgcccaggctggagtgcagtggcgccatctcggctcactgaaacctccgcctccctgattcaagcgattctcctgcctcggcctctcaagtagctgggactacaggcatgtaccaccacacccggctaattgtcgtatttttagtagaggtggggtttcaccacgttggccaggctggtcttgaactcctgacctcaagtgatccaccttcctcagcctcccaaagtgctaagaatcaggaaatttgaaggcaagtcgtttgaaatcatccagtcagggaagcaaaaagtaaaaaacaaaatggaaaaaaaaaagtgaaggcttatggcttcatttatgacttgacttatggggcaccgtcaagctgaccaatatacacattctgggagtcctagaaagagaaagagagaaaggagcagaaagcttatttatagaaataatgaccgaaaacttaataaacctggggggaggaaaatgacatccaaatacatgaagcccagtgaacctgaacaggatgaacccaaaagtctgtaccaaaacactttataatcaaagtgtcaaaagtcaaagaaaacaatagaaatttgaaaacagcaagataaaagcaacttgtcatatacaaatgaagtcccataagacagtcactaggccgggcatgaaggctcatgcctataatcccaacactttgggaggcagaggtaggagaattgcttgagccgaggagtttgagattagcctgggcaacatagtgagaccccatctctacaaaaaaaattaaaaattagccaggtctggtggtgcatgcctgtagtcccagctgaggctgaggtgggaggatcacttgagcctgggaggctgaggctgcagtgagtcatgatcatgccactggactcctgcctgggtggcagagtaacatcctgtctccaaaaagagaaagatttctcaggcgacatcttgcatgctgtaaggaagtgggatgacatgtttgaagtgctgaaagaaaaaaacctgccagtgaaggatattatatctggtaaagccatctatcaaaatgaataggaggtaaaaacttttccagataagcaaaagctgagggacttcaccactaaacgtgccttacaagatatgctaaaggaagcctgctaaacagcaacacaaaagcataaagtttgctcgtgaagttaaaagtgtacacaaatacagaatactttaatataacaacagtgatacataaataatgtttaattctatacagaagttaaaagacaaagtatgaaaataactataatagtatgttagtggatacactatataaaagggtataatttgtgactttaataataaaatgtgatgggaaaagtaaaagtgtagagtttatacaactgaaatgaatttgttagctgaaaatattgttataactatgtttcatgtaagacccatgtaaccacaaaggaaatatctatagaaggtatacaaaagaaaaatgagaaaggaatcaaagcatttttcttcaaaaaattaaaaaatgaaaagcttttaagaccagcaacaaagcaaggatgttcattctcactacttctatttagcttagtactaagaatcctagccagactattaggcaagaaaatgaaataaaaggaatccaaattgaaaaagaataaagtgaaatgatctctctttgcagatgacatgatcttttatgtggaaaaccctaaagattgaaaaaaaacctgttaggactaataaatccagtaaagttgcagaatacaaaaatcaatgtacaacaatcacttgcaattctatacactaaaaacaaccaaaagaggaatgtaagaaaacaatcccatttataatagtatgaatgaagctggaaaccatcattctcagcacactaccgcaaggacagaaaaccaaacatggcatgttctcactcataggtgagaactgaacaatgagaacacttggacacaggaagggggacatcacacaccggggcctgttgtggggtggggggagaggggggagggatagcattaggagatatacctaatgtaaacgacaagttaatgggtgcagcacactaacatgggacatgtatacatatgtaacaaacctgcacgttgtgcacatgtaccctagaacttaaagtataataataaaaataaaaattaaaataaaaaaactcaaaccagggaaaaaaaatagcatcaaaaataataaaatacctaggaataaacaactaaggaggcaaaaaacctgtacactggaaattataaaacattgctgaaaaacagtaaagataacacaaataaatggaaagatatcccatgttcacagattggaacacctaatattgtcagaatgtccatactactgaaagcaatctttttttgagacagaatcttgctctgttgcccaggctagagtgcagtggcgcggtcttggctcactgcaacctccgcctcccaggttcaagccattctcctgcctcagcctccagaatagttgagattacaggcacccgccaccgcacccggctaatttttgtatttttaatagagatggggtttcaccatgttggccaggctggtctcaaactcctgacctcgtgatccacctgccttggcctcccaaaacactgggattacaggcgtgagccaccatgcccggctgcaatctaaattcatatggaaccacaaaggaccacaaataggcaaaagaaccttgagaaaaatgataaaagctgcaggcatcatacctcccgattataaaatacattacacagctgtagtagtcaaaaaagtatggtactggcataaagagaaccatataagccaatggaacataatagagagctcagaagcagatccacacatatatggtcagcggatcttcaacagggtgtcattggggattgatatgctttggttatttgtttcctccaaagctcatgttgaaatgtgttcccccatgtcataggtggggcctagtgggaggtatgtgggtcatggggacagaaccctcatgaaagccttggtgctatgattgtagactttctgaggtcctcattagaagcagatgctgatgccatgattcttgtgcagcctgcagaaccataagccaaataaatctcttatctttataaattatccagtcttggtattggcaatgattgtttggatatgacaccaaaaacacaggcaataaaagcaaaattagacaaggaagaccatgttaaactaaaaaacttctgtgcagcaaagtaaataatcagcagagtcaaaaggcagcctatagaatgggagaaaataatttgcaacgcatatatctgataaagagttaatccccaaaatatataagaaactcctatatctcaatagaaaaaacaaacaaaaaaacacaccaaaaaccaaaccaaaaaaacagatatgcaaagaaatccaaataacccaattaaaaaatgagcaaatgaaaagatgtttctccaaagaagacatatgatttggccaacaggtatagaaaagatgcttaacatccctattcatcagagaaatgcaaatcaaatccacactgtgctatcacattatacctgctaggagagccattatgaaattttaaaaagaaaaagaagaaaaaaggaaataagcattagggaggatatggagaaactggaacccttgtgtgctattggtgggaatgttaaatggtgcagttgctatgaagaacagtatcaaatcaaaaaattaaacttagaactatgatgattcgccaaatcctacgcttggtatttgttcaaaaaaattgaaatcagcatcttgaagagatatctgcattcccatgtccattgcagcattgttcccaatatccatgagggggaaacaacctaaatgtctactgacagatgaatggataaagaaaatatggtataatgtatacataaaataaaatattaagcagtcattgaaaagaaggaaatcctgcaacatagatgaaccttgaggacattatgctaactgaaataagccagttacagaaggacaaatactgcataattcaatttatatgaggtatccaaaacagtcaaactaatagaagcagaaagtatagcggtggttgtcagtggacaggggggagagggacatggggcattgctgttcagttggtgttaagtttcagttatgtaagatttaaaagttctagatatctgctgtgaaatactgtgcttatagttaacaatattgtactgtgcacttaataagatagtagagctcatgttatgtgtttttcaccacaataaaaatatgaagattgttactagtttttactctaagcccagctgagatcttaccagatatatagcgacttgggttattcctaaagcgatcatccactagaataagagctccccaatcatttctgtgtctaatacatctagaaaaaatagggaaaaagtcaaataattataacatcggaaataaatccagttttccagtgggacagacagaaaattggaaaaaaatcaattttatagattcctttaaacaatttgttattatcagaaaagttacagaagctatccaacacaatgtaacaaactagatgtattaaaaattccctactttttccaaatacagataacttgcatccaaaatgttgtattttattttgcactcaagaaaattatagaaaatatattctaagatctttcttagccacatagactgttttcttttttttaccttaagtattataaataattgtaaaggtcctttttactagtttgatgagagttttaaatcatgaataaacatttaattttgtcaaaaatattctaaaattcaattgacataacatgtagtttttcttcttttgactgttaatatggtagattacactggttcattttcaaacactgaatcatccttgcattcctagtcatggtgtattattctttttatagattgttggattcaatttgctagtttaaaaaaacacattaaaaataaaaacatactttttaataattattaaacaattttaaagtgcacaatgcaatggtttgtggtatatttacaaggctgtataacctataccacttatctatcccagaacattttcaccaccccaaaaagaaaccctgtgcccactaattgttactccaaattatcccaattattccccattacctctggcaaccactaatctttctgtccttagagagttgccaattctggacatttcatttaacgggaatcagacaatatgtagcattttgtatctggcatatttcactgaacatgatgttttcaagattcactcatattgtatcatttctcagtacttcatttataagttaatgtttccactttttggctagtatgaataatgctgctattaaacatttgggtacaagtttttatatgaatacatgttttttattctcttgggcatacacctagaagtggaattggggagtcatatagtaattctatgtttaactttttcaaacactgccatactgttttccaaagcagctgcacattttacattcccaccacctacgtacaagggttccaaaatctccacatcctcaccatcatttgttattgtatacccttctaaaaatatatctaccctagaaagtgtgaaataatatttcattatggctttgatttgcatttccctaacaaccaatgatgttgaacatcattttttacgtgcttactggccatttgtgtatccttttttggagaagtctgttcaaattattggtccatttttaatggcccattttgtctttttattattaagttgtaagagttctttatatattctggatactagatcctgctacacatgatttacaaatattttctccatatgtgagttgtcttttccatttcttgatactgtcctttgaagaataaaaatttgaactgtaacaaagtccaatttatctgctttttctttggttgcttgtgcttctgatagcagatctaagaaactattgcctaatacaaggtcaagaaaatttatacctctgtttttgcctttttctgtctttgatccactttgagttaacttttgtatatggtgtgaggtaggagtctaatttcattatttgcacagatatccagttgtcccaacaccatctgttgaaaagactattctttctttgagttgtcttggcactcttgtcaaaaaccagttcactgtagatgtatgaatttgtttatggaccctcaattctacccattgatctatacatctgtctttatgccagtacaacatagtcttgattattgtagctttgtagtaagtttgaaatagaaaactgtttgttctcctagtatgttcttctttttcaagattgttttgactattctgggttccttgcttttccataataattttagaatcagcttctcaattcctgccagaaagtcagctgggattttgattagtattgtatttaacctctatatcaatataggggagtgttgatatcctaatgataagtcttctaatccatgaacgtgggattctttccatttatttagaattttctttcaataatgtcttgcagttttcagtatacagatctttcatctccttagttaagtatatttctaagtattttcttctttctgatgttattttaaatggtattttttaagttcatttttagatttttggctgctagtgaataaaaatgtcattgattttttaatattggtcttgtaacctgaaaccttgctgaacctatcagttctgttattttaaaaatggatttcttagaattttcttagaatgtaatatatcatttgcaaataaaaatagttctgcttcctcctttccaatctgtatacctttctttcttcttcttgtctcactgccctggttagaacctccaatacaatattgaatagaagtggtaagagtgaaaatcactgtcgtgatcttgaacttaggaaaaacatttcagtcttttaagattaagtatgatgttagctgtgagcttttaatagatgacctcattaaagctaagtaagtaaccttatattcccactttgttgagtattttcatcatgaaaatgtgttgaatactgttttatgctttttttttttttttgcatcttgagaagatcgtgtggttttagtcttcttttaatatggtgtattacattaattgattttataaagcatgttgaaccagtcttggattgctgggatcaatcttacttggtcatggtgtataatccttttagtatgttgctgattctgtcaatggcttttatttctatagtcatatgaaatattgctgtacaatcttcttttctcgtaatgtattttacttgttttagtatcaggtaatactggccacatagaatgagttggtaaatatttctctcccattttttgctagagttaatgaaagattaatgcaaattcttctgtaaatttttggtagaattcaccagtgaagccatttgatcatgaggctgaggcagaagaatcacttgaacctgggaggtagaggttgcagtgagctgagatcacgccactgcattccagcctgagtgacagagtgagactttgtctcacaaaaaaaaaaaaaaaaaggccaggcgtggtggctcatgcctgtaatcccagcactttgggaggccaaggtgggcagatcacgagatcaggagatcgataccatcctggctaacacggtgaaaccctgtctctactaaatatacaaaaaattagccgggtgtggtggcgggcacctgtagtccccagctactcgggaggctgaggcaggagaatggcgtgaacctgggaggtggagcttgcagtaagctgagattgcgccgctgtactccagcctgggcaacagatagagactctgtctcaaaaaaaaaaaaaaaaaagggggggggaagtgttttgatgacaaattctatctttacttgttatacatctattcagatattctatttcagctggtcgcagtggctcacacctgtaatcccagcagtttgggaggtggatcacgaggtcaggagttcaagatcagcctggccaacatagtgaaaccccgtctcttctaaaaatgcagccgggcatggtggcaggcacctgtaatcctagctactcaggaggctgagacaggagaattgcttgaacctgggaggcagaggttgcagtgagccgagatcatgccattgcactccagcccaggcaacagtgtgagactctgtctcaaaaaaaaaaaaaaaaaaaaaaaaaaaaaaaaaaagatattctatttcttcttgatatattctcagtattttgtgtctatctatgaatttgtccatttaatctaagttatttgtcatcacacaatttttgaaggtattctcttataatcctttgtatttctgtaaggtagtaacatcccctctttcatttctaattttagtgaattagaacttctctgtattttctttggtcagtcttggtacaggtctgtcaattttgttgatcttttcaacaaatcaacttttgttaccttggttattctctactgttctttgaattctctatttcatttatttcctttttcatttctagtatttcctttaattgcctcgctttgggtttagtttgctcttttttttttcctaattccttaaggaggaaggttagattattgattccagatgtttattcttttaaaatacagatgtttacagtattttttttttttagacagagtctcgctctgtcagccaggatggagtgcagtggcatgatctcagctcactgaaacctccgccccctgggctcaagcagttctcctgcctcagcctcccaagtagctgggattacaggcatgtactaccacacctggctaatttttgtatttttagtagagacggggtttcaccatgttggccaggctggtctcgaactcctgacctcaggtaatctgcccgtgttggcctcccaaagtgctaggattacacacgtgagccaccgtgcctggcctagatgtttacagcttttttaagtttccctgggagtagtactttcactgtgtccccaaaattttgggacattgtttccattttcatttatcacaatgtatttttcaatttttcttctgatttcttctttgacccactggttgtttaaaagtatatcattgaatttccatgtatttgtgagttttccatttttcctcccattattgatttctggtttatttcattgtagtcagaaataatacttgtaatgatttcaacctcttaacatttatggaaccttatattttatggatgaacggatggcctatcctgaagaacatgccatgttcacttgagcagaatgcgtattttcctgttgttgggtgaagtgtgctacagatgtctgttaggtttgtttgtagttgttggtttgtagttttgttcaaggcttttattttctgttgattttccttctagttgttctacccattattgagcagggtatggaagtctccaagtattactaaattattgatttctgatgctttttgctagatgtgttttggggcctttttgttaactttgtatgtttataattgcatatttagacttgttatttttttttattttttatttttatttttttttgagacagggtcttactccagttgcccaggctggagtgaagtagtgaggtcatggcttactgcagcctcaacttcctgggctcaggtgattctcccacatcagtctcctgaatagctgggattataggcacatgccactacacctggctaatttttttgtacttttagtagagacagggtttcatcatgttacctaggctagtcttgaactcctaagctcaagcgatctgcccacctcagcctcccaaagtgctgggattgcaggcagaatggcacttttatcattataaaatgttaattgtttctattaacttttttttgtcttaagggtctattttatctgatattagtataaccaaaccagctctcttttgtttactatttgcatggtatgtcttttcccatcattttattttcaacctatttgtgttttttaaactagtgtttctcttgcagacagcatatatcacattgttttcaatccattcagccaaactttgcctttagattggagtatttaatccatttacatttaatgtaattactgataaggtaggatttactcagctattttgtaaaatactcactttgctatttgctttctatatgccttacgtattttgttcttctgtctttccattactttccattttctccaatagacactttccagtatataattttaattctcttgtcatttacattactatattttcttatttttattagtggttgaagagtataataaacatatcaaccagtaataaactagtcaggaaaattgccaacttaatttcaatagtacaaaaaaatggtccttctgttccctcatctgtcacctttgggttgttattgtcatataaattatatctttaaacattgtatgctggtgcagaagaattaacattgtaggttggattgtttacccctagaaaggtctgtttaaaggtgttcctgggctgatgaatgaaaacttagattcaggagggtacctgtgattgactgataagagtgtctcactgtgcctgaactgtttgagtaaacaatatattaatgctgaatactcattctccttttgagagtctagtcttctggaaactgctaggcagaggctgcctatatgaccagccccagtaaaatccctgggtgctaatgagttcctctgattggaaatatttgacacatgttgccacaactcattgctcggggaagtgtgtcctgtgtaactgcactgggagaggacacttggaagcttaagactggctccctagactttgtcccatgcacatgttttgttctctttgctgactgtgcttggtgtcgtttcactgtaataaatcctagccatgtatacagttatatcctgaggctatctaactgttccaagtgaattgctgaacctgaaggtggtcttggcaacccacaagacaatcaccacagatttacaattattgttttatgcagttgctcttttaaaaaatcaagagtaaaagaattataagcaagaagtacctttatattaacttttacatttacgtatgtcgttaactttgtgggtattctttatttcatcgtgtgcatctgacttacttcctaatatcctttcatttcagcctgaaagactccttttagtatttctcgtaggacaagtttgctacagagtaattctcttggtttttgtttatttgggaatgtcttaatttttaccttatttctgaaggacagttttgttagatatagtattcttggttgacagtcattttctttcagcactttgaacatgtcaattaactgcttcctggtctggaggatgttttgtatatgatgagttatttctctcttgccgctttctagattctgtcttctggctgtttgatttcaaccatctagataggaatctccctgagttcatcctacttggagttcgcttatcttcttggatgtataaattaacgtttttcatcaaattcggaacgttttcagccataatttctttaaatattctttctattcttttttctctcctctccttctgggactccaaatatgcatatgttggtacgcttgatgaggttttacaggtctctgagattatgctagttgttcttcattctttttctttctgttcttcagagtaaataatctcaattgatgtttaagtaaatcaattctttcttctgccttcttaaatctgctgttgggcccctgtaatgaatatttcattttagctattatactttccaactccagaatttccattaggtttttgttaagcaaattttatctctttattgatattccctatttagtgaggtgagacatcattctcacagtttttgacacagtttgcttagttattgaatgtatttgaactagctttctctcctaaggcatagctttgtctactaagacaaatgtctgggtttcctcagggagagtttctattatttttttctcttagttatactttctttgttatgtgtcatgatttttgttgaaaacagtacattttaaataatataatgtggcaaatatagaaatcggattattctccctcttcaaggttttttgttcttgtaatttttctaaaataatcttgtaaagtctgtattgtcatgtgtggtcattgaagactgctcgattaacttagtagtcagctaataattagacagagatttccttaaatgtctagaaccatcatgtctcccattctttgccaagagtctctgcatatattggggcataatttcaatcctcagcactgtaggtaataactctgatcttgttttcacttcctgcttcagcagagcaccaaggtgatagcttagggccttttcaggtcttttcttagcatgtccacatcactggtcacatgcactctcctacacatatgcatggcccactaaaatcccaggaatatgtcagaactttaaaagctctctatggacattgcattcctcagcttttctctttacattttttggctagcctctcacttgccccaaatgtcattcattgtctcaggcaactgtgaagttaaacagctggctgggtgagctctgagtcaggtcaaataaagatagccttgtgagtggggtcttccaggaaactcccaggtaggtcacataattctctggaaatgtactccagacctgttttgctccctccaatgactgtcaggttgttggctttcctcacgatttcaggctattggtttttaaggctattgtgaacttggagagaggtgagaacagagcaagttaaaataccacaaagcttactgttcttactgcaattcagctatttttaaggagtaaattcttcctagaatgctgtaacttttggttaatacccagagttttgataaagttgcttctaacttatttttgcctattttctcattgcttttagaaatttcagaggtctttgttctgccatttttgaggaccttacccaatttgctggcactctgttgaggacatcttcatctatgtttcagagggatattgatctatagttgttgttgttgttgttgttgttttaacttttattttagtttcaggaatacatgtgcaggtttgttatagaggcagattgcatgtcatggtgatttgttgtgacaaattaggaccgattattttgtcacccaggtaaaaagcagcatagtatccaacaggtagttttccttgaatggtagctcaactcttagttcaaacagcttaattttaagctctccaccctcaagtaggccctggtgtctgttgttcccttctctgtccacatatactcaatgtttagctcccgtgtataagtgagaacatgtggtatttggttttctgttcctccgttagttcatttagaataatggcttccagctccatccatgttgctgcaaaggacatgatcttactcttttttatggttacatagtattccattgtgtatatgtaccacattttcttaatccagtctactatcaataggcatttaggttgattccacgtctttgctactgtgaatagtgctgtgataaacatacagatacatatgtctttatgggagaatgactcacattcctttgggtatacacccaataatggaattgttgggttgaacagtacttctgctttaacttctttcagaaatcaacaaactgctttccacagtggctgaactaatttacattcccaccagcagtacatatgtggtcctttttctctgtaaccttgcgagcatctgttctttttttttttttttttttgactttttaacgatagccattctgactagtgcgagatgttatctcattgtgtatgtatgtgtttttttgtttttgtttgtttgtttgttttgagacagagtctcactctattgcccaggctgaagtgcagtggcacaatcccaactcactgcaaactccacctcccgggttcaaacgattctcctgcttagcctcccaagtagctggaattacaggtgtgcgccacaacacccacctaatttttgtatttttagtagagatggggttttgccatgttgggcagagtggtcttcaactcctgacctcaagtgacctgcccgccttgacctcccagtgctgagattataggcgtgagccaccacgcccagccacattgtggttttgatttgcatttctctaatgatagtgtgttgaacattttttcatatgcttcttggccacatgcatgtctccttttgagaaatgtctgttcatgtcctttggccactttttaatggggttgttttttgcttgtcaatttaagttccttatggattctggatattagacgtttgtaagatgcatagtttgcaaacattttctcgcattctgtggtttgtctttactctgctgatagtttcttttgctgtgcagaagctcttaagtttaattaagtcccattcgtcgattttgtttttgttgcaattgcttttggtgtcttcatgatgaaatctttgctagagcctatgtccagaatgatatttcctaggttttcttcaagggtttttagtttaaggttttacatttaagtctttaattcaccctgaggtggttgttgtatatagtgtaaggaagggggtccagtttcaatcttctgcttacggctagccagttaggtcccacttgtcaatttttgttttgttgcaattgcttttgaggacttagtcacaaattctttgccaaatctgatgtttagaacagtatttcctaggttttcttctaggatttttatagtttgaggtcttacacttaaatctttaatccatcttgagttaattttaatccatcttgagttgatttttgtatatggtaaaaggtagggggtgcagtttcattcttttgcatacagcaagccagttactccagcaccatttattgaacaaggagtcctttccccattgtttatttttgctaattttgtcaaagatcagatggttgtaggtgtgcagttttatttttaggctcttatagttttcttttttcccccttttccttttgtttttgtagtcttcatctggtttggttgctggttaattctggtctcataaaataaattgggaaggattgcatcttctgttttttagaagagattatgtaaaatttgtgttatttcttctttaaatgtttggtaatatttgctagtgaacacagctgggtgaattttttagaaggcttttaactattaattctatttctttgctagatagctatgcgtgttatctgtttcatcttggcctcataaaataaattgagaaggattacatcttctattttttagaagagatcttgtaaaatttatgttatttcttctttaaatgtttggtaatatttgttaatgaacacatctgggtggagaattttttagaaggcttttaactatgaattctatttatttgctagatagctattcatgttatctatttcatcttgggtgaattttggtattttgtgggttttgtggaattaatctacttcatctaagttatcaaatgtatatgtatagagtttttcgtagtattctcatattattcttttaatgcctgtggagtctgtagttatactattaatacctcttttattcctgatattagtaactgtggcttctcttttttttctttgttaattttgctagaggtttatcaattttattgatcttttcaaagagtctatttttttctgtttttcaacttttattttattttagattccaggagtacatgtgcaggtttgttacaaaggtatattgcatgatgttgagtttggagtacaattgaacctgttacccagaaagcaagcatagaacacaataggtagtttttcaacccttgcttccctccttctctgcctccacttacattcattccctagtgtctatgttcccatctttaagtccatgtgtacccattgtttatctcccatttataagtgggaacatatggtatttggttttctgtttctgtgttagtttgcttaggataatggcctccagttgcatccatgttgcggcaaggacatgatttcattcttttttaatggctgtgcagtattccacggtgtatatgtaccacattttctttatctagtccaccgttgataggtatttgagttgcttctatgcctttgcttttgtgaattgtgctgtgatgaacacacagctgcatgtgtctttttggcagaatgatttattttcctttgggcatataaccagtaatgggattgctgagttgaatggtagctcaactcttagttcaagcagcttaattttcatttcactgatttcattatttttgttacaattcatcaatttatacttgtttttattactcctttttttcctgtttgcctcacatttatttagctcttctttttctagcttcataaggtagaaactaagatcaatgatttgaggatgttttttcctaaaataagcatttaatgacataaatatccatctgagcactgctttagctgcagtccttacattttgatatgctgtattttcatttttgatcagttcaaaatattttctaattttacttgaaacttgctgttttgcctgtggattatttagaaatatgctgcttaatttccaagtatttggacatttttctgttattgatttctagtttaaactagattactagtttaattccattacagtcagagaacatactggacttgagttggctaataatgttgctcaagtcatctatatctttattagtttgtctactagttctgttattgagaggaattttgaagtttccaagtataattgtgtatttttctatttttctcttcagatctgtcagtttttgcttcatgtattttgaaaccctgttttggggtgcatacacatttatgattcttatgtcttcttggtgaattcacccttttatcattatgtaatgttctcttttatccctaattttgtttgcttggaattctactttatctggtattatacagttacttgagctagatcattggtattttgaattctggtctcctttcttaatctacctgctagtgttgacttttcagagttctcaaacagctactccacatattctgtctaggttttttagactactaaatatgcttacttcatcttttctaggactgaaacgcccaaactattttttaaagttaattttagctttgtaaattttaacttttatcaaagaaacacgaacacatagttttatgttttcaatgaaaaacataactgtcctttccctacccacctcctgtttacaattcccattcctcagaaacaattactttcaatattttaggtagatcttctggttatttatctccatatttctaaggaacattgatcctactactacttcttggtttttgaactttagaacttacgtactgattctctcctgtggaagatgtttatttctcttataccactgatacttcaccatcccttcctgggaatattaacaactgagtcacatagtgcactataattagatttcctttattgtacaagactttttgccttccctggagttaataactgcctcttctttttgtggattaatttttaatgttttctgtcattaattaatccccaaaccatgccatagctgtaaaaattcttccaagtatggtcaaaccttctatcctctgaactcaatttagactacttgctgcactgttatcattccagagttttccttcctggttgttttaggaattatctttgcctctattctggattggaaccctagttccctgcatccttgatattcctttttaaattttttttttttattttgatggagcacatcttccagtaacatcctgagaaagtgtccatttgaagcaaatgttttaggtccttgtatgttgaaggctttattttgtcttatagtttattgatagtttggctcatgtagaacttaagttacaaatcaaaaatttccctaaaatatttgaagacaatttcttctatttttttggtttcagtgttgcttttcagaagtctgttatgattctgattctctatcttttgtaagatagagacctgtctttttgtctttggaagattttaagactttttctttatccccggtacttggaaagggcacagtgaagtgctttgtagcttttcctcctttacctgtgcctgagtgagccccttcaaccaagaaatcgtgttactcaattctgagaaattttcttgagttatttctttgagatgtttctttcctttattttttctgttctcatgatctgagccttctatgtatcagaagttggttattgcatactgatcctctaattttctagttcttctttcctgctttctctttttgatctggaaaatttccattttatcttccaagccctattatgcatttaaaaattgttggtatcatgttaatttctaagcactttttcttattcttttgttcttgtttcatggaggcaatatggtacatctctatggatattaagatttttttttgaagatttctcctatctgggggttggcaaactatagcctatagtgcctacaaaaatagcccatgtcttgtttttgtacagcctccaatgtgtaggaatggtcttcacatttttttttttttttgagaaggagtctcattctgtcgcccaggctgaagtgcagtggtgcaatctcggctcactgcaacctccgcctcccaggttcaagtgattctcctgcctcagcctcctgagtagctgggattacaggcgtgcgccaccatacctggctaatttttgtatttttagtagagatggggtttcaccatgttggccaggctggtctcaaactgctgacctcaagtgatcatttttaagaggattaaggaaaaaacaaaaaatatgtgacagagactgtatgtagcctgcaaagcctaaaatatacacaatagtcccccacagccacaatcttgcctatggtcaaagttactcacggtcaaatgtagtccaaaaatattaaatggaaaattccagaaataattcatacatttaaaaatgcatgcccttctgagttgcatgataaaaatctcatgctgtcccactcaggatgttaatcatccctttgtccaccatgtccatgctgtatactctttttgcccattagtcacttagtagccatcttggttatcagatagaaaaaacatagtatacgtagagtttggtactatccatggtttcaggcatttagtggaggttgtggaatctatcttctgtggataaggagagactactgtactgtctggccctttatagaaaacactggccaatccttgttctagtctgttgtgttgtttctattttctcagagttcttctgctgtgtttttgtttgctttgttggacttgttttgttgttgttgttttggtctgtttttcatgttacagactttctttgacaatctggtgaagactctgcacttacttaagagtaaggcactaaaacactgattggcagctctgaatgtatgggtagagcttataggctgggaagtttgctatagggtaatttggcaggaactgggccaatttgtagatattttctcatggggtggtcagtttccctaaaaaggaattctacacgcttggtagatgtaagactgattgtcagcctactcagagctgaaaagaaaaggggggtggagttctcacattcagtatgtaaaatccccgtatataatattaacctccatctttaatacgtcctcagctgtgcctggtgttgaagaatacagagtctctgttgttcaacctttccagaagtaaacctgggtgagggaggaggctaattgtttcttatactaatttgcaaccaagccacctgtttttaaaccttactttcattgacattttagattgctccaaatcctaggctttttcatgcataaatctgaaagtgcttgttgactatcatcaatgtagatttaaatttcagctttctcttgcctgctaagtcattcagtcattcggctgttttccagtgttcaaaatgtgttgatatcgcttgtctgtcactgtctcctctctctctttgtaatattgtaggtttgacattttcatttctttattatcataggattttgagggggtgaagagtaacataaatgttcaatttttctacaaagacaaaaaaaatctaaattttatagggcattattttttgatattattttaaagtaacctataggctccaaggcaacagaccataacactgggaaggataggaagaagattaatattgtcaatactacagaagagtattgaaagtcaatggaaagtcagtgtgccactgtattttggttccagtttgatttatgtttaaagcattctatggtatggtagaaaggtatttctgttaatgaaacaattcaaagaaaaaagatttcaccttttctttttaccattgttttcaaactgccttgcttaaatgaattatgccggcttgagacaaagattatactttcagtaaagcaacaaagactagttagaaaactcatagtgcagttgtaacctggttgcaaaaccatcttgtatgtttccaaaggctgttcttgtatttcatagacttatattacttcaaatactctaacagtcccatgtgtgcttaaaaaaattaacattaaaaggaatccattggtttctgcttactttagatcttctgtatcccttacaagaagagtgcctcagagtataagcaccttttctgtcaatcaatatacattatgagttttattaaataacataaaacatttgcttggtctttatttttttaatttaaaaaattttacttattgattggttttaaagggtaagttcctttgtaacaaattattaattattgacattattccctgaaaatcagtaaaatgatagctgggctctccatttaaaaaaattaataaaattctaaaagtacagtattatatatcaatactataaatacatgatttttatgatattccaggaaagcatgttttgaagctctaaaagctctctgggcaatgttgtatggcaggaaaaagcactgaacctcacatttttcactaattcaacaagcatttgagacttagttggttgctgagaatgtaacaacgtaacacatgttcaaggaagaaaacagataggctattacaatacaatgagatatgtgctataatacagatagcaaccaaaatgctataggtttactaaggtataaataactctagttggagaagttttaaaggtcctcataaaggacatgactttcaatgaggttttgattgctaaatttgccaaacgaattgtatgataacttataagccaaggcaaagcataatgaaagaatatagcatgtttgatagtttaatactgacatacttatgtttaatagtgaaaaattcggtggctagaggtagaggataaggatgaaaaagcaggtattacagttttagaaatggatgggaacaagatgtaaagggccatttagtagccatgtggccttagaaaaataatttaatttctcacaaccagtttaaaaacaattcaggctgaggcaggtggatcatctgaggtcaggagtttgagaccagcctgtccatcatggtgaaaccccgtctctactaaaaatataaaaattagctgggcatggtagtgcgtgcctgtaatctcagctactcaagaggttgaggcaggagaatcgcttgaacttgggtggaggaagatgcagtgagccaagactgcaccactgcactgggcgacagagcgagactccatctcaaaaaaaaaaaaaaaacaaacccaaaaaaacccaaacaaacaaacaaaaacaaagcaaatcaaataaaacatcaagtagcaacatgcattgctactggaagtgattggtagaagaatcaaatgagataatatatgtggagaaggtttgtaaacgagaaaaccacatacaaatatgacttctgtttcacatggtttcttgaaattcaaggcattgcttatactaaaaggaagaaaaaaatcaactgagctaagaatacttattttccgcaaattgagtataatgactaaaagtcaacaatttcaaaaatatattcaagcgcccctagaaactattagctgaatattaaaattcaaaaaaaaaatgtcaatcagcagggagacacaaagtaagcagatgtgatgcttcaataaccttcagtgcaacttgattccaagtaaaatgggatttctagggaaaaaaggggagcaggatctctgtagcttaaccatagacctgaatcactcagtttgaagaaaaacacatgcagaataccattctaaaatgatggggagtggctgggtgtggtggctcacgcctgtaatcttaacactttgggagcctgaagcaggaggatcacttgaggccaggagttcaagaccagcctggccaacatagcgaaacccgtctctactaaaaatacaaaaattagccaggcgtggtggcatgtgcctgtaatcccagctactcaggaggttgaggtaggagaatcgcttgaacctgggaggtagaggttgcagtgaactgagatcgcaccactgctctccagcctgggaaacagagcaagactctctcaaaaaaaaaataataataataataaaaacaaaaataaaaaataaaatgatggggagtacagtgggtgacatgttctagggcttaaatctagttgttgtagtcttatgtctaagctatacacaaatacacatagcttatgtatttgtatatatatacatatagctatgtctaagcgatacacaaatctgaacccacatgccatctggtttacaaatgggctaatgtaaatacacaagacaccagaaaaataaaaattttttatttgactggttaagattatgattagttgtgggacttctggttgaagtgcaaatatgtcaactgatcatgttttcatgattttactcttaaccaatttcttttttttagatggagtctccctctgttgcccaggctggagtgcagtggcgcaatcttagctcaacgcaacctccacctaccaggttcaagcaattctcctgcctcagcctccccagtagctgggactacagacacacaccaccatgcccagctaatttttgtatttttagtagagacggggtttcaccacgttgaccaggctgatctcaaactcctgacctcaggtgatccacccgcctccacctaccaaagggctgggattacaggcatgagccacctcacctggcccaacctgtttctatgaattatccaaatgccttacagcttcactaggaaataaataattacatggtgaagttaattaaaatttcatagagaatataaaatattaatttgtgggccgaatgtggtggctcacgcctgtaattccagcactttgggaggccaaggcaggcggatcacaaggtcaagaaatcgagaccatcctggccaacatggtgaaaccccatctctactaagaatacaaaaattagccaggcgtggtggtgcgagcctgtagtgccagctacttgggaggctgaggcaggagaattgcttgaacgcaggaggcagaggttgcagtgagctgagattgtgccactgcactccagcctggctacagagcgagacttcatctcaaaaaaaaaaaaaaaaatttaatttgcacaaaacctaattatagcatttacaaattagatgttgatgccctacaatatgaaattaagggatagtaatgcaccacataatgatgtttcagtcagtgtgaagtgcatatatgatagtggtcccataagattataatggagctgaaaaattcctatcacctagtgatgtcaccattgtaacattatagcacaatgcattacaagtgcttgtggcgatgctggtgtaaacaaacctactgtgctgctagtcttataaaagtatagcacatacaattatgtatggtatataatacttgataatgataataactgtgttactggtttgtgtatttactatactgtacttcttatcactacagtgtactcctttcacttacattaaaaaaaaagttaactataaaacagcttcaggcagatccctcaggaagaattccagaagaaggcattgttatcacaggagatgacagctccatgcatgttatttattggtcctgaagaccttccagtgattcaagacatggaggtagaagacagggatattaatgctcctgatcctgtgtaggcctaggatactacatgagtgtttatgtcttcatttttttttttttttgagatggagtctcgctctgtcgcccaggctggagtgcagtggggtgatctcggctcactgcagcctccacctcccgggttcaagtaattctcctgccccagcctcccaagtagctgggattataggcacctgccaccacatccagctaatttttgtagttttagtagagatggggtttcaccacgttggccaggttgctatcgaactcctgaccttaagtgatctgcccaccttggcctcccaaagtgctggattacaggcttcagctattgcgctccccatgtcttcatttttaacagaaaagtttaaaaagtaaaaaaataaaaaataaaaatttcaaaaatagaaaaagcttatagaataaggatataaaaattatttttgtacagctgtataatttgtgttttaagctaagtgttgtaaaagagtcaaaaaggtaaaaaaaaagataaaaagataaaaagtttataaagtaaaaaagttacagcaagctgggcacagtggcgtgtgcctggagttccagctacttgggaggctaaggtgagaggactgcttgaacccaggtgttcgagaccagcctgggcaacatagccatacctcatctctcaaaaagaaaaagtcagaataagctcagggtaatttattattgaaaaaataaaaataaataaatttagtatagcctaagtgtacagtgtttataaagcctacagttagtgtacagtaatgtcctaggccttcacattcactcactacttgatcgactcactcagagcaacttatagtcctgtaagctctattcgtggtaagtgccatatacatttgtaccatttttaatatactgtatttctataccatatctttactgtactttttctacacttatatactcaattacttatccttgtgttacaattgtctatagtacagtaacatgctgtataggtttgtgatctaggaacaataggctatatcatatagcctatatgtgtagtagactatactatctagatttgtgtaagtacattttataatgttcccacaacaatacaattgcctaacaactcacttctcagaatatatccgttattaagtgatgcatgactgtataaaataatgatttaaaaatgagtctcacaaagcacaaatcttaatgggcaagaatatttagaagtcggagtatcatgattaaatgtttagttggtgttaattctttaggatcacgattatagtttgttttaacccttcttcaatgatttgctaatttttttttttttttttttgagacatggtctggctctgttgcccaggctggaatgcagtggcatgattttggctcactgcaacccccacctcccaggctcaagcgatcctcctacctcagcctcccgagtagctcacatctgtaatcccagcactttgggaagctgacgtgagtggatcacttgaggccaggagttccagaccagcctggccaacatagtgaaaccccatctctactaaaaatacaaaaattagctgggcatggtggcgcacgcctgtaatcccagctactcaggaggctgaggcaggagaattgcttgaacctgggcggtggaggatgcagtgagccgatatcacgccactgcactccagcctgggcaacacagtgaggctgtctaaaacaataataataataataataattaattattttattttttctttaattattaaatatccttcagtttcaatgttatccttcaacattatcactatacataaaaggcacaagaaaatatagattgtaatcacattgttatctaaagcttacaaataacattaaaatgaaaatgatttttttttctgtcagatgtcttctttacatagaagcagaatgaaaaattgtgcaactacagaagctcactgggcagtaaaatagattttgtttctatttgatgatattttaacagatacacagattccgtactgaaagtacactttcaaatagaatatctcctcacactggctggtatatcaattttcttccctgacattttgggggaggtgaggagagaggtctgtttatctataaaattgttatctgagctttgatgttcacaagacaaaacttttttgatttgataagctttctttaatatttactgagcatctttgtgtgctattcattgttagatcaatcacaaaatttctttaaactttagcaaattgtgagttttgttttgggaataacttattcttcttactcttttcaaattctacttgtgacagctatcattgaatacataccagttcctatggttccagttaaataaaattttaccaagtttattataaagagtaaagtagcaagactagatttatatatatagccctgtcacagataatattatattaaatttcactccacttacctaccaagggcctggtttaaggccctgtatgcttgaatttcataccactgacggccaggtagaagacctctcaattttgaatggtggtcattgtattgtcgttttagttcaacctaataattttaaaatatatttaaaaaattagtagataattaaagctcattttaaacatcatattaacttctaacagtttgaatatacatatttttagggtagagattttattttgtttttcagtactgatttttttcgtttcatttaaaatagttttatttagcttcacattccttaaattacctaatgcatataactaatcagctgtgtgatctcaagcagttttattgaacttacattcattaaatccacacaattttcagtgtacaagtaggtgagttttgacatatatagtaatgtaaccaccatcataatatagaacattttcatcacccccaaaagttccctcttatccctttatagtaaatttctttcttccactgctggccctggcaaccactgatctgctttctgttttgccctttatagaatttcatataaatattatcatatactatgtaatgacttgtgacatttttcatttaatatacttttagaattcattcatgttgaaaggtttatgagtagttcattcttttacgtttatccagtctggtaatctctgctttttaattgcaatgtttagaccatttacatttaatgtagttattgttatgattgggtttaagactaccaccttgcttcccccctacccccccaatctgtaccattttgtttttatcttttggatcaatcaagttcccccctccccccatattatttccactactggaaataatatgcttccatattatttccactactggattattagctatgtctttgtgtgtgtgtgactcctctagggtttatgatatacatccttattagtctaccttaaaataatattttaccacttcacatatgatgtaaaaacaataccacaatatacttccatttccttttattgtcctttatgctattgctgccatacattttagttttatacatgctataaacccataaaacattttgattatgctttaaacagtacattatcttttaattttaaataagtttataattttgaaataagtttagatttacagaaaagttccaaagatagtacagagattccttataccctttacccaatttcccctaatgttaacatcttatattactatagctcatgtcaaattaagaaattaacattagtacattagtattaaataatctatgtattttattcagatttctgttttgtcccaaaagattatcttttaaaatataccgtatttacccacagatttaccatttctggcactcttcattttctcacgtagatttaaatttccatctggtatcattttccttctacctgaagaactttctttaatattagtagtgcacgtttgctagcaatgagttctttcaacttttctttttctgaaaagacttcactatcttcatttttaagagattgtcccacttgatcaagaattctaaattgacaggttttttcttttgttaaagacggcttttcattgttttctgatttgcatagttctgaagaaaaaatatgctattgtcctatctctgtaatgttcccctttcttttagcgactttggattggattacagtgtgctgttgtgtgtattttgcttgcgtttttattaagcttcttggacctgtgggcttatagtttctatcaaacttgaaaaattttcagccattatttctctaaatatatatattattctgcctcgaaactcttcttcttagactccaattacaactatattagactactttatattactccacatgtcactgaccctcttttttttcactctacacttcattttggataatttttatttataagatttcaagttcaccaaattttccttctgcagtgtctaatccatccagtgtattttttgtttcatatagagagatttcacataggtatttaaaaaatagcttctgtttctcttttcagtatgcttatgttttctgctatcttctttgaacttacagagcataaaacataagatattttaaaaatccttgtctgctagccagttctaacatctctgtcatttctggttttgtttctattgattgattttcctctgtattatgggttaaattctcttctttgcatgcctgctaatttttgattggatactagacattgtgggcattaagtcagtggttactggattttgctgtgaatgcaattagggtacttggaaccagttcattctttggcagctttgttagggaaagtcaagagcagcctttagtctagggctaatttatcccccatacaaaggtgaaactctactgatgattgtttcaagtaccccatgtgttatgaagtttttctcttctggctgctgggaactcaaactattcccagactttgtaagcactaggaagttttctgcctactcatttccctggccttatgtagcttcctctcatgtatatgccaatcagtacttgaccaaaaacttaaggggacgcctatgcagatacctggagctttctctctatgtagctccatcctctctagtactctaccttgcaaattctagctgccacggactttccctaaactttatctctttaactcagtgtgaccactgagctctgtttgagtttattctccctgaactgtggcctagtaattgtctccaggtaataatctggtgcaattgtagtattccaggacaagtatatcaaatggtacagttgtcccttggtatccatgggtgactggtttcagaacttccctcagataccaaaatccatggatgctcaagtacttgatacaaaatgacttagtatttgcataacctatgcatatcctcctttatactttaaataatctctggattactttaatagctaatatgatgtaaagctatgcaaatagttgttacattgtagtgtttagggaataatgacaagaaaaaaatctgtacatgttcagtacagaagcaattttttttcaaatatttttgattcacacttaggtgaatccacagatgcagaacccataaatacagagggccagttgtgtatttttgtagtagaagcctaaataaagatatgtggagttactttcttgaaggaaatcattatattgaagagacattgccccccccccatgtttattgcagcactattctcaataaccaagatatggaatcaacctaggtatccaacaacagataagtggataaagaaaatgtggtatatatacacaatggaatactaaacagtcataaaaatgaatgaaatcctgttattcacggcaacatggatggaactgaggacactaccttaagtgaaataaataaaaaacataaagttaaacaccacatgttcttgctcatatgtggaagcttaaaaatgttaatctcggccaggcacggtggctcaggcctgtaatcccagcactttgggaagctgaggcgggtggatcacaaggtcaggagatcaagaccatcctggctaacacggtgaaatcccgtctttactaaaaatacaaaaaaattagccaggtgtggtggcaggcgcctgtagtcccagctactcgggaggctgaggcagaagaatggcatgaacccaggaggcggaggttgcagtgagccaagatcgcaccactgcactccagcctgggtgacagagtgagactctgtctcggaaaaaaaaaaaaaggttaatctcataaaaataaaaagtagaacagaggatactagcagatgggaaggggagaaggaagggagggatggggagatatttgttttttgtcttgtttttttgagagacagggcctcagtctgtcccccagactggacggcagtggtgcgatcatggcttacttcagccttgacctcctgggctcaagtgattctcccacctcagcctcccaagtaggttggactacaggtgtgtgctgccatgcctggccaatttttttcttttttaatttttatagagatggattcttgctatgttgcctatgatggtctccaactcataagctcaagaaaacctcccaccttgacctcccaaagtgctaggaatacaggcatgagccactgcgtctggctgagatttgttaaaggatataaagttacagctagatagaaggaataagttctaatcttttataccacagtaggatgactatagttaacaatattacatcatttcaaataactagaaggaggagattacatgttccatacacaaagaaatgataaatgtttgagatgacagatacgctaattaccctgatctaatcaataaacatcatatgtatcaaaacatcactatgtaccctatgaatatgtacaataattatctgtcaactaaaaaataaaataaagagtaaacttcttggaaacattttaggctttcaagatatattaacaaaacttatacagcagttccctcttatctgcagtggtttaagttaactgcggtcaactgtggtccaaaaatattaaataaaaaattccagaaataatttatgttttaaattgcccactgttctgagtagcatgatgacatctcatgctatatcctgctccatcccactcagatgtgaatcatccctttgtccagtatatccatgctgtacatactacccaccagcagttagtagttacttagtagctgtctaggtctaatcgagtgtcatggtattgcagtgcttaggttcaagtgacctctattttacttaataatactttactaaattgtaaacctactcaagaaaaaacaaagtattttccgtgtactctataacactgttaactttttcttttttttttgagacagagtctcgctccattgcccaggctggagtgcagtgacatgatcttggctcactgcaacctccgcctcccaggttcaagcagttctcctctcagcctcccaagtagctgggactacaggcggccgccaccatgcctagctaatttttgtatttttagtagagttgggatttcacattgttggtcaggctggtctcaaacgcctgacctcaggtgatccacctgcattggcctcccaaaatgctgggattacaggcgtgagccactgtgcccagccactattaacctttttaaataaaagaacatgctttaggaaagaaaacagaacagtacacttctgaaaagcagctttcaaattgggaggtcaaaaaattttatcttactgtaaaaataaaatctaagctttttttttttttttttttttaacacggagtcttgctctgtcaccaggccggagtgcagtggcgcgatcttggctcactgcaacctctgcctcccaagttcaagagattctcctgcctcagcctcccgagtagctgagactacaggcgtgtgccaccacgcccagctaattttttgtatttttagtagagacaaggtttcaccatgttgaccaggatggtctcgatctcttgacctcgtgatccacccgcctcggcctcccaaagtgctgggattacgggcgtgagccactgtgcctggccaaaatctaaaaacccaaaaccccaccctttttattttacattccctcaaaagaatctgtcaaatttctaaaatgaaactttacaactagaatataaaggacatataaaggacatagactttgccttttttttttttttttttttttttggacagagtaccgctcagtcacccaggctgaagtgcagtggtgcgatctcagctcactgcaacctccacctcctgggttgaagtgattctcctgcttcagcctcccacgtagctgggattacaggtgcacgccaccatgcccagctaattttttgtgtatatatatattttttgtttgtttgtttgttttttagtaaaaacagggtttcaccatgttggctaggctggtctcgaactcctgatctcaggtgatctgcccacctcaacctcccaaagtgctgggattacaggtgtgagccaccacgcctagccaactttgctttttttttttttctttttttttgagacggagtcttgctcaatcacccaggctggagtacggtggcatgatctcggctcactgcaacttctgcctcttgggttcaagtgattctcctgcctcagcctcctgagtagctgggactacaggtgcatgccaccatgcccagctattcttttgtatttttagtagagaggggggtttcactgtgttagccaggtgatcttgatctccagacctggtgatccctctgcctcggcttcccaaagggctgagattacaggcatggagccactgcccccagcccaactttgctttttagggcaacataagtagtaaatgataacataacaccatagtaaatattagatgatatgttaataccctccctggaaattcagcaataaagcacatgataattaagactataagaaaaagtacttttaaaattctgtccagctgggaaaaatatatgtatttcctacctatctctcaaaaatgtaactaaagcagcttctcttctttaacaatattttcctcaaagaaagttgacatctactttgtcagacataatagcttatgtgttttcaaaatttcctacaccatggacagactgatacattatagtggtcactgttccgaagacaacagttgctctaggacgtattagttataaatggaatatttagagtgaatgtagcaactattagattaaataaaattatgactccttggtcttctatttttcattaacataattaaaattttctgtatggctacattgttttaatttattgcaaattttcaaacaccttttacactccaaatggcctttaaaatactgccaatattttacccaggggaatttattttagataaaaagtttaaaaacctacaaaagaacaaaaaactcccaaacaaaaaacaaaaccctgaaatgaactgtatataaaggttaactttgaaatagttcttattacataaacagatttttaaaattaatcaataataaaaattactttgtgagatcacagttaattggaaaaagcaaaactaagggttaagaaaaggtggaaagtgagtacacctcattttaatgacatcagaatctatttcattgtacacttagggattatcaagcatgaaaatcaatgaccaatttaaaatgacatacagcatatgtgaaaaagccagtttctcctgccagcaaatagcctaaatgttaagtaaaccaaaggctggaagggattagttgaaatgtcaaaagacaaccttttacttttacctgctcatccttataaacacattcttatctctcaggcatgctttccaaacaaatagtttcaatgtgcaccaccagcaaaaggcccaaggcaagctctgccatcttgtaactgtcaaagagattagtctttgatctatttgggaggtcatgcccacattcacattaccttataatctaacaacattatacctgttgaccaatgcttccttaatgcctaatgagacagacattttacattatggaagttaactgtgaatgttttttctaagttttgacagaaagtaagcaccataaactgagctcaagtgtggtttgggaagatgatcttttagatcagttaacattacttttcaaatacattttacaagcctttcccaaaatagaaagctatacttaattgtactttttggaaacagttaaactacttgcttcccatccccaataaattagtgtatgtgtaattttggaggggtgtgaagagcaggaaaaagacaaactattttattaacagttgcaaactgaaggcccatagttgtgttttgtgtggcccttactgtggcttaaaataattaaaatttatttgctaccatctaaaactttggctatctcaccactgtcctcaactaacccactcatttaaataacctgtttaattcatgtagctgcttgagtttgcaacccattggttcagatgctgcatagattcacaaaaatttatcatttcataattgaaggtcaagtttgtaccaaatgtaaagctcccttactatgatagtttttagacaaataaatatatatctgcatcaaaatctaacctaactgacataagtagaaataagatcctcaatatcaaaggcattgataattaagactgaggcggtttagaattgggtaaaaatacccaatagacagatggcattcaagcagaagttatatgattttggattctgatttttaccattatatcataatgtacttgagattgaacagaaagtttcttaagttctccatgccttggttttattggaaacagtataagtagcagagcacttatagcagcaatagacaatatgaaataatcaaaaggattatactgcatatgtcaacgagaaattaaggtcacaattattaacattagactttttcaactttcagtcaaactctttgcacaaaagtagcctttttaaagtttatcagtagcttctgaaaaaataaatggtgtgataaatatgagctagaactataaatgcatctcttcattttactgctgcttcacatgaaagatggtggattttatcccaactcataccaatacatattatgatttcagtaataaatgccttcctgaaagcaatcaatagaagaatataatttttttcttgtatgtaagcttgaagacaaaagttcaagcctccaaatgagactaaggacaaataatcagctaaactacataattataaaaatattaagaaaactctgcttcagaaaaataaacacatttgtctagcaaacacttgagtagaacagttttatctttagccaaggtgcagggcctaaagcctaaacatttacagcaaaccaaatctggaagacagagactgtgcattagagacatttgctgctccgtatcatcatagtgtaaacacttctatcagggtatcacaatataaattccaatggttagaattataaactcagcataagatcttgtatgtgatataatttagctagattaaaaagaatatagctggttttatttcatctggcatattttcaagatttctgacacagttaaccaaatagtgtgtgtgtgtgtgtgtgtgtgtatatacactttttttaaatggggaaaatgagttagtttctgccaagagttaagaagccaggctcccttttaaataagaataataatgataaaagcacattagaaatggtttttagttgttacttactttccctgttacgttacaacttgaccacaataatctatcaagacatagtaacagcaatatatttcacatatgctttaagactgttttggataaggtgctttttttggtagagaaatctatattaaacttagtatcgctaattgtcagtgttgactaaaataacctggatatttcaaatttaagaaatagaacaaaatatatccctctgaaatcaggtatctcctcttctcaacatattcagcctcaactggttataaaaatataaccagtttttcctattaaaaagttaatactctaagacatgcaagaaatcttagcatgcttattctgtaaagggctaagttaaagttttcatttttattttttagagacaaggtcttgctctgtcacccagaatggagtgcagtggcatggtcataggtcactgcaacctccaactcctgggttcaagcaatcattctgcttcagcctcctcagtagctaggacttacagatacgtgccccaacaccaggctaattaaaaaaaaaaattattttagagacgcagtctcactacattgcccaggctggtcttgaactcctggcctcaaacaatcctcctgtcttggcctcccaaagctgtgggattaaggtgttatccaccatgcctggcctaaaaaattctttttaagagtaatgacctttgtgtcaatttaggtaggttatccatgttaaaatattactcaaacaaacctgcaaatgtttaaattatcatctctagaacatgccaccattcgtgttatagtttattttgaggaagaaggtataatggaaaaaaagaaaaagcacacggcttggaatcaaggccttgagacttaggttgtttgaccttggacaagtcacagtagccctttataatttcctttctcaatttcttcgtctgtaagaaggggcttagaattagaagtctcttagctttattgaagttggagactgtgtgccaaccttaccttagagaattggttgaagaaataaatgacaatatgcatgaaacagtaaagcatcagatactagaggtaagtggacgagaaagtcattacttaccccatatttctgaaacccagtgtaggtttcagtggactttaaatgctgtcgtaatatattgctgcatggtatgtgaaataagccataaggctgtggaggccatatagtcattaccttagtcagttcaccccaaatcattttaccacctggaccgattccttctgaaagagctctgactacattattcaatgtttggcacataactttaggtgacttaaaaagtaagtttcttgggttcttggagtggctactttttcatcaagtgtcaatgaaaatatatacattggcagaatacatacagaacagtgttcaaacagttttgaaacaaatattttaaaaaataacttctacaattgatcttaaattttctaagaaattttagctaacattagcactctttaatatcctccataatactttttggtcacttttcaacttatgaagtgtttttgaaagcataactatataaaatatgctagtggtgtaatctatgagaatgagtgcatgattggtaccatattagtctaaatattattttattcaaatatcttacaatctagagtttttcttgttaaagtcacatatgagagcccgataactgtgaataaacttttgctagcaataacaactaacaaaataaaatattatcttatgtaagaaagcagtaaatagaatcagaggttcttaaaggaatgagtcaatattaagaggatttaataaggggactcagtaatggtgcattcagcaggtgacagagacctacttctaccttatataacactggaaaaaggcaagattgctcatggaagaggcttttggatgccagaagatgtaatatgacgcataatggcactcagggaattatataaaggttcctggcaatagtagcataaaaagtaaaagttaatcccagtgagaggaggctcagactcagctttcatatgattaaaccctaacatctaaaaacaaacctaagcaagagcgagcatgtacataagaaaaaagattaaatgagtactggaaaatgctgaaaatacacttaaaactttattaccaccacagtccaaaagatgaagtataacacttttgctatctagatttttattattacatccaaattatatttcagggccaggtgtggtggctcacgtttataatcccagcactttgggaggatgaggcaggaggatcacttgaggccaggagtttaggaccagccagggcaacatagcaagaccctgtctctacaaaataaaaattagctgggcatggtggtaggagtctgtagtcccagctacttaggaggctaaggcaggaggatcatttgagcccaggagtttgaggctgcagtgagccatgatctcaccactgcatttcattgtgggcaacagagactctgtctgtctgtctgtctgtctctctctctctctctctctatatatatatatataatctttcaaacatgagcaaaggtttgattttttttttttttgagacacagtcttgctgtgttgtccaggctagagtacagtggcatgatcttggccactgcaacctctgctccctcagttcaagcaattcttgtgcctcagcctccacagtagctgggattacaggtgtgtgctatgacgcccggctaatttttgtatttttagtagacacggggtttcgccatgttggtcaggctggtctcaaactcctgacctcaagtgatccacccgcctcagcctctgaaagtgctgggattacaggcgtgagccaccgcgcctggccacaaaggtttgatttttaaaatatatgatcactttctacctttgaaatattattgccaagaatatttgattcagagcttttcaaatgtgaatgtgagttttggaataagacatatggaatcatagcactttgataactcatgctttatcttagaaagtaatgcagacttctgatttcaataagtcaaaaaaaaaaaaaaaaccccagacatttctttttccctcacctgtcagagaaactgcctttaaattaaaagacaaataggaaacagaaacacagtctccaacttcagtaaagctaagagacatctgattccaagccccaatatatgaacataaaaggtagatggacaaatgttaaatgactaagcagaaaagagaaagttcaaaccaacgtatccacagagctactgctgggacataagccagtttgacctgcaggagttcagaaagtctcaggaaatggaggtataaggaaactgttgggaggatgtgtaccgcaaagatgaaacagtaagcaagaaacaagaggaagatctgagacccaggaaactggcaatccatcacagaagacagacaaatcaaattcctaggatgatagcagttattggatgatagcaggatattggcagttatctgggcttgatgagcaatttagccctgaccgaagtagaagatcaggaggctccagaaatgatatctccaggagaaaaaaggaactggcctgttatctgacaggtctgatagaaaaactgtattgagaggcatggcacacaactattggaaggtgacacatttatttagataaagatcttttaaaaagagaaaaaggaagtggaagagaggagggttctatcaaccctaaagttcaaaacagaaaggaggacgggcggctgtaaccccagcactttgggaggctgaggcgggcggatcttctgaggtcgggagttcgagaccagcctgaccaacatagagacaccccatctctactaaaaatacaaattagctgggcgtggtggcgcatgcctgtaatcccagctactcgggaggctgaggcaggaggatcgcttgagcctgggaggtggaggttgtggtgagccaagatcacgccattgcactccagcctgggaaacaaaagcaaactccgtctcaaaaacaaaacaaaacaaaacaaacaaacaaacaaaaaagaaaggaaatcatttgattacagtgaacagtattttcatagtcatgataatgtacataataactatagatttaattaaaaattgtaatgtaactatcttgggaggctataagaaggaaaaagcagagtaagtgaggtaaaatcctgtctcaaataggaatttaatagttcatgtctaaaactgattaaataaagataaaatatggaggtaaataccagataaaatagctaaagaagtgaaagtcactgcctgtcagaagcaggggctagaagtggggtgcaggccaaaagactgttataagaaaaagctatctactgtatttagtgtatattagactcttggtaagtgctttattggacgtttttcaacttgataaatcataatttaaaaacaaatgcagattattaattttaatttattgtatacatttgtatgcctcactatgtaaaacagtggtgctcaaccgagagcaattttgccaaccagaagataatggcaatgtctagagatattttgggttatcacaactggtggcagggtgaccgtggggggtgtctagatcccactaccggcatctagtgggtaaatgctagagatgctgttaaacatcctggaatgcacaggacactcctcggaacaaagaattacccagtccaaaatgtcaatagtgccaagtttgagaaacacagcttgaaagtaatttcaagtcacaaatctggtatacttgatgcagtaggaaaatacactgagttatttgtatagcttactatagtcactgacgcactggggtgatgtgtcctacagttacaaagtataaactgaactcattcccaagctttcaagcctttaatcctagggaaaaacaggaaagagtgatgttgtaaacatggaacagcaatatctactacagtttatgttatttgagaccttaaagctttacagttagaaaaaaaagtgacatagtcacctgaagcccctctacatgtctacaatctgtaggcattgagagaatttgactgaataaactgattaaaattcacaactaaaattctcctcaaaagaaaaaaattagttattttcagagaagctaaaaaacaatcccaccactgcccttaaggtagagctgctgattatgctccatgccaacataagtaggtaagtgtcaatcaaccttacaagtcctcagggtgataatttcacttttaaatcctccaacctagtttgagagcaaaattaatatataaaggtcaaagttccttttctcaccaaaaataagatgaacacaagaaaataacttcagaattgttcaaaaatcaaaaccaaaagtttttatttattaattatccagagaaacttccagcaatattttcaggcatggctttatgtatttatttatttattttttgctaaggaaatacaatgacatgagtattaggagaaaaaggttatcaaccgaacttgcttaaaattttgggattttaaatatttccatccttgatcccaaaatatcttttaaaaatatggagaatttaaaaattaacctcagcaattcatccatttgttttgtgtttttttgtttgttcatttgtttttcagaagggatggaaacagaggggtttcattaactcattttttgctggccaaggtaaatatacaatttattaacctagacagcttacttagatttaaactaggttttaattttggaatttcaagatatacttagaaactgctttcaaaatacttttggccaaactatcttaaaaaaaaaaaaaagctggggaaaaaaatactctgaggaggaaaaaaaaggtttaagtaattgaggatatactcactctagacttttagaggtgacaaggttttttcttctatatctgtgatggaacctaagtatttccaaaaattccaagagcaagttgctgaacttgtaaatgttaaagagttaagtattacagcactttaagtttatattcacatccatttcccctgggtaaccatgtattattatcagagctatatccaggtgggtctctgtatcagatgcaacactataaccagaagtccactccactctgacctcaggctgtattcctggatctggtttcccataacttagaatgtcccaaatcctgaaaatggcatacagagtcctaagtgatttggctcctaaatacctctcccagcttctattcacatgccattctctcagactcacaacttcagcttctttcagttcttggaaactgctatcctctttcaaccttagaaccttaacacatgctgttctctctgttgagaatactcttatccattctgtacacattcataactcctagttttctttccagtgtcaggttaaatatcacttcctcaggaagcctttcttgatccccaaagacctgctataacattcccagggttcctgtgactttttcttatagcctttatcacaactgtgattgtttcttcattacattaatgtcaatattccttgctagactataagcaacatgagacaaggggctataaactgtgttgtgtatcactctgtcccctgagtctattataatacttggtgctctagccagatattaaaaaaaaaaaaggttgctttattattctgaatagttgctttttttcttttctttctttctttctttcttttttttttttttttttttttgagacagagtctctgtcacccaggctggagtgcagtggagcaatctcggctcactgcaacctccccctcccaagttcaagcaactctagtgtctagtgtctcagcctcccaaatagctgggattgtgccatcacacccagctaatttgtgtatttttagtagagagagagagtttcattatgttggccaggttgttctccaactcctgacctcaagtgatccacccacctcggcctccaagtgatggaattacaggtgtgagccactgcacccggcctattctgaatagttttataatctgaatagttttgttgtaatctaacctctgatgaggccattccactttatgaaatgtttgtatatttgaatctcactgtagagaagattcaaatctcatctctctggctcctccatcccttttaggcaagttagtcaaagtaaattggtatctgcaagggaggcgaaaggtgttggtcaacttcagctttcctaagcatctgagcacctggtttctattccaccaaagcatcttgttatatgttcctgttcttccataaattattgacattactagtgtagagacagcatcttgttcatttttacacctactgcattttgtacaaattaagctcttaaaaaaagtttgttaaatgaatgaataagtgcatgacaaaacattcaatatcattaacatttttttttttttgagacagtgtcttgctctgtcgcccagactggagtgcagtggcgcaatttcagctcactgcaacctttgccccttaggtacaagtgattctcctgcctcagactcccaagtagctggaattacagacgtgtgccaccacaccggggctaattttttgtgtttttagtagagactgggtttcaccatgttggccaggctggtctcgaactcctgacctcaaatgatctgcccaccttgggctcccaaagtgctgggataacaggcataagccactgcacacggccgtcattaacatagttttgatagaagagtaattcaaaagggatttataaatctattcaaaaggaacagatgaatctacctaaaaggtttctgaagtcaagttcctcttgatatactacagtcctttgcattcctgccctcattcattttctcgtgaatattcatattgccgtcaaagcaaaaggaataacaatggaacaatatcattctccttaaaaagaaatctgttagatttaagaattctaatacagccaggtgcaattggcgcgagtctgtaatcccagctgctcgggagctgaggcaggaggatcatcacttgagcccaggaccagcctgggcaatatagtgagactctgtctcaaaaaaaatttttttttaattccaatactaccatcatctgataatattttgacagttgaaagcactggtttaacatggtttaatgtgctttattactttattaatgctgttatcctttagggaaagcaccctttttctgtggtttataaaatgccaacaatgcatggaagcctatcaatttttttgtgtgtgtttgttataaagtcgataagtaactaatataactaaaatagatgtctgaatttttcaatcataaatgtaattttaaaaaattgattaaaataatatatacccaaatagtttggtacattgagagctaagataagtttcctaaacaaaaaaaggaactcataatggttattgtatgctaatagtaagatagacaattcagatcactatgcgaattttaaatagtttccaaataaaatctagtttggtaactcaacatactatattaccaaaaaaacccacaaatataaaatttattagcatgataaattattttaatcattgtaagggcacttctgacaatgaaaagtaccatcaaattttattaaaccaattataaaaatctaaacacaccacttcaacattttaaaaatataaacatttttagccatatgccatggttttatacatttttcttcagagaagtaaaggaacaatacctacgaaggagaacttttctatatactattatactatactatgctaggcaatacaaataaaatgcaattttaaaacctaaatatatttgtaccttatcatatctcacaaactatgtccatgtcaccaattggagaggtggatgcctcaattataaagctgaatactcctgtggttgttagatcacagtaattggccagaggatttgctttagatatccattaaaaaggcagccttgttatactgtgatttaattacatgaaaaagaaaacaacttttattttagttatacttttccatcgacatctagtcatataaaagccttggttcattctcatgcccctcaaatgctttggtttagtgcacagaaagttttctttttaactattatacgattaagtatatccttatgaatgatcagaagcatctgggaaaggtggaagtgaaaaaaatcctcactgggaaagttagcttaatgcttaccttcagagtagcccattatcaacatttcatagtgggtttctttattttcaggtccctcaggtatgtgcaataaattatgacttgaactaaacaagtcacacttggctccaaaatgaaattttcctacctctactttctagtccctaaggtgggaagaggaaatcctggtcacagccaaaggagtcatatttttggctctaacatacattttccttcttctcaaaaagccaaaccctgctattgagactgcaaagtcttatgttagtattttaaactgtattttaacttttacttccataatctttctcaaatttaagaaaaaattttagtatcataaaattaatgtcactgccttctttttcccactcaaatcacttttctgactcaatgatcttaacctttttaaatatgaagtcaaatgaaatagacaaaataatgcagaaataggttgtttcgtttctataaggtagaacatttaaatttttatttactaaataacttctacttattagactattaatgtaaaagaaaactataaagttctaatttaaggtcctataatttgaagcatagttttagttttggaagagccatctatgtaggtcatttagatcatcatctcttttcatagggaataggagtatggcagacacaccctaaggtgatatacagagagtcacaactttgtaatgctctccccttaagtgagggcagaaccagtgatttgcttctagccaacagaatatggaaagggttctgggatagtcactcttaattaggttatattatatagcaaaaatgatgggaagttattcccatgattttttaattttatttttttcctcacaattttattaagttgtgtaagactctgtattggctgactggggctagagagcttcctattggcctctggaagtatactgtcatgatacgagggggcttgtgaaaaggccacatggcaagaaactgtgaatagcttcttgaagccaagagtacaccttagggctaggcacggtggctcacacttgtaatcccagcactttgggaggctgacgcgggtggattacttgagctcaggagttcgagaccagcctgggcaacatagcaagatcctgcctctacaaaaaaaaaaaaaccacgtttaaaaattagctgggtgtggtggcgtgtggctgtagtgccagctacccaggaggctgaggtgggaggatcacctgagcccgagaggccaaggctgcagtgacccatgaccgcaccactgcactctagcctgggcaatggagtgagaccctgttttcaaaaaaatttaaaaaagactgcctcttggatggattaggaagaacctcagtcctacaaccacaaacggaccccaagtgccagataacaacacaacctggccaacactctgattgcagcagttttgtggaaccctgacccagctaagccatgcccacacttgtgaccaatggaaactgagataataaatgtgtgttaagccactatgtgataatttgttacacagcaataaaaaactaatacaggctgggcatgatggctcacacctataatcccagcactttgggaggctgaggtctgagcatcccttaaggccaggagttcaaggccagcttgtacaacatagcaagacctcgcctctccaaaaaaaaaaaaaagtttagccaggtgtggtggcacatgcctacagtcctagctacccaggagactgaggcaggaggatcaattgagcccatgagctcaaggctgcagtgagctatgattgtgccactgcactccaacctgggcgacagaacaagaccttgtctataaaataaaataaaaatatttaaataaataaataataaaagagggatagctaatatagtcaatataagatactccctccacttattatgttctactatgtattaaataaagtgtaagatgctgttgaggattgagcattcccttctacatatcctctaatgatttactactataactaccctgtattgcctccttatgagtcatatcactgtttactaccatcctgttcattattatctaatgattactatcatttccatccttaaagtctccaggaatggagagtggttgctgttgtttttaaaaacaaataacaaagtcaaatacaattttaacaacttctactaaaaccccattcaatcattaactaaaacatttattaaacactgtgtttttaggtaatatcttagttgtagagacacaaagatgctgaagaaattatccctatcctcaaggtacaccatgaaacagattataaaacatctttataaacactaaatatgtgctttaggaaataataaaggacactggtaaaggtaactgcaggtgaatactacaatatgcttttgaattgcaattcctctgttttccctatattatttaaaaggcaaatgcataaaaacaataattaaaaactaacagccacacaaagtataaagatggaatctgtgacaataacaatataaaaagggaggaacagagattcagatgatagttataatccccaaggtaaatactaaaaaccaaaaaatacatataaaaggaaagaagggaatcaaaatagtatactacaaatcaactaaatacaaaaaaggaaatgatgaaggattgaggaacaaaaagcacatgacacaagaaaacaaatagctacatagcaaaagtaagtcctttcctatcagtaattactttaaatgtaaatggtttaaactctccaattgaaaggcagagattggccaaatggatttttaaaaacctgatccaactatacgctgtaaataaaagattcacttagatataaggaaattggacctcaccatatatcacatagaaaaatttactcaagaggaatcaaatatctaaattaaagagttacaactataaaactcttcaaggaaaacattaggggcaaatatgcatgatgttggatttgccagtattttcctaaatatgacaccaaagcacaggcaacaaacaaacaaaaaaaacagataaactggactgcattagaattttaaacttaacttttatattccatagaggcatacaaatattttcaaatacttgtttaaccatttataaaaatgttaagaaatcacccataatgatgctctgacatatttcaagtattttaggtattgactgctatattctgggcatttccaaataataaaaagccttcttaatcattataaaaactgcatgcgtatactcttaaagcttgtaacacaccagtcttataaatggataactaacaaataccttttaattatgaaaaaatgcgatagttgaggacttctttttgaagtcatgattctaagtcctttgccatgtgcggtagaaattatcccttttctccccttccttgactttgagattgtgcatggacgtgttttgggcaacaggaggttagcagatgtgatgtaaataggtatttgacttaactgcttacagttaagcctgccctcttgtactactgccattgcaataataacatgccttggctagtctgttggtccacaaagaatgaaatacaggtggaacagagctgactcagttgacttcaacacagatcagccaactagggcagagtagctgagcccagctaaaatcgagagagccaaccaaccaagcccaagcctagatcatctgtcacccaatcactccagagatgtatgacctgtaataaatgattgctgttttaagtcactaagttttggagttgttacagaagaagaactgatccagacatatggcaataagaaatacacttcccagtacatctagtagtgctggtaaataatttcactttttctatcccttgtccctgcagcttgaactattcttgtgtccactctacttgtaccttttgggaaccactagggataaccctttagaaccaccttcctcccctctacccagaacccattgatgcttctgttattttgctgttttatgcacataagcagaactatgacaaataggatcatgactgaggaatgtcagagtaggccatcaggtgtcttttttgcatgacagactgagatattgtctaggaagaatttatcctgaggaaaaaaagcattaagaaccccagattggtataataacaatgttcaaaatcatagctgttgaggcaaaggtggagaaaagagaaatggaattttctcacaaatgtatatttttaattttaagaatttttggaaaataatgaagaataacataataaatacctgcattctcatattttcttgcagcttattttcctttactaaaaattatggaaaaagttaaaattcttttgataactactctgaatatcattcccttctcttctcctcatatgtaatcagaattataatcttgatgatcctttcaggccttgttactttgtacgtataatatttagtacaacctagtattagccataaagtttttcttcttttccaggtctcaagaactcatatgtagggtccaaggaagagagaggacataggcaaaaatggaaataattagttttagggaacaaaattgtattttattaagatattggaagaagatgtggtctaaagaagggaaaaggattctttccactttaacaaagcagccttagtgcaataatgtagagctagagtaaaatgataagacattaaaaggagacaataccagtaccaacagcagtgccatcagtagcactctacttcagtggaatgcagcaccaatgctgttgatggtgacagtagatttcttgggtagatgtcaactgtttcatcagtagctgtagtcaaggcagcatcagccattttagaataggagacccagctttgggcatagccattagtgccctcagcagtagcactggttaactggagaaaggtagtagaaaccaccaaagttactggaggctgaaaaagtattagactctgaatcatcaagtgagataccccctgaggactttcagaaattttgaagaggtccagaggttacggaagagtaagggctaccaaaagaaatactgcttattactgttaatgttacctaaagactgctacggactagaaaaataaaagaaaaattatctaattcacagtacctagtaaagtattaacaattaaaaagataactattctaatgaaagaactcctgctttggtatgagaccctaactgactgtatcctagggggagggatataggtcataatcaataagtcagctcagtggtcagaaaatctcaaattttctcagattgccagcactttcaaatgcctgtaggaagtaaaagaaaatcctccttgatgaacaataagttcaacttaggctcaaattattactatagtttttcaaatatattgtttaggaaacagtcagtgataatgagatacaactgtttctggccaagattgagtaactggtttaagaatatttcttccattgtaagtaatcgcataaccgggcaaaatggagcaattgttttcaggtagtagacaccaaacagcacaagacagtaattctggagctaagtggaattcattaggtgaactccattatcccagttctctgcttgggtataatttcctgaccacagcacagagcattaaagtacaagcagagcgcagtggtcctgttgagctgaggtggaagagatcagaatatggagtgactaaatcacaagatctgcaaggcaggacactggaaagaagcgagccagatggacaaaagaccccaggattccccggaggaacccatgagtctgtggttaaaagactgataaaacacaaattgctgggcttcacttccacagtttctgatttggcaggtctggatgagcctgaaagtctttatttctattaagttcccaggtgatacgaatgcacctggcccaggaccagactttgaaaataactcctgttgaccaaagacagtataagttgaaaataaaataaaatctgtatctactaaatttttctcactcattcagattcaccaaagatttaaaaatgtctaaggatacaggaaaacatatacaggcatccctgagagacattgcaagtttggttccagaccaccccaataaggagaatatcataacaaagtaagtcacatgaattttttggtttcccaacacatataaaagctatgtttacactatactgcagtctattaagtgggcaacagcattatgtctcaaaagccaatgtatataccttaacttgaaaatattttattgctaaaaaaggtgaatgatcatctgagccttcagtgagtcactctctttgctggtagagggtcttgcctcaatgatgactgctgactgatcagggtggtggttgctaacgttggagtggctgtggcaatttcttaaaataagacgaccatgaagtttgctctatcatgtgactcttcctttcacaatagatttctctgtggcataagatgctctttgatagcattttacccaacataaaacttctttcaaaattggggtcaagcctctcaaactctgccgctgcttcatgcactaagtttatttaatattctaactcctttgttgtcatttcaacaatgttcacagcatctttactaagaatagttcctatctcaagaaaccactttctttgctcatccataaaatgcaactcctcatctgttcaagtgtcctcatgagattgcagcaatttagtcacgtcttaagctccacttctaatttagttctcttattatttccaccacagctacagttacttcctccactgaactcttaactccctcagagtcatccaatgagggatggaatcaatgacttccaaactcctgtaagtgttgatattctgacctcctcccatgaatcatgaatgttcttaatggcatctagaacggtgaatcctttccagaaggtttttaatcgactgtgtccagatgcatcagaggactcgctatctatagcagttatagcctcgtgaaatgtacttcttaagtaatgagacttggaagtagaaattactcctttattcattggctgcagaatggatgttttgttagcaagcatgaaaacaacattaatctccttgtacatctccatagagttcttgagtgaccacatgtgtggttaatgagcagtaatattttgaaaggaactgatttttctgaggagtagatctcaataatggacttaaaatattcagtaaaccatgctgtaaacagatgtgctgtcgtgcaggctttgttgttccatctatacagcacaggcagagtagatttagtataattcttaaaggctctaggatttttaaaatgttaaatgagcattggcttcaacttaaagtcaccagctgcactggcccatcacaagagagtcagcctgttctctgaagctttgaggtcaggcattgacttctcctctctagctatgaatgtcctaggtggcatcttctttcaatagaaggctgattcttctacactgaaaatctgttgttttgcgtagccaccttcatcaattatcttggccagatcttctggataacttgctgtagcttctccatcagcacctgctgcattaacttgcacttttaagttatggagatagcttctttccttaaacctcatgaaacaacctctgctagcttcaaacttttctgcagcctcctcacctctctcagctttcacagaattgaagagagttagggccttgctctgaattaagttttggcttaagagaatgttacggacagtttgatcttctttccagacactaaacctttctctatatcagtaataagactgtttgcttattatttgtacattcactggagtaacacttttaattcctttgaagaacttttcctttgcattcacaatatggctaattggttggtgcaagaggcctagcttttgtcttgtctcagctttcaatatgccttgctcactaagcttaatcatgtctcgcctttgatttaaagtaggaagcatgcaacacttcctttcacttgaacactctggggccattgtagggttattaactggcctaatttcagtattgttgtgtctcagggaatggagagtcccaaggagagagaaatgggggaagggtagtcagtggagcagttagaatacatacatcacttatgaattacgtttgctctcttatgtgggtacagtatgagatgccccaaaacaattacaatagtaacatcaaagatcacttatcacagattaccctaacagtataataataatgaaaaggtttgaaatatcgtgagaattaacccaaatgtgaaacagaaacaagtgaccacatgctgttggaaaaatggtgctgaaagacttgcacaatgcagggttaccataaaccttcaatttgtaaaaaagcactataaaagcaaagcgcaataaaatgagggatccctgcaattaactttatacaaaaccaatgactcctgtaataataaaacttaaggttttgatggcctacctgtagatctttcacatttggaaaaggaattcctattgttatgacagcacgggcattgtcatctgagaaatccagaccctcactcactttaccacgacaaactgctaccaggagagctccatcttaaacaacagaaaaaagcatatccaaaattctcagaaattgcttattcttgtcattttgaaaatacctgatttataattatagtaattacagtagcaaatttaaaataatcaaaataaaacactattatgagataaagttttaaaagttcaatgtctttaagtaaataaggggaacaaaattacatttatatgcaaaagggtagcaaaccaatttacaaactctgcatcttccagataacttatacagtaaaaacatgtcagaatagcaacttgcatatgaactgtgtgattataaacaggtttatttaataaaaattgaagttgcattattacctttaccacctgaaagtaaaattctcagaataattgaaataattgtaattgataatacatatcatatggaatcaatatatttaaaagtattgaaaacagacacagagaacaccataatatatacaccataaaaagatactgatatgttatattacctctttcttgcattgttcataaactactactatcccttcacatcaaacttttttattttattttattattttttgtgtgtgagacagggtctcactctgtcagccaggctggagtgcagtggcacaatcacagctcactgcagccttgacctcctgggctcaggtaatcctcccacctcggcctcctaagtagttggaactataggcacatgcaccacaccctgctaatgtttgtactttttgtagagacaggatttcaccatgttgcccaggctggtctcgaactcctgggctcaagtgatccacccgcctcagcctcccaaagcgctaggattacaggcaagagccaccacgcccggcctcacatcaaactcttcatggatatgctctaacttggaattgagttttcagttatgttttgaaaattcaagtttaccttatgtaatagaatacaagcaccaagtgtactaaatgcatcagaatataggtctcatttggctagtaaggaatatatttatatatatcctaactgcctttttgcacaaactatttcaggtagtgcactgaagactgtgagatgatggcatcgtttttcttaaagttgaatcagcatactcaagtgaaaatattcataggagaacaagtacaattaaaagaatttctttacccaatttattttcttttcactcaggattataatttttctcttaagtgtaattcatctaaaaatataaaattataattgtaccttcttactttgtaataaaaaatattttttcaccgaccatgaaataatttccagttacctttctctcctttgtatttgattgcgtcatagtacacctgcagtaattcatcaaaatttgttttttctcctccctgtggttctacaatgactgtcttcaccaactccagattatgccataaaccagtagagagccaacgttcttttaatttttctaataactaaagaggggaaagaaaaaaatgattttttgtgtgtctagctaaacaaacttaacttcatttgtttaagccaatgtgactacggcaagtatattaatctctctgtgtcttttctcatttataaaatgaggaaaacaatatatctcatagagctgttatggggttaaatttattaacagatttagagagatctgaatggtgctggcacagttagctgctgctgctgctactactactattatcttggcaatttctaccactactactgctactactactattactactactacttctactattatcttggcaatttctaccaccaccaccactactactactactactactatcttggcaatttcaaaagcaaaagcaaaaaacaaaaaacctctgtcaaagttaacaaactttaagttctctctttaaacctaaggtgaagtttcttaatattcttaaatagtcttcaaatgaagatgatttaagatcattttactaagtgtataggcagataagctcattatttgaatatttgatcatcattaataacctgcattgaaaaaagatagaaataaagactcagccaagaagtagaaaatatatgggcacaaatggaacatttacagccatgggctagattacaaaaggacattcaacaaattttaagcaatccttatcatattgatcacatatttcaacagttatgccatggtagattaaaagtcaataatataaagtcatggtagattaaaagtcaagcccaaaacaaaaactcatcttgattgattgattgattttagagacagggtctctgtcacccaggctggagtacagtggcaagatcatagctcagtgcagcctcgaactactaggctcaggcaatccctccaccttagcctcctgagtagctgggactacaggtgcatgccactacacccagctaatttttatattttgtgtagagatgagatcctgctttgttgcccaggctagtctcaaacttctggtctcaagggatcctccagactcagccttccacagtgctgaaattacaggtgtgaaccaacacacgtggctgtaaaactcatattcttaaaaaccatatgagttaaatagaaaaaacacagtataactcatgaaatctttagttatgaataagaaaagcactcacaattcgaaacatgtggcatacagcaatggcaatacatggaaatacatttatagctttaaatatatttatttttaaaatgtcaaaataaaagaatcaagtattctttccaagaagctagaaaatgaaatatagcaaatgcaaagaaagaagttaataataaagctgaataaatgaaaaagacaaaagctaatattagagattattatttaaattgaactgttttatccacttgttatatactatgagttctacacaatttggacaagttattataagaaaccacccaaaattctctggaaaacagcaactgatcaatttttataagatagtttatttcctcaattttacctttaactatttttagaaataaacttcttaataagactataaaacaaaacattagtaaaatagttaactgctgtacaatatgctttaattaaataggaagaactactttaattccataaacacagctaagaagttattatattactttttattctccagaaagacatcaagggaggaatagaggaacaaaaaagctgtagttagacagaaaacaattattgaaatgataataatgtctttccctatcggtcattactttaaatgtaaatggattaaattttctaatcaaaagatataaagtagctggatagataaaaacgctgtctgcaagtgactcactttaaatttaaggatacccataggctgaaagtgaagggatagaaaaagatattacttataaatggtaaccaaaagacagcagaggtggcaattctaagatactaaatagattctaagtcaaaaattgtcacaagagacaaaaaaaaaggacattatataatgataaatgggtcaattcactgggaatatttaacaactataaatatacacacaaccaacatcagagcacccaaatatagcaagcaaatagtgattgtactgaagagagaaataaacagcaatataagaggagtaggaaagtcatatatctaaccttcagtaatgaataaaacatccaaacagaagatcaacaaggaaacggaacttgaacaatactagagaccagatggacctgacatatatagaacattttacccaacagcagcaaaatacatattcttcacaactgtacatggaacattctctaggacagatcatgtgttaggtaacaaagcaagtcttaacaaatgtaagataaaaattaataccaggtatcttttgcaaccacaacagaatcaaactaaaattcagtatcagaaagaaaaccagcaaatttacaaaaatatgaaaattaacacacttttgaacaaccaatgaatgggtcaaaaaagaaatcaaaaggaaagttatgaaattatcttgagaccagtggaaaaaaaaccacaacataccacaagtaagaaatacaccaaaagcagtactaagaggaaagtttatagcggtaatgccaacattaaaaaagaaagatctcaagtaacccaattctacacttcagggaactagaaaaagaacaaagtaaatacaaagtttgcagaaggaaagaaatattaagattagagcagaaataaaatagggaacagaaaaacaatttaaaaagttggtttttgaaaagatcaacagaattgacaagtctttacctagattggttaaggaaaaaaaaaagagaaaatcagaaatgaaagaagacacactgatgccaccgatacaataaaagactactctgaaaaattatatgccaataaattggataaaatagatgaaatggacaaattcctagtaatatacaacctactaagactgaataatgaagaaacagaaaatctgaacagactagtaaggagactgaatcagtaacaaaaagtctcccatcaaagaaaagctaaggacctaaatggcctcaataccgattctacaaaacatttttatttatttaattttattaattttttattttcatttctttgctaattaattaatttatttttgagatacactcttgctctgtcacccaggctggagtgtagtaatgtgatcatagttcactgtaacctcaaactcctgggctcaagcaatcttcctacttcagcctcccaagtagctaggactagaggcatgagccaccatgccctggtaattttttttttttttttgtaggtatggagtctcactatattgcccaggttggtcttgaactcctggcctcaagtgctcctcctgccttggcctcccaaagtgctgggattacaggtgtgagccactatgcacagtcctctatgaaacatttaaagcaggggtccccaacccccaggccacagaatactggtagaatccaggctgcacagcaggaggtgagtggcaggtgagtgagcattactgcctgagctcagtctcctgtcagatcagcagcagcattatattctcataggggtacaaacactattgtgaactgtgcttgcaagggatctaggttatatgctccttatgagaatctaatgcctgatgatctgaggtggaacagtttcatcccgaaaccatcacccccacccccaacccaggtctgtggaaaagctgtcttccacaaaaccagtccctggtgctaagaaggttggggaccattgattttaaagactaatacaaatgtagattcaatgtaactcctatcaaaatcccaatgacattttttacagaaacagaaaaaaatacaaaaattaatatgcaaccacaaaggacttggaataatcaaaacaatcttgagaaagaacaacaaagctagaggcatcgtgcttcatgacacttacatcttacaaacccaccataatcaaaatagtaattgcattgccataaagacagacatatagaccattggaagagaatagagagcctggaaataaatccacacatgtatgatcaactgatcttcagcaagggtgccaaaaatacataatggggaaaggacagtctcttcaacaaatagttcagggcaaacaatatccacatgcaaaagaataaaactggacctttatcttacacaatacacaaaagttcactcaaaatggattagacttaaatgtaagatttcaaactgttggctgggcgcagtggctcatgcctgtaatcccagcactttgggaggccaaggcgggcagatcacgaggtcaggagattgagaccatcctggctaacacggtgaaaccccatctctactaaaaatacaaaaaattagccgggcatggtggcgcacgcctgtagtcccagctactcgggaggctgaggcaagagaatcgcttgaacctgggaggcggaggttgcagtgagccaagatcacgccactacactccagcctggcgacagagcgagactctgtctaaaaaaaaaaaagacttgaaactgcaaaactcttagaaaaaaacacaggagaaaatttttgtaacattggatttaacaatgattttatgcatatgacataaaagcacaggcaataaaagtaaaacctacgattgggaccacaacaaactaaaaggtttctgcaaagtaaagggaaaaaaaagagtggaaaggcaacctaaaggatgagaaaaaatatctgcaaaccatatatctgataaggggttaatatccaaaatatattaagaaacccaatattaaaaaaaaattgaaaaacaggcaaaggacatgaatagacagttctccaaagaagacatacaaatggttaacaggtatatggaaagatgctcaacatcagtaattatcagggaaatgcaaatcaaaaccacgatgagatattggttcacagctgttcggaaggccattatttaaaaaagtaaataaaataactattagtgaagatgttgtgatattggaatccttgtgtattgctggtgggaatataaaacagtatagccactgtggaaaacagaaaaggaaataaaaatcaaaataaaacagtatatatagaaatgttttatgggtttcaatatacaagtcttttacctccttaagtttattcctaagtgttctatttgttttgatactactgcaaatggaaatgttttcctaatttgcttttcagacagtttgttgtcagtgtatagaaatacaactcatttttgtatgttaattttgcatattgcaactttactcaatttattagtcctaacaggttttttaaaaataagatctttaggaaagatcacgtctgtaaataaggacaattttactttttcctttcccatttggaagacttttattcctttttcttgcctaactgctctggctaggaattctagtactacgttatacagaaatggcaagagtgggcatccttgccctgtttctgatcttagaggaaaacctttcagtttgcaccactgagtatgctacgagcttcttacatatgacctttattatattaaatttccttctattcctaccttgttgagaatttgtatcatgaaagtgtgctgcattttgtcaaatgcttttttgcattattgaaacaatgcatgaagattcttttcagcagatggtgttgagaaaactggatcaccacatgtaaaaagaatgaagtaacaccttgcctacataataaaaattaactcaacattggtcaaagacattactgtaagagctaaaaaatataaaactctaaaagaaaaaaatagaaggctttatgaccttggatttggcaatgatttgttggctgtggcatcaaaagcataagtaactaaagaaaaatacagataaactcggatttcataaaaaattataaaacttttttggatactgtcaagaaagttaaaatgatagtacacagaatgcaaagcatatggctgataaaagattaatatccagaagatataaagaactacaactcaacaacgaaaaaaccaaacagattcaaatataggcaaaggactttaatagacatttcttgaatgattaaaaaaaaaaaaaaggcccaaaggacatgaaaagatgctcaacatccttagtcattaggaaactgcaagtcaaaaccacaatgaagtcccacttcacttagtataactgctgtccaaataagtaagtgttgcaaggacacgcagaaactgtaactgtcacacattgctagtggcaatgtaaaatggtacaactgctgaggaaaacagtctggcagttcctcaaaagttcataggcatagaattaccatatgatccagcaattccactcctaagtatataaccccaaatatctgaaagtactaggatccaaacaaacagctgtatgctgatgtttatagaagcattattcccaataaccaaatagtggaaacaactcaagtgtcaatcaacagatgaataaacaaaatgtatgacctacgtgcaatggaaaattattcaactataaaggaatgaaattctgacaaatgcttgaatatggataaacccatagtaagtgaaaaaagccactgtatttttgtacacaaagtacaaatattatatgatttcacttatatgaggtacctagaatagacaaattcttagagatgggaagtagaacagaggttaccagggcctgagggaaggggctaaacaggagtcattgttccatcagtacagtttctgactgggatgattgaaaagttttggaaagggatactggtgatggttgtacaacatcatgaatgtacttgatggcactaagttgtacacttaaaaatgcttaaaaggtaaattttatgtcatgtgtattttaccacaattttaaaaattgaaaagaacacacaaatgaatactatttagtaacataaataaatgaactagtttctcacatattaaccaggatgaatcataaacttctagatgttgagtaaaaaatgcaaatacagatagataacaaatatgatttcatttatataaagttcaaaaacaatatgttctttgagaaaaatatatataactttaaaaaactcatgaaactaatacctttagctttagggggatacaattgggaaggaacaaatggaggatttttttttttgagacagagtctcgctctgtcacccaggctggagtacagtggtgcgatctcggctcactgaaatctccgcctcctgagttcaagcaattctcctgtcccagcctcctgagtagctgggactacaggcggacaccaccacacctgactaatttttgtatttttagtagagacggggtttcaccatattggtcaggctggtctcgaactcctgacctcaggtgatccacccctcagcctcccaaagtgccgggatcacaggcatgacccactgcgcctggccagatggaagcttctaatgtagaaataatgttctatttcttaagctgggtgatggatactcagatctccattttattattatttaaaatgtacatattagttttgtagacttatatacacacatatttcacaaatataaaatataaaaattaaacaacattagtctgattattaatatgatgagttagaggaggggttataacaggtacatttaggctactaatatagtaatccagagatggtggtagcttgaattagaaagagttaagaaaaaaaatgcaaaccttgagaataagataaaaaagaaacagtacaaactttccatttcaaatggaggcaaaggcccactagaagattatctagggaaatacactttgttgaactcactgttcactattaattaaggttccagacttagcaaaattatatttcaacttagatatttttgtctaatacaaatacaaatcatttctgttcaggagaaaagataaccctaaaagttactatttattgccctgtagtacatcaaccagttttcttatagtctattcctttattaaattgcctacaagtacgtgaatccttaaatgctctctgaataggccaatcatcatactttttcttcattaatcagtgagtttaataaaatctgtgataggtgttaactttatatgtgagctatgactttatctttttgaaaattaactgtagagaaagaaaagtgaacagattataaaaatacttaaaattaaaatgagtaagatatggtgttggatgggacatgacagggaagggagaaaaaggttcacaggtgctctgtaggtatatgattagcccaaatatgattacagtacctgctatgttttgaacatttgtcctctccaaaatgttgaaatttaatctctaatgtggcagcattgagaggtgggggattttaagaggtgacagggtaacaagagtgctgccctcatgaatggatttgtccagtcatgtattaatggcttatcatgggagtgggactagtggctttatacaaaaaggaatagagactcgagcttgtatactcagcctccttgccctgtgatactctgagccaccctgggactcagcagagagttcccaccagcaagaaggcccgcaccagatgcagcctctcagtcttgaacttctcagcctctgtaactgcaagaaataaattccttttaaaaaataaatcacccagtttcaggtagtctgttacaagcaacagaaaatgaactaagacagtaccattcattcatacaggcaacactggcaaaggaccaagactggaaggaaagattaaaagtttgttgcctttaagatatccaaatggaaatgttgatatggcagttgggtatatgggcatagtacttaaggaagaagtcagaatttaattatatattaggaaagcatgacaaaagataaaactaaaaaagaatgtatagagatgagattgcctagtgggagagtacagatttaaaaggggggaccagcaagaaaatcttatttcctctccatttttttttttttttagagatgggatctcactctgttgctcaggctgaagtgcagtggtgtgatcacagctcattgtagcctcacattcctgggctcaagcgatcctcccacctcaacctctcaagtagctgggactacaggtatgcactgccatgtctggcttgaaaagaacaacaacaacaacaacaacaaaaaaccagagagggtcttgctgtgttgccaaggctggtctcaaactcctggactcaagcactcctccaccttggcttcccaaagggattatatgcatgagccaccacacccagcccctcatctctactactgctcatccaattcatcagcaaatcctgccagcactacttttaaatttatctagactctaaacatttctcactatctttactgctaccacagtggtccaagccaccaccatctatcatctagattacagcagactccttaacagtcacccttgcttcagcctatgctctctacagtccattttccatacagcagccaacataatccttttaaaactaagtttaaaccctccaatggcttcctactgcatttagaacaaaatctaaattcttactgtggtgtgattttacccagctatttctttggccgtatctccttcaattccccatacttcagtcctactctgctacaatggcttccttttgctcaaactaggtactctcctgtctcaagattcccactatctgaacattcttccccctaaatcagaatggtttgcttcctctcttcctttacacttttactcactgtcaccttctcagataggccttcccaaaccatccaattaaattctaaatgagcaccctccagcccccacccaaaaaaattccaaccccaggatcctcttttccccctttccttgctttagttttctacatagcacttatcaccatctgtattagtcccctcaggctaccacacaaaaatatcagactgaatggcttaaacaaaagaaatttatttcttacagttattagtttaagccacagattgagtggcttaaacaagagaaatttatttcttacttcttggctatgaagtccaagataaaggtgcctgttaacttgatttctggttagggctctcttcttggcttgcagacagccaccttctgtgtcctcacatggcctttcctctctattcagagaggaacagggagagagagcaatgaagttttctggtgtctcttcttataagaacactaatcctatcagataaggaaggcccttacagcctcatttaaccgcaattacttccttagaggccccatctccaaatataaccacactgggggttagggcttcaacataaaaaatttggtggtatacaaacattcagtccataatatcatctaacatattagtagctttctgtgtctctcatttattttctgtctctcaccctggaatacaaaaggacaatgatttttgtctgttttacttactgctgattgcccagtgcatagaacagtaccttacatatagaaagtggtcagtaaatactttttgaatgaattttataaatgaatgaaaaatgaaggtccaaaacaatggaaggtcagggaggagagtagggaggggtaaaacataactgtaaaaccagatgcccaagtccttaataaaagaagagttggctgggtgcagtggcccacacctgtaatcccagcactttgagatgctgaggctggaggatcacttgagcccaggagttcaagaccagcctgggcaacttggcaaaaccctgtatctacaaaagtacaaaaattagctgggtgtggtggtgtgtgcctgtgatcccagttactcaggaggctgaggtgggaggactgcttgagccctggaggttgaggctgcactgagctgtgatcatgccaccgtactccagcctgggtgatagagtgagaccctatctgaaaaaacaaataaaaataaaatattaaaaataagagtatccagatgctttgtaagatgacaaagatgagggggaaagaagggtatgactaaaagacatgagcaaacagactagctagactagactagttttctcttggtgagactttgttcattcattccttcctcccttcctttcttctcccctcccttccggaagaaaacagacaggtaaagatttagaaagaacaatggagagtaaataggatactaagtctgagatactgcaagttacgagaggaaaggatggtcacaatttggaaggtctgacgaagtggtatgtcctctgggtctatccggattttagttcgggcaaagagctatgaggaacacttcataaaagggagaatttggtgactatgacacatttccacagaacacaatgtgttttattttaatttcttcagtggagattttttttaaagtaccttaaaaccttttgttaaggattacacaggggctacatgcaaatttggagtacaattctatagcaaaaacatactggttattttagtgaaaatggcctacagcaaattttcagtttcagataacaaaatatttaggtctacagcttttatattctcattgcaggtgacacttgaattacacatttagacagcttaactatttctgtcttgccagagaaatcacataaataaacacaaaaataactcaattgttaaattctcttaggtatcctaactaggcacctaaaaactaacttaaaggaaagtacgatgacacagagctgtctctcaggtcttatggcttacatatatgaaaaatgtgaggtatctttgttgaaaatatcctacttaatagctcataaagggtaaatactattcatatagggagaccagccaacatatagtgatagagatgatttaatttactaattggtgttcacatcacttcaatttgttaacctcagaggcaattttttttaaagtcagatctcacaaactaaaagacactttagaatgcccatgtcttatctggatattgtcattttactttgtcaaacttctttaaaactagtatttcgctagggagggaataagttagaatgcaacctagtggggaaatcctgcatttgctcaatgtccatagcttttacacagttccagatgttcagtacattaataatacactaactcaaagcctctttttgaaactttagaaagtgcaaattgcattaagacctctttgccctcattagtggtattgttacaatcccagtcctctggaaaatgttttttggcatgtgtttaactttataatattgccatttactcactttaatagccagtactcaagtcttaatgcttttaataggcctgcctaaacagactaccatcttttgtaatcttactcacataatttatttcataagtagaacctggtatatttttccatctaaagatgattcttcattattcatttcatgaggtactcatatgttttaaatgtttactttcttttattcagttgatatgtacccatatgtggcatatgttagaaataaaaaagagttccttttaaatactaataaaaatgaaaaagtagtagtgttttttaaataacttttttagttacagtaaaaatgaatgtccttaatttttgctaaatacaaactgaaaatataagaaaaccaagaatatgaatttctattgaaacagcttcctgtttggtgatatttgactcagcactttcacctcaagaggctgggttatatttcagaatcaaactttcaatgaacacaggtgcagttggaggtgcacttggaggaataatatagacaaatactgccctaaagtgaaagtaagacctctgttggcaatctaactggaaatgaagatcctacagccctctctgaaaaggaacactctctctcataaattagttaaaatactgaggactctgaaaatgtcagagctgcactactagtgcagtaatgcactagtgacacctgatttacagttacttcttgatacattctgataaaaatatacaatgatatttacaatgcaaaaaacttcaaaaaatgacatttgtaaaacaactaacatatttacacatgaaattctactttcctgaaatcatgtgaaaagaaaacaataaaagccagacgcggtggctcacacctgtaatcccagcactttgggaggccaaggcagacagatctcttgagctcaggatttcaagaccagcctgggcaacatggctaaaccccatctctacaaaaaaaataactgggcatggtggtatgttcctgtagtcccagttacccaggaggctgaagtgggaggatcacctgagccagggaggtaaagactacagtgagccagtgattgtaccaccacattctagcctgggcaacagaatgagacactgtcttgaaaaaaaaaaagagaaaaaagaaaagaaaacaataagaactcaatactatgttatgtatggaacaaattcttaactctttgaaacataaattctgaattactgttgtttcatcaacagttaattcatcaatgtctaaagtaatcatttagttaaaatgtatataatctgacttgttttgctttttaaaaatgaagaactgttgactgagttaataatgttggctaaaatctgaatgtataaacttattcacacaaattcaactatatgtttcattcttttcctgaatagattaactgtaggcgaaaaaggcaactcgttttctatacttctgtaaatgggctaataattaaactataatgaagtcagtgctcttgcactattagaattcaggctgagggaagcagatgaataagaagcaaccactataatgttacctaaaagttactactttcaagtattgccatctgaatctgctgtaaatttgttgctctaaaacttgaaagaaattttttggagaaagcatcgcttcacaatctagtgaataagatccaaaagaaaaatatttaaattacagtgcagtgcataacaaacatagaaaggcctcaaggcataccactacaggaaaccatcaaatcacaaaggaagacagcaagagaaataaagaaacaaagtacctacacaacaactagaaaataattcacaatgctgggtgggcgtggtcactcatgcctgtaattccagcactttaggaggctgaggcagaaggattgcttgaggccaaaggattgcttgaagccaggagtttaagaccagtgtgggcaaaacagcaagaccctatctctaaaaaaaaaaaagtttttaaaaaatgtatctgggtgtggtggcacatgcctgtagtaccagctactcaggaggctgaggttgatcccttcaacccaggagttcaaggttatagtgacctatgatcacacccctgcactctgacctgggtgacagagcaagaccctgtcataaataaataaataaataaataaataaataaataaatggcagtaataactctttacctttcaatacctaccttgaatgtaaatgaattacactctagcaaaaagacatagagtcttaattcccagagcaatttagaaagagtaagaaaagaagatccaactatatgctgcctacaagagatttgcttttaaggatgcacagaggctgaaagtgagcagctgaaaaaagctattcaacaaaatggaaaccaaaagagagtggggttatctatacttacataagacaaaatagactaagtcaaatactgtaaaaagaaacaacgaagaacattatttaacaaaaaaaggtcaattcatcaagaggatataacaattgtaaatacacatgcacctaacatcaaagtacctaaatatataaagcaagtattaaaggatctgaaaagagagatagattctaatacaataatagtaggagacattgataccccactttcaacaatgaacaaatcatccagacagaaaatatatttaaaaacattggacttgaataaatttagaccaaatggacctaacaggcatttacaggcataccttggagatattgtaggttcagtttcagaccaccacaataaagcaaatatcacaataaagtgagtcatacatttttgttacccatcatatataaacggttaatgtttatactatactgcagtctattatgtgtacaagtggcattatgtctaaaaaaatacataccttaattttaaaatactttattgctaaaaaaatgctgacacagagacatgaagtgagtacatagtattggaaaaatggtgacaatagacttgcttgacacagggttgccacaaacctttaatttatgaaaaaaaaaaaacccagaatatttgcaaagtgcgataaagcaaagcacaataaaataaggtattcctgtacagaatatcccattcaagagcaacagaatacacattcttctcaaataccataaaatagtctccaggatagattatatattaggccatgaaacaagttttaacaaatttaagtttgttatcatatcaagtatctttgctggccacaatggtataaaactagaaatgagtaacaggaaaatttgggaaaattcacaaatatatggaaattaaacaacatgttcctgaacaaccaaacaaccaagggggcaatgaagaaattaaaagggaaatttaaaaaaaatatattgagacaaacaaaaatggaaacacaacataccaaaacttaagggatgcagcaaacgtagtcctaagaggaaagtttacaataacaaatgcctacatcaaaaaagaagatcccaaataaataacattactcctcaaggatctagaaaaagaagaactaagcccaaaattaacagaaggaaagaagtaataaagatcagagaataaataaataaagtagagactaggaaaacaacacaaagatcaacaaaactatgaattggtttttgaaaagataaatgaaatcaacaaacctttagctagattaacaagaaaaaaagagaatattcaaataaaatgagaaacaaatgaggagatattataactgataccacagaaatacaaaggatcaaagtgactattacaattatatgccaacaaaataaactggatacctggaagaaatggataaattcctagacacatacaacctaccaagactgcatcataaagaaatagaaaatttaaacagaccaataatgagttctttccaatcaaagaaaagcccaagacctgttggctcactgctgaattctacctaacagttaaagaactaataccaatcattctcaaatgctttcaaagaagttgaaaaggaggatatacttctaaattctttttacatgaccagcattatcaccctgataccaaggccagataaggacaatacaagaaaagaaaactgtaggccaatatccttgataaatagaaaagcaaaaatcctcaacaaaatactagcaaaccaaattcaacaacacattaaaagaacaattcaacatgatcaaatgggatttatcactggatggaaagatagttcaacatatgtaaatcaataaatgtatacagcacattaatagaatgaaggacaaaaaccatatgatcatctcattagatgtagaaaaatcatttgacaaaattcaacatcctttcctgagaaaaacttttactaaattaggtatagaagaaatgtactgcatatttggccaataaaggccaaatatgataagaccacacttaacattatattcaatggtgaaaaaattgaaagccttacctctaagatctggaacaagacaaggatgcccactttcactatgtccacttaacacagtactgaagtccttgccagaaaaatttagaaagagaaagaaataaaaagcatccaaatagaaaagaaaaaagtgaaactgcccctgtttgctgaagacataatcttatatatagaaacccctaaagactacaacaaaaaactgttagaactaataaatgaataaatacagtaaacttgcaggatacaaaatcaacacacaaaaaatcagtagcatttctatatactaataacagactatccaaaaaagaaattaagagaactccttttacaatagctaccaaaaagagagagaaagaaagaaagaaatttaaccaaggtgaagaaaggcttgtacgctgaaatctataaaatgttgatgagagaaattgtagaagatacaagtaaatagcatgatattctttgctcatagactggaagaatattgttaaaatgttcatattacccaaagtgacatattgattcaatgtaatctctatcaaaattccaatgtcatttttcatagaaatagaaaaaagaatcctaaatttcatatagagccacaagaagctttgaatagccatggcagtcatgagtaaaaagaacaaaaatggaggcatcacacgacctgattccaaaccacactgcaaagctatagtaattaaaacagcatggtattggcataaaaaacagccacagtgaccaacgaaacaaagagcacagaaagaaacccatgtatgtgctcaactgattttcaacaaaggtgccaagtatacacaatgggaaaaaaagactctctaaaaatggtgctaagaaaattagatatccacatgcagaagaatgaaaatggacccttatctcacaatatttaaaaaaaaactcaaaatgaattaaagatttaaacccaagaactgaaactgtaaaactactagaagaaaacagaggggggaaaactacataacattggtttaggcaatgattttttggatttgatcccaaaagcacaggcaacaaaagcaaaaataggccaatgcaattacaacaaagagaaaacaataaacaaagtggcaacctacagattgggagaaaatatttacaagctatatatccaataaggagttaatgtccaaaatatataagaaactcaaacaactcattagcaagaacacaaataactcaatttaaaaatgggcaagggatttgaatagacatttctaaaagaagacaacaaatgaccaacagatacatgaaaaaatgctcaaaatcactaatcattagggaaatacaaattaaaaccatgatgaaacattaccttatgcctgtaacaatggctactgtcaaaaagatgaaagataacaaagtgttggtgaggatgtggagaaaagggaagccttggacactgttggtaagaatgtaaattagtacagccattataaaaaactgaatggacattactcaaaacactcaaaacagaattaccttatgatctagcaatctcacttctgagtatttacccctaaaatttgaagtcagtttgcagaagaaatatctacactccctcgttcactgtagcattgttcatttggctggaattggagaacattatgctaagtgaaataagccaggcacagaaagataaatgtctcatgcccttactttacgtggcatctaaaacaactgaactcaaagaagtgacagtaaaatggtagttaccagagtctggggcaaccacccttctactttctatctctgaatttgactactctaagtacctcatataagtgtaatagtgtatttgccgtttttatgacgagcttatttcacttagtctaatgtcctccagattcatccatgttgtagcatgaaaagaaatacccatttattatctcacagtctctgtaggtcagaagtccagacacagggcagctggtatgggaatgtggggaaggttgtgcatgtgtcgggtaaaggggtatatgagagctgtctatactgtccactcaattttgctgtgaacctaaaactggtataaaaaataccatgtgacctatggtattctctacattgagctgctatctgtagaatcttttccttgatgacttttttcctttatgatctctcatgttagcatgacttcaagctaacattatctacactaggcaagcaaggtgaatcttatttctaaaaactcctcagaaatagtactttgtacaaaggcaaacaaccaacgcactgatatgagctctaaccattcattcaccatgtcctgtagagactgatgtatcttttgaaagacttttcaaaaatgcaataacccttgagttaactagatatcttaaaatcgaaggctagagattgggagagttcgcttctataatttgcatctgctgtatatttgagaatatataaaatacaagaacccaaatagatgggtgaaactcttaaaatgttaaaatcgtagctagaagttagaaacctgtgtaagccatattaaagagataaagtaagtacagcatttctctatgaacatagatgaaaaaggatggaaagacactagatattcaagatacactacatatacatgaggtatcaaatatccaagatacattaaatatatctgaggcatataaaatactacccaatatccataaaatcttattcagccacccattggtgacacccattctggctccatgtatcctctgcccaagaaaggcaaataaaatacattgtagctcagcaggcaaactgatggactacagctgtggccaagtgcatttgcgctggccttactctaataaagtgtgtcaattgtgcatctgttgggtccccttgcataaacctcatttctagtctctgtaagcacaccatcagcaaaggagagctgatgtggaaaagagaaagacaagacataaacattgcacagcccaggatttaggtagtgtggtccttccacccacttacattgtattcacatgttaacctaccctcaactctctccccttgcctcccactgtgtgttttaactatctttactaaactatatgattcaagcatcccaatgtggtgtcacttttttgtcccatgacctctgggataagtatatttggagactaccactgcatcaagttaacgtccctcctgacaccacacaaatcatctaaattcaaaaggtgccaatatgaaactgtcagccaaaaaggaaaatcaattggttgctattatgaagattaactgggtagatattaaagattgtaaccaagatgaaacaactagaacctccaagtttttctagtccatatcaagctcaaaaattgctttaatatgtaaaatgtacagtaaattaatcataagttatatttaactaatttgtctgtcatttcccaaaagtgcttcctatatttatccttacatccatgaaaaatagtttagaactaagggggtggggggagcacagggagttaggatgaattcagcttctaaatttgctacttgatccctgcctgctatggtttgaatgtcccctcccaaagtcatgttaaaatgtaattgtcattgtaacagtattaacaggtgcagcatttaagagaccattaggccagaaaggttctgtcctcatggatgggtttaatgcctttaaaaaataaaggagctttttctttctgtgtcacttgccctttcacctttcacctcgagatgatggagcaagaaggcccttactagatgctggcaacttgatacttggacttcttagtctccagaattgtgagaaataaatttattttctttctgtccagtctgtggtattctgttatagcatcaaaaaattgaccaagacactgccttctcaaactaagttacctggacatccttgactctagtttaatcttaacttctctgcctttattctccctagatttttcacttaaaaattataatacatatacatacataaacacacacatacacatatacacatacatatgtatgtgtgtgtgtgtgtgtgtatatattatatatatatatatatatatatatatatatatatatatatatattttttttttttttttttttttttttttttgagacagagtttcactcttattgcccaggctggagtgcatggcgtgatcttggctcactgcaacctccgcctcctggattcaagcaattctcctgcctcagcctcccaattagcagggattacaggcatgtgccaccatgtccggttaattttgaatttttagtacagacggagtttcaccatgttggccaggctggtcttgaactcctgacctcaggtgatccaccctccttggcctcccaaagtgctgggattacaggcatgagccagcatgcccagcctaatcaatatatttttataaagcttttttgaaaccagatgtgatacaaatatattcatgttatttatagaaagtacataaatgactatattcatgcacacacacacacacacacacacacacacacagagcaaaaaacaacttggttattaaattgttactttccaactgccctactattttcattcaattgttaaagcagctttttaacatcctctttcagagtagctcttatatctatcttcctaacagtttagctcataatcaaaaacaaatgtgaaaagcaaacataaatataggtataccaatatgtaggtatttttatataagtgcatattgttctaaataaaaataataggtcaaattaatatttatcagatcaactatatttcaaacagtagaatactattacgaggatagcattgaactagaaaatcaggagttctaaggcaaatgctttcactaattaaatgtatgaccttagccatatgaattgtctactcagaatgtagtatgtgcccagtaaatgtttgtcaaatgaataaacaaaggaacaaacaaaggaatactttttgtttaataaccaagagcagaagttctcaagaactacatctaacctgagagatatacaacctctctaccacatcccaaagcctcaatggcataatgattctttctatttaacactgtagaaaaaaatatttcttcaaaaggctcagttgatcacttaaagcaaatttatatctatagaaatttcagccttctacacgaggggaaaaaaaacactttttaatgtagcaatttagtttctcctttaggttaagtgcggtacagctttaaaaatgagaaccaaaacaaactagtagcactgcaaatttcttaacatacaaatttagtgctgaacaatactttaaaaaactacagctagagagtgaacaggaatgtttgcattttattcctcatctgacattcagtgatgaatgtaaaatatgccctcagggaaaatggtttatacatattactcataaagatgtatttttttttaagtcgaagtctgtattgtatgaataaaaagatccaacttgttactttggcaccagagagtctcttttcaaaatgatttaatagaaaagtttctattctctttatatggacagaaacttctctgtccatataaagagtttagaaactcttctacccataaaaatgaatttcagagagttctaaagcaatgctgctactacttaaataacaacagagtcaaaatcaaatttatcttagtggaagaatggcattcctcctagttaccataaactattggtctgaaagaatgtggggaaaaaaactagatgaacaacgttctcactcttacccttaaacaaatgctgcagtttacatcaaaagaatattagtttttactcagtgaaagagtaaagttttgagtaaatcacccattccaattatctagtacaggaagaaaactggccattaaatataagggggaagaaatgaccactaaaatgtatggtttgaaaaactttagacatatatttttcttttttagagatagggtcttgctattggccaagctggagtgcagtggtgtgatcacagctcactgcagcctcaaacttctgggctcaagcgatcctcccatctcagcctcctaagtagctgggactcacaacaccacacctggctgatattttttgttttgtttttttaaacactgggtctctctatgttacccaggctggtcttgaacatctggcctcaagtgatcctcctatctcagcctcccaaattgctgggattataggcttctgcactgggcctagacttctaccatatgtttctttctttctttttgatttttagtagagatgaggtttcaccatgttgcccaacctgatgtcaaactcctgagctcaggcaatccacccaccttggcctcccaaagtgctgggattacaggtgtgagtcaccgcacctggcccttatcctatgtttcttttatgaaactctgcaaccagtctttacattacattttcacacatgccaagctaaactctgtgattatgaaaatattttctgtgcctttgctaatacatgtctccttggtccagaatattatattcctcactcccacatctaccagtagaaatctatccacctttctttaatacccactgaaatatcaaccacctcctctaggaaactcctctgcttcattcaatcacatgtgatctcttcctactcttaattccattatcattcttcttaatctctctaatgattacaaattttgtcaaataatgcaaggatgtgtacacttattttataccacaacccaaactgaaatcttcttgaagagacagtaacttgtttatttttgaatctttaacaggacttagtgcagtcctccgcacaaagtatgtactcaataatgatttcttcaatggattaagtaaataaaaataaatgtgaagtaaagttatgagatttctcaggaagatcttaaatataatataagcaaggctctcaatataaatattttggtattttaaagaaattcaactaaagatatttaaagttctttctcaatacaaaataagtattagtatatggaattaggctgtattgctctacgggaaatcacaggaattttagtttgcagttctaaaatacctctaacttcaaaggcagtaagaaagacttggaacaataagagttagtctccatccattcgtgtgtttattcatcaagcatttatggaaagattattatgtgcagttgtgatgcctttgctacctaaatttcataaatatcatttcacttctattaatattttcatatgccatagtcacaaatctttattctaatggttcttcctaacctttttcttaccctgataaattaacccctgtgataaaaagtttatgatagcccctaagattcctactccctatatacaacctgcataaacttctccccgttgtgagataaaaataagactttacttccatgattagattatattatgtagtaaagatgaggggattttatgaacgtaattaaggtctacctcaattgattctgagttaatcaaaagggagattatcttgggtggacctgacttaatcaggtaaaagtccttaaaagatacaatgcacccctacagaagagacacctttgttggctttgaagaaggaaaaaaaaaagtagtagtagtaataagctgccacgttgttgagagggcgatatgactaggacctgaatgcaacctttaagacctaagagtcatccttagccaacagcccgcaaaagactgggtatctcactcagtcctacgactacaagggataaattctgcaaacaaactgagggaccctggaagctaatctttccccagtcaagcctttagtgagaccacaaccccagttgactctgctgggagccttgtaatacactgagaagaaaaacccagataagccatgcccagactcctgacccacagaaagagtaagatgataaatgtgtactgttttacggtgctaattttgtggtaatttgttatgcagcaacatagaactaatacaacccatctaattatatttcaatcctggttcctcatgtccccctgaaatgaattctaatgtaggctttctgtcttctgcatggtcagtatcaaacccctctgaaatgaaaactagatggcataatattaatacatttaataactgtagtcactgtactatgtgagaattgacaacggtactgacaaaagattataataatgtgctagtttgctcttatgactagattctgaaactcagtagcaaatttatttttgccaattttattggacttctgatttcagctccaatatgtaaagaactggaagtcatcacacctgttttacaacagaaaaaagttaaacaaactaaaaatcaattacttttctgggatccatctgagaactgaggtcacaaggcaaactgccaccctgaaatctggagagacaggtaaatacagagaatcaagatatgcttactgggacagcggccactaaaacataaattgacagaaatagttaaaagataatattgatgaattgctggagataaaatgtgaactagtttataagtgagaaactcctaggggctgcagtcttgccagggggcccacaatttttaagacattacctctaaaaatcccaccaggttcccacagtaaagagccaagaaaaaccctactgtttcgggcaggaggagggaaaaaaacaaccattttgaaatacgttcaacgcattctctaaaacaatggccagtctgccagtaaggaagattttaccagatccttatccaacatgagggaagggatcatttcctaaactgcagctccctgccatctaatcttatgatatgaatgaagagctcagaaacacttgtgaaggtcacaggcaagggacacagtcatgctaaaagactgagacataatcataggattagaagatgcttcctgttccccataccttaccaccacatcaacagggctccagtataacagcagaggattacaacagagagagacagctgcaaggctcagattctatttaagaataagtttttagggacattggagagtaactcaagtccacattaagaattaattaaagagcactggtcaagataactacaaggtagttataaaagacagtataaaatgtgttttaacatagatacaaaagacaatataaaatgtattctgtttttaattttttttatctgatttgaaagtcagttgcaaaaggtaataattgtaaatctgtgttgagagacatacaatgtgtaaagatgtaatttttataataatgacacaaagaaggtaggattaaaaaaacagctacataggattaaagcttctgcattctattgaaaattaaattagtattaatccaaactacataagatgttaaatataattcctaggacaaccactaagaaaataactaaaaaatacacagtaaaagaaaagccaagggaattaaagtgacacattagaaaaatttaaatggcacactagaaaatatctatctattagattcaaaaggcaatgatagagaaatagagggggaaaaggcaccagatatacagaaaacaaacagcaaagtggcatttgtaaacactaccttagcactaattacattaaacgtaaatggagtaaacactcaagttaaaaggcagagataagcagaatgaatttttcaaatgctccaactatatgctgtctataagagacacactttaaatttagacacaaataggttgaaagtaaaaggaatgttattcagccataaaaaggaataaagtattaattcatcctataatgctgaacatggaaacattacactatgtgaaaaagccagacacaaaaagtcacatattgtatgattcaatttagatgaaatgttcagaaaaggcaaatctatagaaatagcagattagtggatactagggaatagcaggtaagagtaggcagtgactgttaatgagttaggagtttctttttggggtcagaaaaatattctggaattagacagtggtgatgattacacaactttgtgaatatactaaaaatgactcaatgcaaaaatgcgcaaagaatttgaataggcatttctctaaagaagatgtctgaattactaataagcacatgaaaatatacttaacatcactagtcatcagggaactgcaaatcaaaaccacaaggagatactacactttatacccatttgaaaggctattatcaaaaaaaacataaaataacaagtattggcaaaaatgtggaaaaattggaatccttgtgcactgctgatgggaatctaaattatgcattgactataaaaaaaacagtttggtggttcttcaaaaagttaaatttaggctgggcgtggtggttcacgcctgtgatcccagcactttgggaggccgaggcaggcagatcacctgaggtcaggagttcaagaccagcctggccaacatggtgaaaccctgtctctactaaaaatacacaaaaattagccagacatgttggcggacacctgtaatcccagctactcgggaggctaaggcaggagaatcactggaacctggaaagcggaggttgcaatgagctgagatgatgccactgcactccagcctgggtgacagagtgagactccatctcaaaaaaagaagttacatttagaattatcacaagatccagaaattacatttctaggtatatatccgaatgaattgaaagcaaggtcacaaatagatatttgtacaccagcgttcatagcagcattattcacaacaggcaaaaggtagaaacaatccaaatacccatcgacagatgaatggataagcaaatgtgagattatatatatatatatatatatatatatatatatatatatatatatatatataaaatgaaatattattctgccataaaaaggattccgatgtatgctacaagatggacgaaccctgaaaacattatggctaatgaaataaatcagaaacaaaggacaaatactgtatgattccacttatatgaagtagctacaatagccaaattcacagagacagaaagaatactagagggtaacaggaaatggggaaaaggaatctggggagttattttgtgggaacagagttcttatttggtatgatgaaaggttctgaaaatagatagtggtcttggttgtctaacattgtgaatgtacttaattgtacacacacaaaaaatgctaaggccgaacgcagtggctcacgcctgtaatcccagcactttgggaggccaaggcgggcagatcatctgaggtcgggagttcaagaccagcctgaccaacctggagaaaccccatctctactaaaaatacaaaattagccgggtgtggtggcacatgactgcaatcccagctactcaggaggctgaggcaggagaatcacttgaacccgggaggcagaggttgcagtgagccaagatcacaccattgcactccagactgggcaacaagggtaaaattccatctcagaaaaaaaaaaaaaaaaaaaaaaacctaaattttgttatgcatgtttcaccacaattagaaatgacaataaatatcagaaaaataaatcaaagacctgcgaagcctctggggatgtgggactgggaagaaaggaggagtagtatagtgaagggagctgttgttttttcattataaccattctaacattatttaattatgtataagaattattttgataaattaagatatttaaagctaaaaaagaaattaaagaatttaatgacaaacaacaaggttttaatgatatgtattataaaggattactatccacactatatatttaaaagcccatacaaatcaattaaaaagacaaatacaaccaagacaagcagacaataaacaaaaattttaaaagaattaaacaaaaacctgcagaacaactaattgacaaacctgacaaaaacaaaacctgacaaaacctgacaaacttgataaaaacaagcaatggggaaagaattccctatttaataagtggtgctgggaaaactggctagccatatgtagaaagctgaaactggatcccttccttacaccttatacaaaaattaattcaagatggattaaagacttaaatcttagacctaaaaccataaaaaccctagaagaaaacctaggcaataccattcagaacataggcatgggcaaggacttcatgactaaaacgccaaaatcaatgacaacaaaagccaaaattgaaaaatgggatctaattaaactaaagagcttcagtacagcaaaagaaactaccatcagagtgaacagcctacagaacattctgtaggctcccatccctacagaatgggagaaaatttttgcgatctacccatctgacaaagggctaatatctagaatctacaaagaacttaaacaaatttacaagaaaaaaacaaacaaccccatcaaaaagtgggcaaaggatatgaacagacacttctcaaaagaagacatttatgcagccaacagacacatgaaaaaatgctcatcatcactggtcatcagagaaatgcaaatcaaaaccacaatgagataccatctcacaccagttagaatggtgatcattaaacagtcaggaaacaacagaagctggagaggatgtagagaaacaggaacgcttttacactgttggtgggagtataaattagttcaaccattgtggaagacagtgtggcgattcctcaaggatctaaaactagaaataccatttgacccagtcatcacattactgggtatatacccaaaggattataaatcatgctactataaagacacatgcatacgtatatttattgcagcctattcacaatagcaaagacttggaaccaacccaaatgtccatcaatgatagactggattaagaaaatgtggcacatatacaccatagaatactatgcagccataaaaaaggatgagttcatgtcctttgcagggacatggatgaagctggaaaccatcattctcagcaaactatcacaaagacagaaaaccaaacaccgcatgttctcactcataggtgggaattgaacaatgagaacatgtggacgcagggtagggaacatcacacactggggcctgttctggggtgggggcctaggggagggatagcattaggagaaatacctaatgtaaatgacgagttgatgggtgcagcaaaccagcatggcacatgtatacgtatgtaacaaacctgcacgttgtgcacatgtaccctagaacttaaagtataataataaaaaaagaaactatgagataataaatgtttactgttttaagccacaaaaaaattaaacaaaaacctgcagaacaattaatttcgcaatcaaagaaataaactcaattggaacaaagtatattcgaaggatttcctgtgtctttatttttaattgaaaagctagaagcagaaaaataatctattcattttgctaatatatatacagtcactaaaaagttatttcaatgttatagtctctagtcacccaattataaatgtctgtaactaaaattcatactgtctgctatatgcattccaagcctagcagaaaaatgtcacccagacatctcctatctccctttttgtgactatgactggaaaatataaaaaggttttagcaatgaaataagattttgctttaatcgcttacataactgtggagtgagtacagtttccataatcccataaataacttttcttccaatttcccggaagatatttgtctccatatttaagaattaaaagtcctaaaaattttattaggtaagaccaactccctacaagttttattgtatgacttagtatcaagcttaattactagttttcctaaatataactgtttggtgtagatgttcacactggaataaatcttgttttccattaagaattttaaaaaatgtttatgtccgttttatttttagatattcttgtaaaaaattatctgattaaatatgtttttgaaaacaaatcctttaatttatctacaagagactaattgctttagtgtatccctagctatcaaagtacatatatataaaaagacagtagaagagtcaaaagtatcaatattgtcattcaaatatattacttccaaatgcttctgtccttagaggtataacttcctgtggaaaaaagagaagggaacgccacttctctacattggatttaggttagattttgatgcaatgtgatgttactttcaggaattataagtggtttcaatgctttgaatgttaggaggaccaaaatatactaaataatttcaaattaactaaaaaaaattattaaaaatcagtgactctaaaaacaacaacaaaattcttctggccagatacatgaagtaaaatgagggcaacgaagaaagtttggcttagattaactttaatgaaaccttcagaaatgtaatttatgaaaataaaaaagaatgctctgtttctttctactctgaaaatatcgacttgtccctaagaataaaaatgtacacataaacacttctcctatataattaacattgcttgaagacttttattctttcagattattttattttattttagagagagtcttattctgttgcccacgctggagtgcaggggtgcaatcatagctcactgtaacctcaacctcctgggctcaagcaatcctcccacctcagcctcgcaggtagctgggactataggtgtgtgccaccacacccagctaatttttgtattttgtagaggcagagtttcaccatgttctccaggctggtctcgaactcctgggctcaagtgatcctcccagctcagcctcccaacctgctgggattacaagcatgagccaccacgtccagccttgctctttcagacttttaagtaaaacagaggtaggacaatcaggcagtatcttaatcaaaaaataagtaaaataatatgtgatgtttagaaaactatagttattaccttgttgcctctaccctaggaagcttactgtggtaattttaaaattagcatgccaatgtttaaaatgtaaatgattatttaaaggcaaaagaaacaataaatattcccttaccttgtaagatggcaagaaacacaaaattccttggctcacagtctggcacacagataacaaaagtgctcccacttcatcttggaactcaaatgtttcagtattctggaaggtagcacagagattccgacccttggggcctgacccaatggtaccaacccaaacctagaatatgaatatgtcattattagagttatgcctgaaaaaggcatggaaattagtatttatttggaagtatgtacataaaagatcaagcaacaagtttaacaatttatttttaaattgtcagggggttttctattaccttcaattaactgtatacagatttaatttataaatgttttgctttaggcagatcactaaattctcttagagtgaaaattctttgaaagcaaaacaggttgtacctgtctctgtttacttaatagctttgcaaaatttaagcatgtaacaaatttttgttaggtgaataaatgaacaagtgaaatgatgaatatataccaatagcagaatcagataattccaaaatactggggatgaaggccagtataatttgccataggcaagtctcaaaaatgacaggaactactctttcaaaaattcattggtgctcaaagatccttagtcatagaaaaaaatcacacccaccacatcttacagttatttgcaattctatctcccttatatgtagagagagggagagagacgaaaattttgcaaaatgttaacaagtgatgaatctaggtgaaggatataaagatattcacaatattaatattatctttccaacttttctgaaatttctaattttttgaaatacagttgaaagaatcaatgaatgaatgatcaaaatgtagcattgagtagaaaaaaacaaactttttcctttgctctcacaccacagcaatcaacacagaaaacttctgtgaccaaatgtgtgggaggttttttccacataccaagcaatcaattctgcaacagacatcaactgggtgtcctctaattcaattcaattctgatactatctactgggagatgataacttcagatcccagaggttgagggctcagtccccaagactgcccctgatttctgtggccagtcacagttgtttttacttgcacttctgactgatcagctagaaatcgggcatcccacaaccctctgcttgggttcaattaatttggtagagctgctcacagaacccagggacacatttacctacacttactgatttattagaaaaaatattacaaaggatacagataaagagatgtatgtgggaaggggctcagagcttcaattcccaggcacatcaccctccaagtgttcaggaacctccaagtgttcagctatctggaagctctctgaaccctgtccttctaggtttttatggaggcttcattatgtaggcatgattgattaaaccactggccattaagataaacttaacctttagcatcatctcccccaagccctccccagaggttgaggaatgggggtgaaaatcccaactctcctatcatgtcttggtcttcccggaggccagccctgatcctgatgctacctaggagccccctaccattagtcatctcattagcatacaaaatgtcactttggagattctaaggattttaggagttgtatgccaggaaatggagtggaagaccaaatatatatattataaatcacaggcatatacacacaagaaacattattcacctttaaagaggaaactctggcacatgctacaacatagatgatgaactttgaagacattatctgcaacatggacaaaccttgaggacattactaagtaaaataagccagtcacaaaaacgacaaatattttatgattccacttatatgaagtatttatagtaatcagattcatagaaacagaaagcagaatggtagttaccaggagctgaggagagggggagaatagagagctgttgtttaatgggaacagagtttcagtttttcaagaggagaaagtcttgagattggttgcacaacaacatatacatacttaataagactgagctgtatactcaaaaatggttaagatggtaaattttatatatattctaccacaattaaaagttttttaaattttaagttgaaggaaaatattacagtgtaacagaatccagctgcacaactacattattataattcagcgacattataggttaaatggacttttgtgcagtaggctgagaacatagagcctgtaataacattcttatgagaaaacgtatgctgaatttaccaacttcccatatttatctgtgtctctaaagaaagcaacttgaaaacgtggaacatgtattcttccttcactgctgttcatagtcacatttctcagcaggaacactctggcatttggaaagcacaattcttagttacataggagtagcattctaggttcccaactaccaaatgccgtagttgctcccaagtaattgtgaggaccaaaaatgttcccacctataaacctgtgtatatagcttaataaagagctagcattgtgttaggcacacaggtgatgttaacttaaccactttagcattaaccacagcttaacatcacctgtgtgcctaaccactttaaaatatttcataaaaagaaaccagaaggcataatgaaaaataacaatctatacatttccacaaaaattaaaataacatttagtagccatcgttataaaacattaaaatcttaaatcataggactcataagagtacttttaactcatttcagatattcaaacatgctgaacacttgctaaataccagctattaatctaggcacagaggaagaacgtggatgtaaaaggaagaatcaggatacactgtagtctaatggaaaagagaagcataaataattatacaagctgggcatggtagtacatgcctgtagtcccagctactcaggaggctgaggcaggtggactgcctgagcctgggagtttgaagccagcctgggcaacatagcaagcgaccttgtctctaaaaagataaagtctggccaaaatggcaaaaccccgtctctactaaaaatacaaaaatgtgccaggcatggtggcatacacccataatcccagctactcagaaggttgaggcaggagaaccgctggaacccaggaggcgaaggctgcagtgagccaagatcgcaccactgcactccagtctgggtgacagagcaaaaccttgtctcaaaaaataaaagtaaaaataaaaatacagagataaaataaataaaatataaataggctgggcacagtggctcacgcctgtaatcccaacactttgggaggctgaggcaagtgcatcatttgagggcaggagttcaagaccagaatggacaacatgctgaaaccccatctctaccaaaaaaataaaaaattagccaggcgtgcggcgcacacctgtaatctcagcaacttgagaggctgaagcaggagaattgcttaaacacgagtgagccaagatcacaccactgcactccagcctgggcaacagagccagactctgtctcaaaaatcaatcaatcaataaataaaacataattatacaatgagaattaaagaaatcaaaattttgttttcattacaaaactaaaacttacttagaagaagaagctgaaatacagccttttgcatcccaagtgactggattatttccttctgttgacacatcattaagtagctgacagattttcttttattgtaaaactggaatgttgaatttcctaccaagatttacttgctggcacttcaggtatcttctaacttgtttacatagttatattgaagtagaaacactgaaggccttccaaaaaaaaaaacaacaactaacctgtgaatttttaatgatatgattagcctccagctggatagtaaatgtaacaccaagttctgacgaaaaggatttcattggtgataatgtaccagatgtcaaaacaatggtctgaactttgccattaatatctgaaaaggcctaaaagaaaacaacattagataaataaaattatctttagaagaggctgggcaaagtggctcacacctgtaatcccagcactttgggaggctgaagcaggaagatcgcttgagtctaggagtctgagaccagcctgggcaatatggtgaaaccccgtctctacaaaaaatacaaaaattagccgggcatggtgacacatgcctatagtcccagctactcgggaagctaaggtgggaggatcgcttgagcctggaaggtcaaggctacagtgagctgagattgcaccactgcactccagcctgggtgaagagcaagaccctgcctcaaaacaacaacaacaacaacaacaaacaactatctttaaaagagtcaaccacatttattaaaatgctggtactgagcaagaagacaaaatttccatttacatgatgagcttaccacagctggatttaagcaccaaaagtttagcacatgaactgcagttttctgtcgtgaacgtttcttattttttggtagaaccaacaacccatttttgtctgaaatatcaatctgatttgtccaggagtaagtctgttgaatcgcaattttataatcatctgcaaatctagatgcaaagaaagtgctaattaagtggcaaaacttttaaaacctatgacccagctacatacaatataaaaactgattacattaaaactcatttgaaagagctggtaccttcccattcaaaaataacattctccttaccattaattaaattcagtaattctgatattaataaagccattaatcatagaatcaactgattctcagagggaatattagaaatcatctaaccatctatcttttatcagctacttcctaacctcattttcaaacattacatatgtcatggcagaagcagaattaaaatccaggcctcctaactcccagtccagagctctctgcatgctctactacatgatgagttacaaaatagaaaacagtattatggttaaagagactaaaaggtgggttatacttttttattaaatgagaaaatagaaggataatttttactgaaagtttttaaagtattagcaacaagttataaaattcttacattcctttgaaacctgagtctcagccttcatctacttttaatgaaggtgctgaaccagatgatatctgtgatcccatccagtgtataactgctttcaataagaatctagaaaatggttaagcttaaaaataataaaatgtggccaggcgcggtggttcacacctgtaatcccagcactttgggaggccgaggcaggtggatcacgaggtcaggagttcgagaccagcctggccaacatggtgaaaccccgtctctactaaaaatacaaaaattagccaggtgtggtggcagtcgcctgtaaccccagctactcaggaggctgaggcaggagaatcacttgaacccgggaggtggaggttgcagtgagctgagatagcgccactgcactgtagcctgggtgacggagcaagactccatctcaaaaaaaaaaaaaaaagtaaaatgtgatattctctaccatgtcttcgctatagtatttccttattcatttcactcctagagagattagatctcaaaattaaagttgggaacttaacaactgtggagagaatcttataaaaatactgggagccaaaaactgtaaaactcttaaaacaaaggggagaccgggtgcgatggctcacgcctgtaatcccagcactttgggaggccgaggtgggcggatcacgaggtcaggagatcgagaccattctggctaacacggtgaaaccccgtctctactagaaaatacaaaaaattagccgggcttagtggcgggcgcctgtagtcccagctactcgggaggctgaggcaggagaatggcatgaacccgggaggctgagcttgcagtgagccgagatcgcgccactgcactccaacctgggtgacagagcgagactcccgtctcagaaaaaaaaaaaaaaaaaggaaaagaaaacataggggaaatcttcatatcagatttggccatgatttactggatgtgacactaaaagtacaggcaacaacaagaaaagagaaagataaattggacttcaacaagattaaaaaccttttctgcatcaaaggacactatgaataaatgaaaaaacaacccacagaatgagagaaaatatttgtaaagtatatatctcttacaggactgacatccagaatatctaaataactacagctcaacaacaacaacaaaaaaacccaataattcaaaagtgggcaaaagacttcaatagatatttctccaaaaaaagacatacaattggccaataagcacatgaaaagattctcaacttctctagtcattaggaaatacaaataaaaaccagatgatatcacttgatacctattaggatggctattatacaaaaaataaaataacgagtgtcagcaaaaacaattctgatatatgctgctacataaactgttggcaaggatgtgtagaaattggaacccttgtgcattgataatgagaatggaaaataatgcagttgctgtgagaaacagtatggtgagtcctcaaaaagttaaatgcagcattaccatatgattctgcaattccactgctaggtacttatatacacccagaagaactgaaagcagaactcagatatttgtacaccaacgttcatagtagcattgtttacaataggcaaaagatgaaaacaacccaaatgtccattaacataagaataaattaacaaattgtggtatatacatacaatggagtattattcagccatagaaaggaatgaaattctgatatatgctactacataaatgaactctgaaaacactgtgccaaatgaattgaaataagccagacacaaaaagacaaacattgtatgatcgctcttatgtgaaatacctagaaaggacttcataagatgaaaatagaatacaggttagcaggtgatgaggggaaagactctaggggttattatttcatgggtacagaattcctatttggaataataaaaaatttctggaaatctctggaaatgagtacaatgtacaacattgcaaatatactgtacttaatggcactgagttgtatacgtaaaatggttaaaatggtgtattttatgtatattttaccacaataaaaaaaaaataccagaactaggtactactataatttaagttacaggatgagagggattggttgtttttcattttccacagttcatacaataaaaaagggactttctgacactgtaggaacataagaaaactttagcaatagaagataatttaatatgaattaattaaatatatttatttaatgatttcaatattcattaatataaaagactaattttggccaggcatgggctcacacttacaatcctagcactttgggaggctgaggtgggaggatcacttgaggccaggagttcaagaccatcctgatcaacatagtgagatctcatctctacaaaaaaaataaaaattaaaaaattagctgggtgtgggtgttgcacacctgtaatcccagctactcaggaaacaggtgggaggattgcttaagcccaggaggtcaaagttgcagtgagctgtgatcatgcaactgcacttcagcctgggtgacagagaagtccctgtctcaaaaaagcatcagactaatttcaattcctctaagtctgtgtcaataagagcaaatatataataatatctataacacttgttttcaattctcctatttactcacccaaaataggtatgtattaaacacatgctagcatccaaattaggctatttttaaaaggaaaatacatactagttatcttcacttacctgctattttgcctaaaaagatagtcaagtaccataaaaagtcctttaagcattatttgagttgatgcactaataacaggtacttctcttgcctcctctttaccataaattggtgagattttttcctctttttgaagaacagcagaaaaatgtccctataagaaattaccatattaagtatagaggggttgggagggaattggaaaaagaaacttctcaaaaatacaatgaaacccaacaaaacatgcattgaaattttaggtgaacagaattgctatagtttgatagtctgacttctccaaatctgatattgaaatttcatccccagtaatggaagtggggcatatcaggaggtttgggaccatgggggtagatacctcatgaatagattaacgccctccctaagtagagagggggtgagttagtgctctgttagttcccacgagagctggttgttagaaagagcctgacacctccctcccttctctctctcgcttcttctcttgccatatgatctgtacaaaccagctccccttcaccttttgccatcagtggaagcaggctaaggtcctcaaaattagatgctggagccatgcttcgtacaagctgcagaactgtgaaccaaataaacctcctttctttgtaagttacccagcctcaggtatttatagtgatacaaacaaagacaattattaacagcacaatgctaacaatatattttagattgccatattagcaaaattctcctcagagtcaaagactctttaataataagttaggtatttagaagattcaatcagggtattatttggtgcctttcagatgtaaggaattaaataaaaatgtagcaaatggcttctccaaaaggctttaaagagttgatatgttgccttaaatccatgagttatttccagaaagtaattctgatgctgagaataatatgactacatcacaagcaaaactaaatgacttaaggaaacaatacatgctaaataacaaaatgtatgttaactggttctttggtctttacatggctcataagttttaatatggatgaaagtgtggacattaaaacaaaattataagaaaacagaagagtatgttccccacattgtaaaagagaaaattctgaatactgaagcaataaaagatattggtgacaactctgatgtctgacaataaaatgtgttcaatgaaaataaaatggggaaataggataaataagaaagatacattttaatattcagatatatcatgaaacaatacaaatctataagagtaaaaatcagccttcactgaacaaaacattacagaatacaaataagtagaaagacttaaaaaacaaaccaacaaagaacaaacaagaaagacaacatgaacttggaaaaatattcagccctgcaatgaaatacaaatatcaaattattctttttgaaaaatgaagtcccctcagcaacaccttatatcaaagcttaatatccttctccaacactggcagaacactggcaatttactctgataaaatatagaaaatataaactactaaaggtgaggcgctgtactaaaaacagaagggctaaatgaaatcctacatattcaattattagagtactccgagctcaattccagttagcttacctacacattggcagctgggttggggggggtagaaaaatagaaaactaagcaatggaaaaataaataaaaagttaattatggttccttaggaaacatacataaagctgtataaaaatataatcaagtaagctacatgcattactatcatgggctataataatacatacacgtgatgatatccacgctgaatatcaatataactatactggcagaatagagagtgaagagagagaagaaagaagggcagaaaagcaggaagcaaaggaagaagagagagcgcatgagtgagcgtgtgtgtgtgtgtgtgacagagagagaagagtgtgtgtgagtgtgtgcgtgtctaaaggagctaaatcatcattatacttaacagaaagtcaacagacaacatctaaaattgaaaactccaaagaagcagaacccacgttatttttttaaatgtggttaaatatcagaagaaaccactacaagagataaaagtgcactccaaagtgagaattgggattgaggagtgggtcagaggaatgcttttctcaacagaactgactctttatattctataggtatactactttggtaaaaattcctaaaaatattgataatcataatgatgaatgtcttagccaactagaattagggcaaatttccttaatccaataaaaataactataaaatatataatataataaaaatataatatatatattatttaacagctctaattaattttttaatttaattaactgaattgaattgaattaaaattaacagctttattgagctataattcacatgcttacaatttacctttttaaagtgagttctgtgggttatttctatattatatattttatatattatatatttatatataatatagtatatattatatatttatatattttatataaatatattttatataatatatttatataaaatatatattcatatatgtattaatatattaatatataaatatattttatatataatgtaaatataaaaatatatatttatatataatatatttatatataatatatttatattatatttatatttataaatttatataaatttataaataattttataaaattataattttatttataaataaatttatataaatttatataaatttataaatataattatatataaatatattgcatgtttatgtattaataaatatattaatatataatatattatatactatataaaatatataaaaatatattatatactatataaaatatataaaaatatattatatactatataaaatatataaaaatatattatatactatataaaatatataaaaatatattatatactatataaaatatataaaaatatattatatactatataaaatatataaaaatatattatatactatataaaatatataaaaatatataaaacattatatattaatatattatatatagttatatactatatatagtatatatatttatataaaatatttatataaaatatataatatatatactatatattatatataaatatataatataaaaataacccacagaactcactttaaaaaggtaaattttaagcatgtgaattatacctcaatagagctgttaattaaaaaagaatttttaatcacagcaaacatctcaataaagggtgcaatactagtaattcctcctttaagcaacaaaaccaagatgtctttttcttttttttattttattttatttcttttttgagacagagtctcgctctgtcgcccaggctggactgcagtggcgcgatttcggctcactgcaagctccgcctcccaggtttgcgccattctcctgcctcagcctcctgagtagcggggactacaggcgcccgccaccacgcccggctaattttttgtatttttagtagagacggggtttcaccgtgttagccaggatggtctcaatctcctgacctcgtgatctgcccgcctcggcctcccaaagtgctgggattacaggcgtgagccactgcgcctggcccaggatgtctttttcattgcctgtgataaacaacgcactggaagtctgagacagcatagtaagaaataaaaacatgaagaaatagaaagaaatgagaaagaaagaaaccggtcattattcagacaatatggttatctacatggaaaatttaagataatctgtgggcaaacctgtaaaataattcaacaaggtggttaataagacaattataagataaatatataaaaatcaaacaccagttttatatagcaataacaattaaaaatgtaattttaaaaatatatcatttgtaatggaaacagaaactttaagctacccatgaataaatctaaccaaagccatctaatcttttaaaaataaaattataaaattttattgaaagataggaaaaaataatgaagaactatatcttgtcatgaatgggaaaacttcataatgtaaatgcatgaattctttccaaattaatctataaatacagtgcaattacaataaaaattctaacagaacttttcctagagattataagctaattctaaaattcaaatggcagagtaaaacaaaggacagctgatacaattccaaaggaaaataataaagtgagggatatgccctactatatataagcacttttcttaaatcattaattaacaaatgtgacaaattagagaaacagaatggtggaacacaatcaagtccagatataaattcacacatatatgaaaattagagggactgggtgtagtggttcactcttgtaatcccagtgcttcaggaggccgaggtgggaggatcgcctgaggccaggagttcaagaccagcctaggcaacatagtgagaccctgtctctacaaaacataaaaaaaattaagccaggcacgggtggctcatgcttgtaatcctagcactttgaaagaccgaggcgggtggatcacttgagctcaggagctggagaccagcctgggcaacatgacaaaagcccgtctctacaaaaaaatacaaaaaatgagccaggtgtggtggcatgcttgtggtcccaggtacttgggggcgctgaggcacaagaattgcctgaacctgggaggcggaggttgcagtgggctgagatcacaccactgcactccagcctggttaacagagtgagattctgtctcaaaataaataaaaaaataagtaattagccaggtgtggtaatgcatgcctgtagtcccagctactgagcaggctatggcaggaggatcccttaagaccagaaatccaaggttacagtgagctatgaatgcaccattgcacttcattccgggcaacacagcaagactctgtctcttaaaaacaaaaaaaaaaagttaaaaaatatttttttaattaaaaaaagaaaaataggtagcagaggtagcattacaaattagagggaaattaatatgcactatttaggaaacagtgctgggacaattctctatccatacaggaaaaaaattgattcataaattcacaacataaacaaaatgaatccaaggctttgtaaaagtatttataaatcccatcctttataaacaataaataccttaaaatttttaggagaaatataacataggataagaaaagactgcttaaagtaaattcaaaaaccacaattcataagggatgttcatatcagaactgtttattatactgggaaactggaaataacctatatttcaacttatcagattaatcaatttagaataagtacactcataaaaatgctacaccgcaattaaaaattatgtgaaggaatctttacttaaataggaaagtatacacaatatattgttaaattaaaagagggtaaaacaaatgtgtcatatcagaaatatatttataataagcaaatatgggcatagaagaaggcataagtagacataaatcacaatgttcacaatgttcatctttgagtttatgagtcatttttctttgtgccattctgtattttccagtttttttcccttgacatacattttatttgtacattttataactgacatgtaacatatacagtagaatgaactaatcttacatgtacacctcactaaatacacacacctccccatgtaactaacacctgaccaggatacaaaacattcctagaatcccagatgttcctttgtgccccttctcagcccaaactgcttcaaacccccacatagttgtaaccagtacttcaacttctgtcaccataattaggtttgtctgttcttcaacttcataaaaatagatttatacagtttatacccttttgaatctggtttccttcacctaacataatatttaagattcatctagagccaggtgcggtggctcacacctgtaatcctagcactttgggaggccatggtgggcggatcacctgaggtcaggagttcgaggccagcctgaccaacatggagaaactccgtctctactaaaaatacaaaaaattagccaggtgtggtggcgcatgcctgtaatcccagctacttgggagtctgaggcaggagaatcacttgaacccaggaggcagaggttgcggtgagctgagatcacgccattgcactccagtctgggcaacaagggcgaaactccatctcaaaaaaatatatatatatatctatatggttgtgttggaagcagttcattttttattgctatgtagtattccactatatgaatatgctacaatttatccttttctttttttttaaacagggtcttgctctgtgccccaggctggagtgtagtggtgcaatcatggttcactgtagcctcaacctcctgggttcaggtgatcctcctgcctcagcctcccaagtagctgggactacagcgcatgccaccacaccagctaattttttgtagacaacagggtctttgttgcccaggctggtcttgaactcctgggctcaagcaatccgccagcctcagcctgtcaaagtgtaggattactggcatgcaccaccaccctcagccccattttactgttatataagtagctttcaaaatgcaaacaatttatgcaaaaaatattatgaaagatgtcacaatatggaaaaattcttacaatagataccacgctgcattttataaatgcagggcaaaaatttaagtatatcctgattaaaatatatgttttaatagtcacatgccccgaatactattgtgatcatgttggcaattattttcatcattttttttgttcaaaaacctctttgagaaataacatcagcaagatggaagaatttgagttttctagccaggcacggtgactcacacctgtgagcccagcactttgggaggccaaggcaggtggatcacttgaggtcaggagtttgacaccagcctggccaacatggtgaaaccctgtctctaccaaaaatacaaatattagccgggcatggtggggcatgcctgtagtcccagcaactcaggaggcttagacatgaggatcacttgaacacgagaggcagaggttgcagtgagccgagatcacgccactgccctccagcctgggcaacagagtgagacttcatctcaaaaaaaaaaaaaaaaaaaaaagaatttgagttttccattgtcatctcccaacaatgaaccaattctgacaaccactcgcacatgagagtacctttgttaagagtctaagagtctagcagagaagttccaggaccccattggagcaaaaaatccaagaacagatgcattgaagagggcaaaaagtatagtttcatattacctacatcacccctgccccatggaagtacagcccagtgccaagagagcctccattagcccacaattcttcccatggggaaaagtgagaatatagtgagtgattaatgaaataaagaaaatgtggcacatatatatataatgaaatattcagtcttaaaaaagaagaaaattttgccatttgcaacaacatggatgaaactggaagtattatgctatctgaaataagcctgatagaaagacaaatactgcatgctatcactcatatgtgtcatctaaaaaagttgtactcgtagaagcagagtcctcagccccaaagttcactggtgaagatgtacaacaacaggaacttttgttcattgctggtgggaatgcaaaatggtacagccactttttgtcaagagacaaagtcttgctatgttgctcaggctggagagcagtggctattcacaagcatgcaatcatagtgcactacagcctcaaattcctgggttcaagcaatcttcctgcctcagcctcccaagtagctgggactacaggcgcataccaccatacccggcagttacagccacttttgaagactgtttagcagtttcttgcaaagctaaacacagtcttaccatataatacaacaattgtgttcctaagtaaatatccaaatgagtagaaagcttgtcactaatagaaatgtttataatagctttattcacaattgccaaaaactggaaaccatcaatgtttctttcagtaggtgaatggataaactgtggtacatccaaataatgaaatatcattcagctataagaagaaatgagctatcaaggcaaaaaaatacatggaggaatcttatatgcatattgctaagacagaagccagtctgaaaagactacatactgcacaatttcaactatatggcattccagaaaaggcaaaacaatggagttagtaaaaaaaatctgtggttgccaagggtttggtgggtgtgggcgtggtgtggtggagggatgaataggtgtaacacagaagatttttaggacagtgaacacactctgtatgatactgtagtggtggattcctaggcaaaacctaattgaactctacaacacaaggggtaaaccttaaggtaacctatggactttaatgaacaataatgtagcaataatggttcatcaattataacaaatatactacactattgtaagaggtcaataatggggaaactatggagttggtgtgtattgtgtatgtgtataggtgtgtagctgggagtgagagtatatgagaattctggaccttctgcttaatttttctctaaacctaaaacaaccattctaaaatacataatctattaatttaaataagtaaatagcaacaaaaaaagaaaatatattcttatcggcaaaaaacattagaaaatataatgaaatttatgcagcctctatttagaaaaatgtacaaaaggatacgctcataaaattttgcatatagcttcataagtttcatagtcttccaaagcctactcatgatctctccatgaatatcaggtttataatttctaaattaagatgaacaaaataggaatttctcctctttttattttctaaaattttaacttttacaattgactaagtaagtctacaacctaaaaatattgactccttttagctttaaacaaagcaattaatccctttaaagactaatttccttcaaactaaataatgctatattttcacccacaatttacccatgccatcacttaaagattatcaaatttagataataaaatttttaaaaaattaaattgctatatttaacaattctgggttactcactagatttaatctggatttagtcacgactaaatcacttctaattcactaaatacgtttcacaggtagaaaaaatatcttacctgcaaaatgggaaaagtagcagtggtgatacccattttgtgtaaagttaagagcatttcatttccactccatattttacaagctgattcataatctctttctacaagatattcagcgtttgcttctaaccaactgaaataaaataaaacaattgtgtcaaccagtatcatccttacacacactatttcagcagaacaagagaatcatcattattgtcatgcgttgatctgtatatcttgacattcttaggacatgaatgtggattaattaagacaccttttaaaaagcattcatgtctcatattgcaaaataaactttatataactgaaaagaaagcttttattcagaagaaacaaacatgcatatgatttcccacttgttttgtggattcacattgctttacttagctaatgtctcttcaactgagagccaggtcttaggtacttatcccaaatatatataaaaggaaatgcaaaacaacctaataaagaaattaaagtgttacatattaacacaaaaaagagaattactagaaaatatataaatacattcattgatatatatacacattcatacattaagtgtttgaatgcctattttattccagacattgttctgggtagtgaaaataacagcagttaaataaaataggcaaggtccttactctcatggaaattacattctactaaagggagacaggaataaacatcaaaacaaatacataaacaagaaaatgtcaggtagtcatgggatactatatggccataaaaaagaacaagaacatgtcctttacgggaacatagatggagctggagatcatatccttagcaaactaatgcaggaacagaaaatactgcatgttctcacttataagtgagagctaaatgatgagaccacatggacaagaggggaacagcacatactggggcctatcggatggtgtagcgttggagacgggaaaagatcaggaaaaataactaatgagttataaggcttaatacctgggtgatgaaataatatgtacaacaaacccccataacatgtttacctgtataacaaacctgcacatgtacccctgaacttaaaagttaaaaaaaaaagttctaataaaatgaaaaaaaaatcaggtaattatatacaaataaattatgaaaataaattagtttaatataacctagttgcaactttaattttaatgtcaagaatgctctccctgaggtgacatttattctaataactgaatgcaaaaagtatccagtcatgggagaatcagaagaaaagaaatatccaagcagaaggaacagctaggagaaaggtcctgaggtggttagcaaattttgcttgtttgaggatctgaaagaaagccaatatgatttgcagcacaatgggcaaaaatgaataatggtatgaacaatgtcagagtgataagcagaaatcagtcatcttgagtcatcataagaaatctgaatttattcaaagggcaatgggaaggcttgggttttaatttttaattttcgtgggtacatagtaggtgtatatatttatggggtacatgttttgatacaggcatgcaatatgtaataatcacatcatggaagatggggtatccatcctctcaagcattaatcctttgtgttacaaataatccaattatattcttttagttatttttaaatgtacagttaaatcattattgactatagtcacactgttgtgctatcaaatactaggccttattcattcattctatttttcttttttttgtactcattaaccaacccctcctcccctgtgatccccatctactacccttgccagcctctggtaaaccatccttctactctctatctcaatggattaaattgttttcatttttagatcccacaaataagtgagaatatgtgatatttgtctttttgtgcctggcttatttcacttaacatagtgacttccaattttatccattttgttgcaaatgacaggatctccttctgtgttatggctgaatggtactccattgtgtatatgtaaccacattttctttatccattcatctgttgatggacatttaggctgctttcaaatcttgactattgtgaatagtgctgcagcaaacatgggagtatagctatacctttgatatactgatttcctttattttgggtatatatctagcagtgggattgctggatcgtttggtagctctattttaagttttttgaggaacttccaaattgttcttcatagtggttgtcctaatttacattcccaccaacagtatacgagggttgtcttttctccacatccttgccagcatttgttattgcctgtcttttgcataaaagtcattttaactggggtgaggtgatatctcattgtagttttgatcagcagagaaatgctgatcaatgatgttgagcacttttcatatgtctgattgccatttgtatgtcttctttagagaaatgtctattcaaatcttttgtccatttttaattagattattagattttttcctacagagttgtttgagctccttatatattctggttattaatcccttgtcagatgggtagtttgcaaatattttctcccattctgtgggttgcctcttcactttgttgattgtttcctttgctgtgcagcagctttttaacttgatgtgatcccatctgtccatttttgctttggttacctgtgcttgtggggtattgctcaagaagttgttccccagaccgatgtcctggagagtttttccaatgttttctggtagtagtttcatagtttgaggttgtagatttaagtctttaatctattttgatttgatttttgttaatggtgaaagataggggtcttgttttattctcctgtagatggatatccagttttcccggcaccatttattgaagagactgtctttccctcagtgcatgttcgtggcacctgtgtcaaaaatgagttcactgtaggtgtgtggatttgtttctgagttctctattctgttccattgatctgtgtgtctgtttttatgccagtactgtgctgttttggtgggaaggttttaaatacagagttttaaataaaagacagactatctattttacatgtttaaaaaatgattctagctaccaagctagaattgattactggagaaagatgagtgaaagtagagacctgttaggaggttgttataatatccttgttgagagaagactgtaggatgatagatatgaacaatcaatgatattgaggaattggggatatactgtgcaggtggcatctataagacttactcattaattggatgaggtgaggcagtaaggatattattaaggatagtatttaacttttttacttgaggaactggtacatactgtttgcttagatgaggaagactggggagaaaacagaacacaggaagaaaagcaattctgttttagatgtaaagttgaaatgtctattttgatatacaaaaagagctataaagtagatagttggatataagaatggcattctagggagaggctgaagctagagacataggttcaggcctcaccagtactgaagattatattctaagctatgatactacaaactatttagggaaaatagaactacagaagaaactaggtcccagtaccaagtaagtcctgaggcaccccaacatttagatatcaaaaagaataagaattatcaaaagaaatgataaaaaaaaatggactgtgagaaggaggaaaatcagagatgtcacagaagctaagacaaaaatgcttttcaaagaggtagtcatcaactacccaacaccactgactggctgagataaaagaaacaataacctctgtatttggcaatatagagatcactagtgatcttgatcaaaacaatttgcgtagaattgtccagagagcaacactgctaagatcgatgagggaagaatgtcaagtgagaaaatagaattagcaactacagacaactctttcaacaagttatgctgtaaaataaaaaccacaaaaatctgcatggcaaaacaccaccagaaaagacacaaatggcaaaatggggtggaaagtatttacaactcttattgcaggcaaagattttaattccctaatatatgaatggggttctataaatcattaagaaaaagaaccacaataagaacaaaaaaaggacagagatgtcaacaggcagttgacacaaaaggaaatataaatggcctttaaagatgcttaatttcatgcatattaaggaaaatgaatattaaaactacattgggataccacttttcacctagcaggctagaagaaaacaatttccatactcttatacattgctggtagaagcatacattagcccccctgtcatccacctattgtgtaaatgttagctatatctattgaaattacaaatatgtctatgctttcacccaacaattccacttctaaaaagattcctatagatatatttgcatacaaatgaaattatgtatgttcaaagttattcattatagcagtttaagagcaaaaaactagaaacaacctcctctattaatcagaggctggttaaataaactattgcatatctatctaatggaattctagatatctattttttttttaaactgagaaagctttctaggtcttaacatggaaaggtctccaaaatacactgggaattgaaaaaagcaagttgcagaaaaatgtatgtatactatgccatcatttggaaaatagtgagggacaagaaaatatatctaatattggttcataaatgagtaatatgcattgaatgataaacttgtttaggagaacacagacattaaacagatcagggatggaactggaaggaggtttttactatacaaatttgtatacattttgtcttcaaaccatgtgactgtgtaacattcaaatttttttaaagtgtaaatgtgaaggaaacagaaaaatgctacaataaatgaaatgggattcagagttgggaagtttttttctatggtaacaagattctagatcaacaacttaatgtctaataaaagaaaaattagtgtaaattgtcataaagctagtactaaatatattattttagagtactgaaatcttgattaattaaaacccatgaaactagaatcctatttaaattggagaataaagcaataaattaaagccatgatccagaattttaaaatatattaattaaaagcacgtttagtttctggttcaatatcctagacacatccttcggggctattatgttatcctgccaaattaggaataagattcacaattattcatttttaaaaatcacttatgttcattatattcttgtgaacaagacaaaaggttggactagccttgtttttaaagcttaactggcaaggaacaattcatttcccaagaagcctagttaaccaaagtttactaactttaaatactctggcataatcaaacatatttttcatataaaggcagcacaaatacactaatagacaaatcttcttacttaatgaggctacagcacacagctcgtaggggttcatgatctttcttccttatattattgttgaccatactatctagttcatcccgagcaaaccgaagctgaacttctgttacactgtaacttgctgattcccgagcacagtcctcgatgttatgagcttcatctaaaatgacaacctgttctttcagatttaaatccatctataagataaaagaattttcttgtaaaacatttggcaaaatagatttaacaacagcaggcaagatatttcattttaaaattcacactataggccaatattgcaaatgcaattacataagcaacagagattctaggtcttaaataaaacttctgaagcactatggccaaccaaatatcagctctacattattgtgtttgccatttttttactcttaaaatactttgcaaacctatcgacagcaacaaaaatatgtcagtgagtctggatcaaggtaccacaggctacacagaaaggtataaaatcccactatgaaagtgtttccaacataattttacaaactaattataagacctttaaaaataaaataacaatataagattaaaagcataagacctttaaaagtaaaataacaatacaagattaaaagcataaaacctttaaaagtaaaataacaatacaagattaaaatgactcttaaaatactaacataatatatatgttttgttttaatctgtcctgcaatccttctccaacatgggagttggagaattgttcttctccaactcccatgtgatgctggcaggactattaacctgtgaatcaaaggacatcaccactttcacaatgggggtaaggcccaggattgtcagttaaatagagtattccatccttctgtggtcacagtgactggttcaggttcaggaacagacatgtgatccacggtaggccaaccagagtaatttggagggactaatatgtggccatgctcttttctccaggtgagctagctgcttatggttatctttgttccataagcaagagtgagaacttgcctgagaataaagccatcacaataaagagaatcaagtattttttcttaagcattttttagggtaggtttgtgtcacttgcaatagaaagagtactgactaatacaaggaactgtcacaaagcaattgtcaatgagttattttgaggaagtaagaatacacagacagctgaaaagttgagaaaaaaccatggaagagtaggaaatatattggggtttaaaagataagtaggatttggatttggacagacaaagagtggacagggcattccaaagaggtgtcatcaaaagcaaagatagagtaaagaacaaggtatcctcaagggagtatgaggtaatttttgaaggattcaaattgggcagatccaggtcagactattgagcatcttgagtgtaagcttaagaaatatgaactttatctcatgagcaaaggaagcaatagatttttaggcagataaaaggatgtaataaaagcaatatttggaaaactgacctggcattgatatgcacagtgtctcagaaggaagagatctagttaagagataaccaaataagaggtaggatagaaggggtagtaaacataatgcctattaatttggatcttaaagaaatagaaagctgagatgaattgtgcagtcagatctgaagacaggaataacaattgactatgccaaattattcactttttgtcttatgctgttaacaattgcatgtctctaaaaagaaccaggcaaacaaacacaaatgccattatctgaagttcacttctcaaagctcacaaggcataattttattcccccacataagttcttcaaaacatagttttttcagagaaatgtttctaaataattctttttgaatattcataaatgcaaagagaaatcctgctgtaatcccacttcagtcactatgttccttaaaactgcttgttattttggaaattaaaatgagtgggttgattttaacccatgttaggatatgttttcagtactctaatatgtttacacaaatttatttacataaattaaagcaaaaaaaattaaaacatctaaaagcttttacattcaacatttacatctccatgagtaggaagaaggttctcatttttacacatatactcacactttcccttatttgtgcatctagaagatagttgtagggacaaaatatgatgtcagcatcttgtattagttctcgggctgtgtaatatggacaggcctttagtttcttccccaggctgacaagttcttctatatcccaggctttgcacatcccttggaaagtctgtaatgtgtgctgatcactaattttatgaactccatgataaaaatagcaggattttccctagaaacaaatatgcataactgaaatgtgaaccaatattagcatagaaggaataaaataagcttatctcagaatttgaggaacatcattaaagccacaaggctaagattttactggctacgccaccacacctggctaattttttgtcttttttgagacaataccatagctacaatcacaacgaagtctggttgactcagacttagatagaagtccaaatcggaagagctccaaataccctaaattaacttgaaaaaaatttcttttaaatatgtttgttatgcctttttttttctgattaaactgatgttaggcatgaaatacttctgaaaggattcacaaaacaatggtatcactggttgcttccaaggatgagaattaagtgactgggcacaggagtgagagatttttctctgtagacccttttgtaccttttcaactttgagccatgtgatagtatttcttattcaaatataaataagaaggaaggaaggtaagtaggtaggttggaatgtcctaaggggaaaaaaagaaagtaagagtattcactacaaaatattcaggagtaccaaaaaaagcctaaattatccataattctattacacaaagaatgcactagaaacattttggtgtatttcatttcatatttcttctatacatgtgtatataaggatatctctacaatgtgacccaatattaaaataacaagaacaagcaaggcacgatgacaggtgtgagcactttgggaggcttaggcaaaaggactgttttaggtgaggagtttgataccagcctgggcaatgtagcaaaaccctgtctctacaaaaaataaaaaattttctaggattggtggcgtacatcaatggtcctagctactcaggaagctgaggcaggaggatcacttcagcccaggagttcgaggatgcagtgagccatgatcaagccactgcactccggcctggatgacaaaacaaagccctatctctaaatagtaataaaaacaagaacaaagcaaatgttccccaggcattgaggattattaacaattcagccacaataaacaaaaatttttataaagcatattccctttgttttcttctgtctagcgtattaaaaatcatacaaggaaaatcttgacatcactaagcatcttttcgttgctgctcatatatgtacattgaattaatgtgccatagctgatgaaccagttttcttattactgggcttatagactgttaccaatttctgctttagacataaggctgcagtgagcattcttatgctggtttctaaatattttcttagtctatatttttagaaatggcattatgggatcagacgctacaaggtatttttaagtttcttgaaaacatatagtgaaattatcctccagaaagtatatattgctttgcattacccttttcccacatccttatcaacactggtgttatcttttgttatctctatcttaaaagtaaaaaatagaatcttgttttgatttgtattttttatagtttctagcaaagtttaacatagtgttgtatgaatagtctaacaaggttcaatagtaatttgtgtttcttcttttatgttatctactaatgccctttgccattctattacctttttttttttcagagatgggagtctcactctgtcacctggggtgcagtggcacgatccaatcttggttcactgcaacctccgcctcccaggttcaagcaattcttgtgcctcagccaccaagtagctggaaccacaagtgcatcaccacatatggctccttttttgtagagacagggttttgtcatgttgctcaggctggtcttgaactcctgaactcaagcgatccgcctgcctcggcctcccaaagtgctggggattacaggcatgagccactgcactccaccccattctatcactggaaataaaaaaatttcattacaggctgggcacagtggctcatgcctataatcccaacattttgagaggccaaggccggaggactgcatgagcctaggagttcaagaccagctgggcagcacagggagactcaatctctacaaaaaaacaaaaaaaattaaaccgcagtgagcagtgaccacgccactgcactccagcctgggcaacagagtgagatcctgtctcaaaaaaaaatactcattatgtgcattaataaaaaaataaaatgtttgataaaacccagccctaacaagtgtctcatatactattaaaaatgtacaaaattagaaaagtatatatatttttagtagaagtataaaattctagtagtagaagtacataggcaatttgtcaaaaaactaccaaaatttaaaattttaccattaatgtgaatagatgtaccctgtactgttaaatagccaaaaaattgaaaattaaccaaatgtctacccataagggacatgttaaataaattatggtaaattaatacaaaaactttagcccttaaaaatgatttagatttgtctatgtgttgattaggctctctatgttaagtgagaaaaacatgttgaataacgtgtatagaatgattaaattcatgtaaattgcttttttaaagaatatgtgcacatacattatagcaaatacattttttaaacattctggtagaatagatatataaaatcttacagtagttaccttaaaggattaaggagatggaggatctagaaaaagcctctcttttcattttctaaccacatacatgtactacttctctttttcaattgtcattggaactaagtggtagaataatgggccacttttattttaattaattctactatttattttaaaacgattttgaaataaaaatatttatttttcctagtttgctatccttaacaaaaaacaaccatacataaaatatataaattatatcagggataaaagactttgaggcagctatatacatatgtgtgtgtgtgtgtgtgtgtgtgtgtgtgtgtgtgtatgtgtgtgtacatacacatacatatatacatatgggttcaagcacttctcatgcctcagcctcccaagtagctgggattacaagcacgcatcaccatgcccagctaattttttgtatttttagtagagacaggttttgccatgttggccaggccagtcttgaactcctgacctcaagtgcccacctcagcctcccagagtgctggcattacaggcatgagcatcatgcccggccaatgtattttttacaaatacataataatttccccatatatatatattcaaaatatttttgtctaataattattaaaattataaaatataaaaataattagtctaacaaggttcagcaataatttgaatttcttcttttaggttatctactaatgtcctttgccattgtattactggaaataaaagatttcattacaggctgagcgcactggctcatgcttataatcctaacactttgagaagccaaggcaggatgaaatgtctctctctttctgtgtgtgtgtgtgtgtgtgtgtgtgtgtgtgtgtgtgtgtgtgtgtaaaattaaattgtatttgtatacgtctgtataataaattaaattgtatatatatacacacacatatatatgcatatatataatctttacatgtatttttatctatgaattatccaaaaggagaatccgtgttttcaaaacatacatacatcaatacatacacaaatgtatctagatattgctagaaacaaagtaaaccataagagattcataacctataaaagaatgtcagcaaatcaaaggacaagacatgaatagctgaggaccagttctcctaaagctttgtattcagccatgttaaaggatgatacctgttagtcctccaaagtattaaaaataaaaattaggaggaaaggactcatctaactatatttatttaggccattttctacattattttcactcactttctctaacctctactgttcttattcttcatactgtgtcaacttctccctacctcaatgccatctttggattttgtttctagtgtaaccaaaatagcaatggatgaggaatcagaaaatttgggttctggtccctccttgctaattacttgtctgactgagaaaactccagggcccatttttctcatgtgactaagcatcaaaagaatatttgaaccagaaggcttgtaagattccttctgactcactgactatatcatctctaaaattccttccagctctaaaattctgtgattcaggtaaaaacgtgtcaatcatctttcatactctcagtttgatacagactgagtttaataataggacattcaccatttcttcattccaagcttcttccatacaattctgaaagcttacctttatacaaaatgatcactaaagtgcctttagaatctatgactatgagctattaagtctcattttaaccaaaaaaagatatatatctaaaataatatttcagaattgtcattcctgactctagttaaaattattttttcttaactgaaacaaaaattaacttttaacagataagtgcatacttttccagtataagggcactttagtaaaagaaacaatgaacaaaaacacatgtgccttggatcaagccaaaaaatcagaaagtttacactttaagggcagttagaatgacacccctctgcaggctgacagcaaaaccagaaaagctcatccattttagcagtgtaacacaaccctgaggaagtctgtcaattgaagtgttatcacactttaaacacttccattcaaactgtcagttatctatttatcatttcgctttggtaattcagtcaaagtaaacacagacacctatggtgactttgtaattgcccttcattacaataccaaattactaacagggcttgagaacaagaaagaggatgttcatgtatgcccgtgaggtaagcattctgaggcagaattaggtcaagacaaaccacaagcagatatcttcaattattcatattactaatattaaaaaataaaatacctgttcactttaagacaaactaaaggccaatgaaaaattcggaacattgaagtctactgaattcctttttatttttacatgattcaaacttatgagtaaagatcaataaaaacgtaaccagcactgtaggattctaggttacacaaaatgaaactgtctgccttcaatacacaatcttacactttatcattgcttttaccaatgtattttaccaatgtatgtttttggttggttggttgtttttgagacaagagccttgctctgttgcccaggctgcagtgcagtggcgcgatcttggctcactgcaacctctgcctcctgggttcaagcgattctcatgcctcagcctcccaagtagctgggattacaagcatgcgccaccacgcccagctaattttttgtatttttagtagagatgtgttttgccatgttggccaggccagtctcgaactcctgacctcaagtgcccgcctctgcctcccaaagtgctgggattacaggcatgaaccatcaggcccagccaatgtattttttacaaatacataattaatttccccaataacaagtaaaacaaaaaaagataaaaatatggtgacaatgccagcaagtcttcttgcataggctatatagccaaaaaataaatttcaagcatttgaggaattcagcagatcacttagtcactatggaaagcagtctacttatgcatgaaattcatggagttttaccataaagagctttattttattatttttgaacacctgacacttaatactttcatctctccttgaagagaagttttttaatatacagagtaaaggaatttcacaattcctcagttagttagaaataactctttggaaataaatatgactgtaggatttcaacaatgactttgattcagtaattctgtattctctcctggctcggaacaagtcactcaagttttgccattggaacaccttactacttatactttataatctcgtttgaatatctgttaaagtatcttttgaccatccctaaataaagtttaaataaattttcatctataaaagagagtattaaggaagaaaagcataaaacaaaataattcacattatatggtagggggtgatatatcaatgaaatgaaactctgggggctatagctcacagttttttgtgtagaaccaactctaataagatactagtgaaaaacaaaacaactctaaaaatatattaaaatatcattggtcacttcatagtaatcaatttatggttcactgatttgggggtataatttcatacttgcaacttcaattttagagtaaactaattatcacaccagaacataggctcccaaactaatactgccaaaagaaattatttgaaagtcatataagtctttagtaagaaagaattctctatttccaccaagcccaaattcatattattctaatttccctggaaaatttcaaaaccaccaatgacatcttttgaaagttaataatttagtataacttttaaaagaggggtttgtatttatcagaattatgaggtgggataatcattatatttctcattcaattaagaaaattcaaactttgcccagacagcctaaataaactatctgcttttgaagtttttaagtatataaagtatattaattagatctaattagactaaaccatttaaacacttctatctcctcatatgatatcatccaagtttgactatttttggtagcaggatttaaaagaagaaactaagatgtctgactacaacagaaattaatttcaaggaattaaatatcccaagctttaagaccaaatcccatactttaaaacttgactaaagattttattacaggaaaattgttttttaaaagatatcaatactagcagttaatttgattttccgaagttgattatcactaaaatgtacatataaaacacatactgagtaatttaaatattttcagccttattttttctctaacacaaaataactttactcacgtttttcccatctagcaattccatgcacttctcatttctgttgaagttaccgactacctcaggatggacacaagtatgatccctgctggaaagaatagtcattggaacccctgaatatgccgtcctccggagctctctagtaatctgagcaatctgcttgtgtgtgcgtgtcccaaaatatattttgggtatcttggatttccctgtatgatccttcttaatggtattcgatgactcttgactgtttccttgtttagtagaacaacagcacctagaacagtggccagggggctgtaagaaaggaaagaaacgataactaatatctaaactaccataaaaaacgttatcaaacctcacatggaatcagaacctgtaagtaatgaatcacaatggtcaaataaagagaaataacaagaaattatagtatctaaaacttgccattaaagaaaaaactacaatttaaaattggtcctcattctttcttttaaaagttataaatgatatttccaaatttgcattctttccaacataccactctaactctccaattccaaatgttttgagtacattttaactctcctctttcataaattataaaaatgataaaacaaagtaggaacaattttaattttttcttaggcttcatacgaacttgtgatattatagtttagagttaatagttttgttcacagcatagttcattcaaatattccttaatacaccaatgcttttgaagcacttttaaatatagtttacaaaagaatagaattatcaagttgaatctaaaggatcacttaacaacttcaaaaagagaaaattcttctttagcaaaggtacgaaaataaatgcaaaatattaatatttaataatgaaagcaggttgcttgtgtggaacaagtatatctgaaattcagttacctgtcatggagtgtaaaccaatcagtaaaattatcatccagggtagtttttcctggacaatttcacttgtaactcagtttcataactgaaatagttatataaatgtctctttaaacaaaccatatggaacatcaggaatatagtctacttaatttacctgatttttctcttctgtttccaaattctcaaatactaaaaaaaaaagtttaatgctatatattagaactcacaggttcttaataactacttccttctaagtctcaattattacaccaaatgacacagaacaaagtctcattttagagaaatagtgtaaaatggttaatttatagaagtggtcattgatggggagggaaaaaaggtaaatagcattgtaacttaaaagactgtgtgctaaagagttttaatttagtagaacaaacactctacttgactgtttttttttattattgtaatcagtaagattagccttcataaacaaatgctaagtcatagcatgttacaccacaatactggggatgaagctgtcttttagcctcaactcagtggaaaagcaagttcaaattactcccagtctcactcaaccttgtccgccattaaatattacaatacatgatagaatggatgtaaatgtgacccttctggagctgtcactcactgggataaaaggttcactgatgtgccaaataaacagtcagtcaaagcagataaagttacagccatgctggaattgttacattctcctctcaggttgccagtaacagcagatttcattacagagtgctgccacattaaatagccagttccaaatatcctgccttctatattgaataattacttattcactaaaaggataaaaagaagagttatgaatggggctcttgtcaacagtgaggcaggaaacagctgacatgtggtttatgttacatatgttgcaatatccaacaatttacggtcacagagaaaatggaatgcaaattatatcatgatatttctgactgaattctttttggcttttgcaatgatcacattaatcaattaacatacaaaaagaattaaggtaactcaattagaattaatttactttttcataccatcaattttttccctcaattatactatttctcttccttatgatacagttaaattcatgtgaatactagaatgctatggcccaatgcactgttatgtactatatagatacattctatctaagcataaaagtaatccaataaagtagctttttctcaaggctgggaaaacttactttttgatgttacacttttcaacatcaattccacttaaagctttaccatctactccctttaatttcaccttttctcttggtcaaaaaaattcaaacaataatacagaaatattttttaaaaatcaactatcccatcacgaataatttagtgtataacttactgaccttcatatatacatatctttcatatctttttttcaaatagaaagggatgctattatacagttttacaactagatactttgttttcaaagtttttaatttttaaaaggggtgaatttggcacaaataatttaatgttctacttatctttaaatgttacactagtagtggtactaacaaaagcaaaagatcaagaactagtctcagaaaacttttctcactagagtgactttagttaggacttgaaatctgttttttcactccataattcagaatattataaaccacagctaactttatattaaatgtttttgtttgtttttttaagttgtaaagtaatatgaacaaattataacatctatgaacttaagtagactcctcaagaagatggttttctttttttgtttttctttttgttttgctttttttgagacagactttcactctttttgcccaggctggagtgcaatggcatgatctcggcttaccacaactccatctcccaggttccagcaagtctcctgcctcagcctcccaagtagctgcgattacaggcgtccaccaccacgcctggctaatgttgtgtttttattagagatggggtttctccatgttggtcaagctggtctcgaactcccgaaatcaggtgatccgcctgcatcggcctcccgaagtgctgggattacaggtgtaagccaccatgcccggccaagaagatggttttcaataggtacttaggcaagtaaggtataaggtggaaattaaaagttaattcttttccctttgcattattaaacaggaattatttcttcagaagcaatcttctattaaagtttccatttaaaagattcggtacaggccgggcatggtggctcacatctgtaatcccagcactctgggaggccgaggcacgtggattgctttgggtcaggagttcaagactagcctggccaacatggtgaaaccctgtctctactgaaaaaacaaaaattagccaggcatggtggcatgtgcctctagtcccagatactcgggaggctgaggcaggtgaatcacttgaaccagggagacggaggttacagtgagccaagaccacgccactgcactccagcctgggtgacagagcaagattccatctcaaaaaataaataaataataaaagatttggtacaatcatatttgaagacagaaaaactgattgtagtaatataacaaaggcttcaaaaagtcacttataacaaaagataattacctgtaccaaaatcagcaactttcaatgctctaagaaaactagaggaaggatcctgatgccagcagtgtcaggaggtcagaatatcccccaatcaaattaccaggctaatactttatggcctctctctgaaaccctttgacccaggggtcttaaaacaattagatgaataaaattaaataattttgtatctcttattgagtatttttcctgctaacaaatgatcatgtttatctttcaaaaagacttttttattttccctttgctgtttaaattgacagagatttccttttctccaggaaactagagaataaattttataatattcactctcatccaataatatatctgaaaatcaatacataagacatggggctttccaaaatctgtaaactctaagacctgtaagtggctacacagtgccagaaccaaactctttaagaaatggcttcttctccaagctagaaactgttcagagtccttttacttcaagaaaaggcaagaaaacccaacccaagtaactgcaaaaatatactatcattaaaaaaaaaaaacaggagatacatgtggatgtgacagctataatatttccatgtgcagtagccaattgtttaaaaatacatttcaaatctacaattatcaaaactgttcttagaacatcagcaaccaaggattttcagaaaatttttcttgtgtttaataaattatattccctctcttgttgtattatatagagacatgtctacattctttcaaagatgaagagttcgaagatttgatcttgaaagaaagatgaattgctgagtccttgccactgttcctttcacaagctataattataagttcaaacggtaacataccacaatgtcaacttctaaagatttataactttctccaaactttccctaccactcacacaaaaaaatactatgcctaaatacctgaaaaatgagcatagcaattaaatatttttagaaatggaaaatgataaagaaataggaactaatttcattgccaaagaagaagttcctttgctaactgtaaatcaggagagattctcaaaggagactacaaattgaatttcaaaagcaggcaggagtacgaaaactaagtatataaagaagtagagagaaaaagagaatgaagagaaacctgtttgagtgaaataaaaggaaaactaggtcaatgaaacagtaaaaaaaaaaaatacaaaaacttgtgttcttccataactttccacatgtgcatgtattgtctttccaaccacactgcaaattccttgaagacagaaactatgtcttacatttctttatatagctcattcatcgagagtggtgttttgcacataactgtaacttagctttttttaaactgatgaattatgactaaatgtccctgaaccaaatactgtacccatgcattacaattaaatctgacagatgcttaaatgatgtcctaatttgaagtgctgcacatatcaaaaagatacttcaaaatccagattagcttttaaaggaaaaagtacaggacaattactatttttcaaggccaaaaagaaaaaccatcttatgctagtattttagtcgtgacaaacatatatcccaatattttcattagtaataatactgccatttttaagcctgtccttgtgctaaacatttttcatctaatatcccatttcattcattcattgactcaagagacattggaatccctatatatcaagccacggagaagacaatgacaaggatcacctcatcttactgacaaagagagcttcattcttaaattgttctacaaagtgtagttcttggagtttatcacaccattttcactcataaaccaaggaattgtttaaagttagttatattattttatgaatgcaattacaaaatattcctaagtatgatcttcataaaaattgttttaacttattagttgacatttaaatcaaatatgttataacaagatccatattatgtcccccaagggaaaaataaaaaacacaaactttcaattaatagactctttagagcaagagtcagcaaaagagccagacagtaaacatttcaagcttcaaaggctatatggtctcttcttccataggaagatatcttttatgatcgaaatgtagagaaggatttcctaaaacaataaaccaaaaacacaaatgagtgaaaacacagcttcattaacatgttaaacttctatttaaagatacatattccttaaagaaggaaagaaaaataggtaaaaagggggcacaggctgacagaagatacttgcagtgcttacagtcaagtgaggatcagtatctacaacatataaagaattccaataaatctatttttaaaagacaaaccctacagaaaaccaagaacaggcaaatcacagaagagaaaagctgaaaggctaataaatatctgaaaagatgtgccatctaatgtacagcttcactagtaattaggaaaatgcaaattaaaaccataattagattccatttcctatccaccagattgggtactggagaggatatgaagaaactcttattcactgctgatcgaagtataaattggcacaactacttgagagcaaattggtgatctagtgaaatcaaagatacatataccctttgacccagcatgacactgttaggtatacatgctagaaaaactcttgcacattaagacagatacaagaggaatattaattgcagcattgttttaatagtgagaaaaacaagctacatgtatcaacagaaggaatggatgagtaaattgtgggctctttccaatcaatggaataatattataatgaaaatatatgaatgacagttgtatgcatcgacatcgataaacatgaacaagcagttgaacaggctgagtatggcttaaacaaaattgtattttccccataaaattctaaataagttgatgatagaaataaaaatataaaacttcaggtagagagtgaggaatcaagactatggaagataatcttaaaagctaacaattgtcatgaaaaacatacctgaaaaatgctagaagtgctggaaaaaaaaaaaaaaacccacagtaaatatactctgttctggtttctcctcagttgtttcatacccagcagaatagctttcatcttaacacctcctcctcaaaagttttcaacctaatttattaggaaatgggttctcaaattagggtccatgggctattacagatcacccagaaactacagacacaattttgtgtgcatttttagaaagtgaacccctaactttaatcaagtgctcaaagcagattgtgactgatttgggttagggctttattccagaatttatatctggttttttaacgaaaatcaaatggaaacaacattttctttataaccaaattagccagacatagttattctgtaaaggaataaacaacagccaagagaatttcataaagtttcctccactgcttctgaactcatttctattttaatgtttgttaattacctaatattaacataaggctaaaatactcagttcactaatgtatatttctaacttcattttacagataaaaaaggaaattcagaagaattcaaattcccacaaaatacacaataaatttgtggagaagttgaaattcataaccttaaatctttaaagtgaagctttaacaggattgttttcatctaccacttaagcaaaaaagcaaaacactgccctttatttcaaaaagtcatgcatatgaagagctagtggtaaaaggccaatgaacatagaattatactacaaactttgagacataaaaaagggttttttaatctttatcaaccatttgctgttgtccaagccatctaaacaggtactgaatgcccgttgtgcaaaatctcacattagcacacactctagtaagatagcaaaagtaacataactataccttttcaactattctttttttaaaaattcaaacagtagtagtaccctactgccaccgtttcatgattagactgcacaaagcagctgtttatccactcacagcaaccagcaggtgaacctgattcaatatttatcacaggctttcatagatcactgctaaccaagcaaacgttttaattaagctggaacttgcttcaaagagctcattcaagatgtcaatcagcaggtaggggatcagatacagtgtcaggtgagagtgtgtaatacaaatccacaactttcttcatcccatcgctgtaaattagcctgctctaaagttcagactctgattgtaacagactgccagtctcctggaatgtgtaactgaagtcactcaaattctattgtgaaggttgtaagcaatatgttaaactgcagtgggctagcacattaagacagatccttttcacggttgttttttgataccataagtgtttgttaccctactctccacttactgtttactttcttgcctagtgtaaatgggaattccttaacacagttgctccagtttctgaaaagtctgtgtttcaatagagtaaatcaataagaattatcagtttaagaacaagcatatcataaagatgactgacctgctataaagcaaaaattatcctggtataatagaactttacatagatgtgattatagcaatgagtctcaaagcagtgatgagtcacaccgatcaacttcatgagaaaaacccagggtgtttataaaaaataaaaaggggaaaaagaagactcaaacgagcaaaatggggaagtgggcgggtaggcggaaaatatcttctttaaataagaatgccagctaagaattgtaaataaaatgatagaattttaaaaatcaccattttgcaactttcctgtactaactgattcaggcaagttacataaatggatgctgaaatctttcagtgaaaagttattagggaacagaatattgacaaagtctcaaaatatcaccccacagattattcattaattacaaaaggaaaatgtacctttacaatgaagagacctggcagtgacactctaaccaagtggtgaaattcagcatcaatggtattgagactaactggcttcatatgcctcctgatataagaaatatactcttgtgcccatcttcaataaaactacatgattattaaatccaaacaatcaagacatgaatcaaaaagaacctgggaatagagaaactgtggtaaaaagacatatatgtattatttagtcggtgaaaattcatccaattgtaatttatgatatgtacacttggttatagattgtatttcaaaaaggcttttaaaaaaaaccctatctcttgagattgcaggtaatttttactttctcctttatggtatttttcaaactttcttcaatgaaccttttaaaatgagaaaacaatgctatcctatcatgtcattttccacatattaaccaaaatgctataaacaaaacatatgacatagagatttgtgcttctatgggctttaaaaattaaatggttattattacatacaagtctctaaagcagcactacccaacaggattttctgtgatgacagcgtatttgatatctgcactattcaatatatttggcattagccgcatgggcacttgaaatgtaattagtacaactaactgaattttaattttaattaatcaaaaaacataaatacatgtggctagtggacagaatacatttaaagtattatcagagattctagaaaaccaatggttattgcaggtgcattgtatgtgtgagaaattctcttcgtaaattcaagttagaaaggaaaaagcaaaagtacactgtaaaaattgtgtgctcataggtaaaaatgggttctgcaggttgcagctcatgaaaactgggttcacaatttttgtagactagtaaactacttttcttaatcttttttgttctaatttttgtctgaattccaatcaaaatcccagcaagatttttttttgggtaatctaaatttaatcttgaaaataaataagtgagaataaccaaaactttttggaaaaataagatggggacaggtgtgatctctcacacctgtaatcccagcactttgggaggccaaggcaggcatatcacttgtgcttgggagttcgagaccagcctgggcaacatggcaagacctcatctctaaaaaggggggaggggggggaaagatgggcaagtagggtatatatttctatagatgtaagaatttcaaatatatgataaagatgctgtattaggcacctctatggacatgtgtccacctacttactctgaaatcatctatatcccctgctgaaaggctgaacctaatatccacattaataacacatatccaaagacactctcaggcatagcaagatcaattagtttcactttcccaagaacttgtatttggggcatttagactgagttgattaattacagaaaataggccacatcatttggtagattttaggcttccactttgagatgtcatggtaaggtcatatgaaagagtgtaagtatctagaaaaaccaatctacaaaaaataatgagaaaactttgctgagaaatgcagatgtcacaccagaggccccaaagagaacagagaagctgcctaaaaacttttcatttccaatgaggggaattatatctcctgcatgatctttcttttagcgggtttctatttcttaaaaagcagatcactcccttaaaaatctgatttaaaaatgggccaaaaatttgaatagacatttctcaaaagatatacaaatggcaaacagacatatgaaaaggtgctcaacatcactgatcatcagagaaatgcaaatccaaactacaatgagatataatttcatcccaattaaaatggcttttattggctgggcacggtggctcacacttgtaatcccagcactttgggaggccgaggggggcagatcacctgaggtcagtagttcgagaccagcctggccaacttggtgaaacccaatctctaccaaaaatacaaaaatcagccaggtgtggtggtgcacgcctgtaatcccagctactcaggaggctgaggcaggagaatcacttgaacccgggaggcagaagttgcagcgagccgagatcatgccactgcactccagcctgggcaacagagtgagaatttgtctcaaaaaaaaaaaaaaaaggcttttatccaaaacacaagcaataacaaatgctggcgaggatgtggagaaaagggaaccctcatacaccgttggtgggaatgtagattagtacaaccactatcgagaacaatttggaaattcctcaaaaaactaaaaattgaattaccatatgatccagcaatcccactgctaggtgtatatccaaaagaaagaaaatcagtatatcgaggagatatctgcactctcatgtttattgcagcattattcacaatagccaagatttggaagcaacctaagtgtccatcaacagatgaatgaatgaagagaatgtggcacatacacaatgaagtactatttagtcataaaaagaatgagatcctgtcattttcaacaacataaatggaactggaggtcattatgttaagtaaaataagccaggcacagaaagacaaactttgcatgttctcactcatttgtgagagctaaaaattaaaacaggtgaactcatggagagagagagtagaagggtggttttcagaggctgggcaaggtagtctagggaggggagagagtggagttgttaatgggaacaaaaaagtagttagaaagaataaataagacttagtatttgctagcacaacagggtgaatatagtaaaaaataatgtaattgtacatttcaaaataactaagagtataattggattatttgtaacacaaaggataaatgcttcaggtgatggatacctcatttaccctaatatgattattacacattgcatgcctgtatcaaaatgtctcatgtacttcataaatatatacacctactatgtacccaccaaaattaaaaattaaaaaaaaaaaaagcaaaccaccctgtttaaatcaggtggcatttcaaatctgtgggggaaattattcaactaatatttagatgaatgactatttggggaaaaaaattagatcctatctcccaccttacatcaaaataatttacagttgaattaaagatcagtatataagaactgaaaccacgagacttccagtctaatatggcagattaggtacacacatttgccctccttcccacctaaaacaccactaaaataaacttacttagtagctgaagttgcaaactggaggtccacaaatcatacctgcttcacaatcatgttttgaatggctacacagagttttataaatttgaactacttaaaaattatgagatgaaaatccatagtgctggtttcttctagaaaaactggttgactggccacattaggcctgtattcttacaggacagcaatccactaacattgactagattgccacatttggatgagacatatactctcaaggtatcacagtccctgccacttaaagaatgtaatcacatgcacttatacttagaccccttctttcattcatgctacctatctggtgctcatttaagttgccaaccctggttacaaaagtgtaaaaagggccaggcacagtggctcacgcctgtaatcccaacactttgggagaccgaggggagtggatcacttgaggtcaggagttcaaaatcagcctagccaacatggtgaaaccctgtctctactaaaaatacaaaaattagccaggcgtggtggcatgcacctgtaatcccaactactcgggaggctggggcaggagaatcacttgagccagggaagcggaggttgcagtgggctgagatcccgctattgcactccagcctgggcaacgaagcgagactctgtcttaaaaaaaaaaaaagaaagaaagaaagaaagtacactccacagagtgggagggggcttgagcaagaggctcaagagcactggttacaaaattttctggagtttaaatactctctagaggtttccattggttattttgttgcacactatgtaaataaacacgtggcctgtgaccagtctgattggttgtgggaggcaaccaatcagaagctgaagggaagctacagttacatcctatgcaaaggaagacatggcccatgaccagtctgattggttgtgagaggggaccaatcagaggctgaagtgaagttacagagttacaccctatgcacatgaagactggttgtgggaaggagaggtactttccattctttaacctgccattcagtagaaaggcagggtgttgcaaacagagtagcctctgatccttttgttacttgggggtggagaggtgagtttttctttttgattcagttttaggaagtcagtgtgaatcggccttaggttccctgcctccagaccctattctcctgcctcaatttcattctctttttttttcttgtattttttacctttttatttttaattttatttttttttacagacagggtctcattctgttgcccaggctggagtacagtgatataatcatagttcactgcaacgttgaactcctaggtttaagcaatcctcctgcctcagcttcccgagtagctgggactataggcacatgctaccacgcctggctactttttgcattttttgtctttttaaaatttttcttaagatacaggatctctctctctctctcgcccatgctggagtttaatggcacaattatgactcacttcattctcaaccctcaacctcctcggctcaagtgatccttccgtctcagcctcccaagtagctggggctacaggtgaatatcaccacatcaggccaccatttcattctcagcagatattgaaggctcaatgaatattactggtagaaataagcaacaaaataaataaatctcacattaactaaaactgcacatgaaaacatttgttaatgactaaaaattgtcagaagaatcagtaatagccaccagtaaaagaactaaatgacagaagacataataaaaacctcgtgtgactggtttttgatgtgaaaaatataaattaatgaatgaaatgtcttccctataagcgttacataaaattagtaaatgacaaaaaataaaagacaataaaagaagaagaaaagctatttgacgaatagactgataatgggattctcatcatttttttctgtaaaatctttgatgttactagaatttttataagcaaatatcacttttataaaaacaattacattttttaaaaacatacacagaaaagaaaacaatatacagggtagagatactaccaaaaggagaagtaactagtttttcagggcttgcagaatcattttactcaatttgataagatttttgtcgtactaatagatccagttatgtgccctctgggaaaaatgcaccaaaaagcgccaaggaagaaagggaactggacagactatccagtaaggccagtcaaatcaatcatacaggttaatgagatgactgaataggaaaacagactgctctcacatctactattgttcagaatattagattaaggaaagagctgagacaaggtttccttgtggaaggacaggagaaaacataacatggttatagctaaggaaaagaatcaatagaaaggaggaaaaataattgacaaacatccagtgatgtgtaaatgtgtagtgggatgtgaatggggaaaagtttgtgtttaaaaaaaaaaaggccctgtatgactaatatggggaccaacaagttttcagtttaaaggtgggacggttccaaatgacaacgaagtcccatgtgtagtggtgctgttgaattaatggctaaattaggtcgtaagtttcaagaaggctgaggaactatggtcaaaatagcagatcatcaacacagatcatgaagtaccccaggatggtgactgcttctcctactccagattcactgagtaacaaggagaatctgacatttttactgccctgatgtgtgcctacttcactaaacctcaaaagcatctttctttaaaagattcatacatgtttccaatgctgttgtcaatatcaattatcttctgaatgaaacgttaaccttgcacaagtaatgcaacatctggcttatagtagttttcacttagaacaatgcatatatttgtttaagttttccaaaaggccaacatttaaagaaacaataaatgtccttaaaaatatgattgtatggccttctgcttttagccatacgaaaaaacagaaatcttatcttgcaccataaactactaacaaattggacaagatatatgaaacagtacttttcagacactgaattgtgatctcagagaaaaggaaacaaagaggtgataactacattactttacttctacagatgaaaacacaataactgaaaagaaaaatccactagtaagatttaacaccaaattagaaatagcagaagagatcaaggagcttgacaaatcggcaatagaaggtagacaaaatgaagcacaaagaagaaaaaatagcttaaaaaatgaacatatagtcagtgatgtataatatcaagctgtctaatatacacataattgaagtctgaaaggaaaaaaatgagtacttaagaaaatatttttaaatggctcaaattgttcataatttgatgaaaactataaaaccatagatccaaaaagctcaatgaccccaagcacacaataaacacacacacacacacacacacacacacacacacacacaccttagttgaattgctgaaagcagagataaaaatagaatttttttttttgagacggagtttcgcagttgttgcccaaagtgatctcagctcactgcaacctccgcctcctgggttcaagtgattctcctgcctcagactcctgagcagcagagattacaggcatgtgccgccgcacctgcctaattttttgtatttttagtagacacagggtgtcaccatgttagccaggctggtctcaaactcctgacctcaggtgatccacccgcctcagcctcccaaagtgctgggattacaggcatgagccaccatgcccggcctaagatagaatttttaaagcagccacagattactctatagaaactatgtaagacaagccaagggcagaatatcttttaagtgctgaaagaaagaaaatgtgaacctaaacttcaatacccagtgaaaatgtgtttcaaaacaaagcgacggttcctatcaataacccaatgaagtttcttgcagaaatagaaaataccatcctaaaattcacatggattctcaaggaaccccgaataaccacaataatcttgaaaaagaacaaaactggaggtctcacattttctgatttctaaacttactacaaagctacagtaagaaaaacagcatggtactggcataaaaacagaaatatagaccaatggaacagaatagaaattccaaaagcaaacccccacatatatggtcaaataattttcagcagcctatcaagaccattcaatgggaaaagaacagttttttcaacaaatggtgcagggaaacctggatatctacacacaaacaatgaagttgcaccattataatatatggaaaaattaactctacatggatcaaaaccttaaatataaaagctaaaaccataaaacttttccaaaagcactggtgataaaaaatggacttcatgagataaattggactcatgaaaattaaaaacgtttatgtatcatagaccaccatcaacagagtaaaaatgcaacacaccaaatgggagaaaatatttacaaatcatgtatccaataaggtattaatatctggaatacataaagaacttccaccaactcaacaacgacaaaagcaatccaattccaaaatggacaaaggcaacatcatactgaatgagcaaaagctagaagcatttcccctgaaaaccagcacaagaaaaggaagcccggccgggtgcagtggctcacgcctgtaatcccaacactttgggaggctgaggcaggcggatcgcaaggtcaggagatcgagaccatcctagctaacatggtgaaatcccgtctctactaaaaatacaaaaaattagctgggcaaggtggcgggcacctgtagtctcagctactagggaggctgaggcaggagaatggcgtgaacctgggaggcggagcttgcagtgacccaagattgtgccactgcactccagcctgggcgacagagcaagactctgtctcaaaacgaaaaaaaaaagaaaagaaaagaaaagaaaaggaagccctctctcaccactcttattaaacatattattggaagtcctggccagggcaatctgacaagagaaagaaataaagggcatccaaataggaagagaggaagtcaaactatccctctttgcagatgacatgatcctatatctagaaaactccacagtctcagcccaaaacctccttaagctgataaacaacttgtcaggatactaaatcaatatgcaaaatttactgacattccaattcaccatcaactgtcaagctgagagccaaatcaggaatgcaatcccattcacaattgccacaaataaataaataaataaataaataaataaataaataaataaataaaataactgggaatacaactaaccaggtaggtgaaagatctctacaaagggaactacaaagcactgcttgaagaaatcagagatttcttacaaacaaatgaaaaaaccttccatgttcatggataggaataatcagtatcattaaaaaggtcatactgcccaaagcaatttacagattcaatgctattcctattaaactaccactgacattcttcagagaactaggaaaaactcttttaaaactcatatggaaccaaaaaagagcccaaaaagccaaggcaaccctaagcaaaaagaacaaagctggaggcatcgcactacccaacttcaaactatactacgtggctacagtaatcaaaacatcatggtactggtacaaaaacagatacatagaccaatgaaacagaatagagagcccagaaataaggtcacacctacaactatctgatcttgaacaaacctaccaaaaacaagcaatggggaaaggattccctattcagtaaatggtgctgggataactcgctaggcatatgtagaagattgaaactggaccccttccttacaccgtattcaaaaattaagatagattaaagacttaaatgtaaaacaaaaactataaaaaccctggaagacaacctaggcaataccattctggacataggaacaggcaaagatttcatgatgaagacaacagaagcaattgcaacaaaagcaaaaattgacaaatgacacccaataaaattaaagagttaatgcacagcaaacgaaactatcaacaaagtaaacagacaacctacagaatgggagaaaattttttgcaaactatgcatctgacaaaggtctaatatccagcttccataaggaacttaaatttacaaaggaaaaacaacctcattaaaaagtgggcaaaggacatgaatggacacttttcaaaagaagatatatatgcagccaacaatcctatggaaaaaagctaacattactgatcattagagaaatgcaaatcaaaaccaccacaatgagataccatctcacaccagtcagaatggctattattaaaaagtaaaaaaaaaaaaaaaaaaaaaaaaaacagatgccggtgaggttgcagagaaaaaggaaaaaggaacacttgcacactactggtaagaatgtaaattagttcaaccattgtggaagacagtagacagtgtggcaattcctcaaagacctaaaaacagaaacaccatttgacccagcaatcccattactgggtatatacccaaagaaatataaattgttctattataaagacacatgcacacgtatgttcattgaagcactatgcacaatagcaaagacatggaatcaacctaaatgctaatcaatggtagactagattttaaaaatgtggtacatatacactgtggaatactatgtagccataaaaaaaatgagactgtgtcctttacagaaacttagatagagctggagaccattatccttagcaaactaatgcaggaacagaaaaccaaatactgcatgttctcacttataagtaggagctaaatcatgagaacatatggaaacataaaggggaaaaacacacaatggggcctatcagagggtagagggtgggagcagggagaggatcagaaaaataactaatgggtactaggcttaatacctgggtgacaaaataatctgtacaacaaaccactaccacacaagtttacctatataacaaacctgagcatgtacccctgaacttaaaataaaaattaaatttaaaaaaaatggggctgggagtggtggcttacacctgtaatctcagtactttgagaggtaaggcaggaggatcacttgagaccagaagttcaaggctagcctggccaacatggtgaaaccccatctctattaaaaatacaaaaaattagccaggcgtgggggcacacacctgtaatcccagctattcgggaggctgaggtgggaggactgcttgatcctgggaggcggacactgcagtcagctgagatagtgccactgcactccggcctgggcgacagagtgaagccctgtctcaaaaaagggcaaaggacttgaatagacatttctccaaagaaaatacacaaatggctaataagcagaagaaaagatgctcaacatcactaatcattagggaaatgcaaatcaaaaacacaagataccacttcacacccttaaaaatggctattctttaaaaaggacaacaaaacagataatgaggttggcaaagatgtggagaaactggaacccctgtgcattgctgatggaactgtaaaatggtacagccactgtgaaaaacagcttggcagttcctcaaaaacttaaatatagaattaccatatggtccagaaattccactcttaggtgtatacccaaacgaatgaaaacagagactcaaacagatacgtacaccaatgttcacagcagcattattcaaaatagcaaaaagatggaaacaacccagatgtccactggcagatgaacggacaaacaaaatgtggtatatccatacaatggaatattattcagccataaaaagaaataaaattctgacacatactacatggtggatgaccttgaaaacattatgctgagtaaaataagccagacacaaaaggacaaatattgcatgattccacttacatgaggtatctagagtagtcaaattcatagagacggaaaggagaacggcatttttcctggggctggacaatagggaaatacagagatattgtttcatgggtatggtgtttcagtttggaaagatgaaaaggttctggcactagataatagtatataaatatgcataataccactgaatttacacttaaaaacagataaatggtaaattttatgttatatatattttaccattaaaaacatgaaggtaagaaaaaaagctgaaaaaatatttgcaatgcaaatgttaaataaagctctttaagctaatagaaaagttacacaatacagaaacttggacctacaaaatgaagggcaccagaagtgaaaaactggagggttaagaaagaaattattttcctcatttgtaaatttgtacatagctgatgatttaaactaaaaataacaaaacactgtgagggctatgacaaatgtagaagtaaaatatttgacaaaaatggcacaaaacatgggagagtagacacggaagtatattggcagaaggttcttacacattatttgtgagttgaaatattatttgaaggtacactgtgataagtttaagatgcaaagtatgaagcaactcacaaaaataaaactaagaggtatacttaagaagacagtggtgaaggtaaagtagaatcctaaaacatgtttaattaattcaaagaagacagaaaaggggaataaagaaaagttggaacaaacagaaaacaaatagtaaccacagtgataattacactgaatgtaaatagtataagtgttccaattaaaaagaagaggttgtcagattggataaataaagaagacaattatttataagaaacttatcttaaatctaaagacacaaataggttaaaaataaaaggatgaaaaatatatactatggaaacattaatcctaagaaagctggagtggctatatcaatgttagccaaaatagatctcagaacaaagacatttcataatgacagatgggttaatacatcaagaagacataataatcttaaatgtgtatacagctaataacagaccatgaaaacccatgaagcaaaaactggtagaattgaaagaaaaggcaaatccacaattataggacccttacagtattctctaattaatttataagtagaccaaaaaaaaccagcaaggatacagaagatcttagcaagataatcaacaaacttgacctaactgatttttataaatgaatacccatactttccaaaaactcacagagcatttgccaagacagatcgtcaaatttaaaagaactgaaatcatatagaatctattctctaaccacacaaaaataaattagaactcagtaagagaaaaatatctaggaaaaaacacctagttagtgtttatttagacttctaaataaatcttgggtcagagaagaaatcacaagggaaatcagaaaaaaatgtaacaacatcaaaatttgtgggacacagataaagaagtgcttagagggaaatgtatagctttcattggtgttttatttaggaaaaaaaaaggtccaaaatcagttatcaactatttaagtttcaatctttttttttttctttttttttgagacggagtttcgctcttgttgcccaggcttgagtgcaatggcacgatctcagctcactgcaggctccgcctcctgggttcaagcaattctcctgcctcagcctcccgagtagctgggattacaggcgcccaccaccatgcctggctaattgtttgtatttataatagagacagggttttgccacgttggccagcctggtctcaaactcctggcctcaggtgatacgctcgcctcagcctcccaaagtgctgggattacaggggtaagccaccatgcctggccaagtttcaatcttatgaagctagcagaagagaaaattacatccaaagaaagtaaaacaatggtaattaaaaaaaaaaaaagcagaaaccaacaaaatagaaaatggaaaaacagaaagtcaacaaaaactttttaaaagatcaataaaatggataaacctctactacctattacagattgagcaaaatgaattctagattaagcaaaaaaaaggagatagacacaaattcacaaattatgaatatcagaaatgaaagagggcatatcactacaaatcctacagacacttaaagaaataagagaatattttgaacattatgccaataaattcaaaaacttgaatggacaaatttattgaaagatactaattactaaaactgactcagaaacagaaaatgtgaatactcctatactcatttttaaaattaaatttaaaagtaaaagtcttcccaaaaataacacataagggcaagatggcttccctggtgaattctatcaaaaatttaaggaagaagtaatatcaatacttcccaactcattttataaagccaacattaccttgatatcaaagccagataaagacattacagaaaactatagaccaatattcttatgaacatagatggaaagaatccttaacaaaatttagcaagtcaaatctaacaattatataaaatgggtcctataccatgatcaagtgggttttattccactaatttacagtcaggccaacattcaaaaactaatcaatgtaatttaccatatcaacaggatataggagaaaaaacatataatcctaccaaggaatgcagtaaaactttaaatataaaatccaacatccactcattataaaaatgttcagccaactagcgatagaaggaaacttctttagcctgacaaagggcatagacagaacacctagcacaaatgtcatacagaacagtgagggaccagaatgttttccaccacaaggttgtgaacaaggcaagggtatccactctcatcactctaattcagccttgtactgcatgaaaggtaaacactgtaaaggaagaagtaaaacagtatttactagagaatgaaacatgcaactttgggtacttagaaagtcctaaagaaactccaaaaatatcaactagaaccaataagtgatataacaagttgcaggttacagggtaaatatacaaaaatgaattctacttctataatagtaatgaataactggaaggaaattataagtggaatcatacaatatctgtccttttatgactggcttattttacttcacataatgtcttcaagtttcatctatgttgtagtacatgtcagaatttccttccttttaaaggctcaataatattccattgtatgtatacaccacattttgtttattcgtttatttatcaatggacattttggttgtttccaccttttggctattgtgaataacactcctatgaacactggtgtacaagtatctgagtacctgctttcaattcttttggatatttgcctagaaatgttatttctggaccatatggtaattctgtttttaactttcagaggaatcaggaacaaggtttttcagttaaacatacagaaaggaagaaaattagaatgggccctctggtactggaatggaactggatgtattggtataaacactcataattttcagtgtacagacagacagatacagaaaaaatatagacataaatgtatatgtctatgagtctgggtttgtgtacacaatacattgtgtatattctctagctgtctgctgaaagggcctggagcagcaactccaacagcaatgagcaaaactaactcccagaacacagcgttcaaatgttatttttcactaaatggaaccagggttccttggagaaatgtctgaatccgagactagggcagggaaaatataaggtgagcctggaacactatcttttgccaaaaaataaggaagcgttccaagaatgattgatatatgtcagaaagacacaagcaacttaactggtttcccacttgagtaccaaaacaaatcatataataattataactcaccgaataaaatggaaaatcacaagtccataaagatataaataaaatgagtaaactgaatttttgtaaggacatgttatttatataatttcagagttcttccccataaagtcctcttttataaaggcaaaaagataactgtaaagttatattttttacctagcagatatcatattaatcaagttatcaatcattaatgagaaaaaatgaaactgcgtgccaccttataagatgcaatgagcagaaggcatcacttctgtgacattcctgccaaagataaataacctcagtctaatgagaaaacccaaattaagagacattctagataagctgtaatattctgaagtgtcaaaatcatgacagtcaaggaaagactgaagaagtgttccagactgaagaagttactaaagtgataactaaatgcaatgcatggttctgactggattcttttgcttttataaaagcgttattaagacaactgctaaaatttaaaccggttctgagtattagatggcaacaatgaatcaattttaacttcctgattcttatggttatattgtgattatgtataagaatgtctttgcttataagacatagacactaaagtatttcagggtgagggaacatcagggcaacaacatactcttaaatggctcaataaaaaaagatatttggattgtacttccaatttctctataattttgtgacagccaaacttttaaaaagctaaaataaccgaaagataaatttactgggcagacagttggtcaattaacgaagtagttttcaaaggtaaagttatctttccacacccagtatccatgaatgaaaacgttctacatgacaattgcagatactatcaccactgaatagctacactcatgtcggatgggttgctatacatatttatttcattaatgtatctacacatcaagaaaacttagaggagtggctgaattttgtcaactttctctgaaatattcaccaagttcactcaatatgataaagaagatttgaaacttttgagaattaaacatttccaccatagagaatactatgttttctccaagctctcaaaaaattataattactgggccaggcacagtggttcactcctgtaatcccagcactttgggaggccaaggcaagcggatcatttgaggttgggagttcgaaacatgcctggccaacaaggcgaaaccctgtctctactaaaaataaaagaaattagccaggcatggtggcaggcacctgtaatcccagctactcgagcggctgaggcaggagaattgcttgaacccaggaggtggaggttgcagtgagccaaaactgcaccactgcactccagcctgggtgacaaagcaagactccacctcaaaaaaaaaaaaaaaagccataattattggagctgaaggacatactcaagcaattagtcatccattctatcatcctacccctaggcaaatttgcagacaaggcaagagattcacactaactccactaacctctggcctaacttaaccaagattacaatagtatagaacgggctggcaaactttttctctaaaaggccagagattttcctgctggctgaacatgaaaagaaagaaaagaaaaatacataaatagacagagtatatattttaggttttgtgagccatatggtctctgtcacaactactcaactttactgttataacgcaaaagttccacagacaatatgtataaacaaatgtaaaatgcgttcaaaaaaactttatttataaaagcaggcagcaggctgtattctgcccatgggtcatagtttgccaaccactggcataggaaaaaagattacgacaaaaaagtatccatcaaaatagacctgctaaattttactatgaccgtgatatattaggtgaaaaataaaagctatatactataatcctaattttgtgtgtggggagggagtatatatgtaatatatgtgtaatatatgtcatatatactacataacaaatatatgtaatatatactacagtatcaacccctttacaggggttgagctctgtacaacacctgattgcaggagtgagccaccacgctcggcccaataattacgatttttttgagagcctggagaaaacatagtagtgttctctatggtggaaatgtttacatatatactcagttgatactgggtatatatgtaatatatactacgtaacaaaaatggcaacaaattctacttatctttgtatataagctccctttcaaggttactttgtagctcttcctaccaagatgtgagctttaccccttgagtctggatttggtcatgtgatttgcttttggtgactggaacattagcaaacctgacacaaacagactcaaaaggcatttgtacactggggcttgttctcttgctgctcttggaaccctgaggccaccatatacataaaccagaattagcctgctagatgatgagagagacccacctcatggtcccagctgactaccaatcaactccctgaagcagggctgccttgctgacttacagctgacctgcagttgaccacagacacatgagtaggccacctgagatcagcagaagaaatgcccagctgagcccaccctaaattgctgacccccacaacagtaagctaaataaatggttggtttgttacagcaacagataacattgcatgtgtgtgtgcacgcacatgtgcgcacttaagaatagacagcaggcagaatatcaggggttgatattgaggagacagtttaattaaggattaatgttaataatttaagtacacattttggtggttcccaaattttctcttagatgatgcttttatattcagaaaaaagttatttagaaatataaaatttaattcaatataaaagagtatttttcattatttccactaaatattgaaagtctaaaaatatggacatcttgacctgatgtatttaaatgaactgatagattttactttctaacagagagtttggagataaatagttacaggtacataggaaactaagcaaaggacaagacaactactagcaccaaaaaaaataaatactggtttggggaaagaactgtaataagtttaaatatttatagaattataacaatacaaataccaaatgctggcaggctgaagggtagaagtaatgagaaaggagaaaagaataggaggaagacaacagaaagtatctaaaaccgaaaactcaagagaaaagcaaaatatgcatgctacttcaaaaactatcagaatacaaaggataaataattgaaaattatttacttcagatagtgggaattggtgaataatagaattagggcaggggtctactgcttttctgtttgaagccaagtggaattctttgacatattttttcacacatactgttaaaaaaaaaaaattaaagagaaaaaaaagtccaggaaccaatccaagtacatataacaatttagtacatgataacagcaaaacttcaaaactggaaaaatgattaagtgacactgggacaactgatcaactatttgggaaaatatgcaattagagcctgacctcatacatgcatgaaaataaatcccataaacaagagagttaaatgcacaaacaaaactgtaaaagaactattaaaaatatccttataaatttatagaaacggatctagaaagatcctcatgaaagtgttcatggtgtttccttctggaaagcagaaagggagatggggttaacataagggagaacattttaatttttattctgtattggtttttataatgttaaaggtttttcaaaaaatgttattactcttttttttttttttttttttttgagacaggttttgctctgtcacccaagctggaatgcagtggcatgatcacagctcactttaacctctacctcccgggctcaagcaatcctcctgcctcagcctcctggtagctgggaccacaggcatgagccaccacaccaagctaattttgtttgtttgttttttgtagagacagggtcttgctatgttgcccaggctgatctcaaactcctgggctcaagtgatccacctacctcagcctccccaagtgctgggattacaggcataagccatcatgcctggccaaaaactatttttaaatctgcattaagtcacctgtatttaacaatactgtcataccctcttaggtataaggatctgagtaaaaattgtaagctacaagaaacagtggtgaatcatacatctacttaactatggccatttttttcattcatttattcaacaaataatacaagtagctactaggtgcaggctctgtgccagatgctggttataaaaaactgaaaaaaagagacattacacttgtccttatggtcagtctggtaatgagacaaacaaaacaaaaaacagttaaacctacaaataaataaataattataaatttgggtaagcattgtaaatgcttagatttggtgttgagacactaaaaaagggacgaatcttgaataaataacctgcatggtaatgcatataatatgacctgtaacagtataaaaatgaactgtcatcaaaaagtcatctggaagagtttattcagagacagaatagtgaggtggtttagaggatcaattccagagccagactgcctgggttttaatccagcttctactcaccaggtttgtgacatgaacaagttattcaaatactctgtggctcagtttcctcagctataattgcggaaaatattaataccttcctgatacggttgttataaagattgagttaaattcttttattttgaaaactgtcaaacccaaagaaaagttaaaagaacatgacaataagcatcaactcacatgaacctgtatttgccaggtgaattaatatttctaaagtgcttagcagagtgtctggcacataacacagtaagcaccagtatcagcatatatatgcagttatgttaaatagctattttaaataaaagtaaattaaaaccataaagtaaaagaaagaagggtaggaaggaaggaaataaaaatggggtatgggaggaagaaaaaggaagaaaaatagcctaaggatcgccccagtgttaacactttgtaagaaggtcaacagcgcactctgctggacccaagtgtcttccacacaccaggcccaagttatgaattaaaataatatgctactgctacattaaatcaaatataattactttaattaaagtatataaagaatgttagcatttatttaatgaataaataaaaagcaggtataagcataagaatatatctgaagacaaccctggctattgtgaggatttactaaaaaaagaacagaatataaataaatctagagaaaatgattatgaatgatagaacaaagtaatatcaaaacgttaacatactattctaaaaaacaatgtttttcttaactatattttgaccatgtggagacagatgcttcactagaactttgacatatgaattgtcagattaagaaaataaatctgaactgtaaggaaagggatcaagcaggggacaccagaaagttaattatataagaaaaggtactgacactatcttccgacttgaaaagagagttaggagactagaaatgatagaaaaataaagagacaacaatctacttctccaatccactaggtggaaactaaatgattttcataaaaactaagaaaatttgaagaacctaaaaagtttaatgtcaaattcaggggaaaacagaaatcatcaaactaatttaccatttaatttatggaagaaggtttgtcaaaagtaatgcaactgcagatttgaaaaacgtgaagactaagacacacctttgcagggatgagaattaaaccattaatttatgaatccaaataaatatttctatttaaaaaatactgtactccctagtatcatataataaaaagcaagataggaaaagcgtccttagaatttaaaggtgttagaattcaattagatataacgtatctcctgacctcgtgatccgcccgcctcagcctcccaaagtgctgggattataggagtgagccaccatcctggctaacacggtgaaaccctgtctctactaaaatataaaaaattagctgggtgtggtgacgggcgcctgtagtcccagctacttgggaggctgaggcaggagaacggtgtgaacccaggaggcggaacttgcagtgagccgatcgcgccactgcactccagcctgggcgacagagcgagactccctctcaaaaaataaataaataaataaataaataaataaataaataaataaataaagcatcattaaatctagtctcccattctttttccttccatatgaaggaactggttttcacaaaaaagttacttacccaagtctatcaatttaccttattcaagattattacaaggtctagattaaaatacaacagataaaatgtgaggcattttggtctgaagaaaaaagcaaaaataaaaaaatataaaaaaaagtgaggcatatgatctgtcagcataagaaaagttctaatatatggactacttttttttcaattactttatccaaaagttttggcaataaactcatttcaaaagctgctgtataataaatattaaaacttacgacattaatacacatgaaactatttttcttctacttttcatgaaaccacctatcccaaaatctacagaaaatacttttatgatttataataagtcactttgcaaagactaagaaatgttacagcagaaaccaaagtaatttcctacaaggaaaaatatttactcccctatgacacccaaaaatcccattttttaaataaattacctctactcatatccccattattttttcttatattacattcttggaaataattagtccttgttctctgaaaacctagatgtattatttaatgctagaaatccatgagaaatttactaaaaatttacttaacatacaaaaaggagaaacattcatgctcactaaaactatacattttataataattatatttctattataagtacttatcctatttttatgttaggaagaaaaaaataaagttgaaaatacaaatcattttacctatgtatttttgggtttttttttcccataacctttcagaaagcacataaaattactttatacgtcatgtttttcatcatagactaccatgaaaagaaacaaatattagagctcaaccatatgttctttgcattgcaaaagtgctttgatgtctgttaaatttactttatgcatgtttaattagtatgacatatatctcttacatcttcttgcaaacaaaaattcagtgtcacactagtgaaatgttatcatttgagggactagatttaattgagagatttaacttgttcaagaagttttcagacttatgagaaattgtcagaggcctatatcttaatgttatgagtaataaatcacccacttatgaaaaattattccatttctagagatatgtagagttataccacctaaagccaaggaagaaaatatgcaatttctagcttaaaaataaaacagatataaagatacagatatacaattatagatacagctatattttaccaatgagcagaccataatcaatgatcaacatatatcagcatactacataaccaaaaggagaaatcaatcaaagcattaggcttaaaattaaggtactcaaccaagggcacagtagatgtgcttatggtcaagcggtttagactcaaaagatttcagccataaacatcttcaacagatatcaaaagaatttttggccaggttccgtggctcacgcctgtaatcccagcactttgggaggccgaggcaaacagatcacccgaggtcaggcgttcaaggccagcctggccaacatggtgaagcctcatctttactaaaaatacaaaaatgagctgggcgtggtgtcaggtgctacttgagaagctactcaagaggctgatttaggagaatcacttgaacccaggaggcagaagttgcagtgagccgagatcgcccactgcactccatcctgggtgacaggggagactccgtctcaaaaaaaaaaaaaaaaaaaagaaaaggaattttctactaaactctaaacctaactcctcaaaatttataatgttgatcagtattatcaacaataacattaataatagctttcagcagcatttaaaaataagaactacaaggccaggtgcagtagctcacacctataatcctggcattttgggaggccaaggcaggtggatcgcttaagcccaggagtttgagagcagcttaggcaacatagcgaaaccttgtctctaaaaaagttaaccaaataaataaaatgaaaataagaactacatattactccaagcaacctacagattcaatgtaatccctatcaaaataccaataacattctttacaggaatagaaagaacaatcctaagattcatatggaaccacaaagaccctgaatagccaaagtaatagtatgcaaaaagaaaactgtaggcaccacgctatgtactacacaaagctatagtaaccaaaacagaatggtattagtataaaaatagacacatagaccaatggaacagaatagagaaccgagaagtaaatccaggtatttacagttgactgattttcaacaaagatgccaagaacacatatcggggaaaggactccctcttcaataaatggtgctgagaacactggatgtccatatgcaaaaggaaaaaactagatccctctcaccatctacaaaaaccaactcaaaatagattaaagacttaaacataagacccaaaactataagactactagaagaaaacatagggcaaaagcttcaggacactgatctaggcagattttatgggtaagaattcaaaagtacaggcaacaaaaacaaaaatagacaaataggacagtatcaaactaaaaagcttctgcacagcaaaggaaacaacagagtatagagacaacctgtagaatgggagaaaatatttccaaactattcatctgagaagggactactatccagaatatacaaggaactcaacagcaaaaaaaaaaaaatctgattttaaaataggcaaagggtgtgaataaacatttctcaaaagatacataaagccaacaagaacatgaaaaaatgctgaacatcactaatcatcagggaaatataaatcaaaagcacaataagatatcatctcactcagttagaatggcttactatcgaaaagacaaaaaaaaataacaaatgttagtgacgatgtggagaagaaactcatatactattagtggaaatgtaaattagtacagacattacggaaaacagcaatggaggcttctcaaaaacctaaaaatattactaccatataatcatataatccagcaatcctactactatttatccaaaggaaagaaaatctagagtacagtagcatgatcatatctcaccacagtctgaaactcctagagtcaagtgatcgcccatgcctcagcctcccaagtagctaggactgcaggcacgtaccaccacgcctggctaatttttttaaaaattttgtacagatggggttctcgctatgttgccggggctggtctcaaactcctggcctgagtgattctcctacctgagccttccaaagtgttgggattactggtgtgagccaccacacccagccaacaccatgtttattgcagcgctattcataatagacaaggagttggcatcaacctaaatgtccatcaacagatgaatggataaagaaaatgtgacacatatacacaatggaatattattcagccatagaaaaatattgaaaccttgttatttgcagcaacatgggtaagcctggaagatattaagtgaaataagtcaggcataggcaggtaagtactgtatgttcttactcatatgtaggagctaaaaaaaatgagctcatagaagtagagtaaattgtggttatcagaggttaggaaggggtgaggggaggggaggataaggagaggtgggtttacaaattcataactacagctagattggagaaacaggaggaataagttctggtattctatagcactctagggtaaatatggttaacaataatttcttacatattttcaaaaagctgtaagagagaattctgaatattcgcaacacaaagaaatgacaaatgtttgaggcgatggatatgttaattactctgatttgatcattacacatcatatacatgtatgaaaattatcacactgaatcccataagtatgtataattattatgtgtcaacaaaaataaacaaaaaataaagatcagaactacaaatatgtaatattattagtcggtattatatagaatcttttatcagcagcagctaaaggtaagaactacaaatatgtatccatctgctgctgttactactactacagctgctgctacttctactaccacttggcgcttaaactctaaggtatgccagatactctcagcactgtatagatatcaacttgtttaatcctcctaacggccccgtgagataggtactattactaaccccatttaacaaatagctaaacataataccaagagtttaaaaaatcaaggttatacagttaataaagagtagagctatgattaaaatccaagcagtctcaagatatgaaaataacctaagtgtctgtcaatggatgaataaagaaaatgtggtgtgtatgtgtatgtcaatggaatattagccctaaaaaagatcctgctatttgtgacaacatggatgaacctggagggaggacattatgcaaagtgaaatatgtcagatgtagaaggaaaaatactacatgatctcacttatacgtggaatctaaaaaagtcaaatacatagaaacagaaatcagaacaatggttactggggcagggaggtgggggatttgaggagatgttgatcaaagagtaaaaagttgaatctacataggatgaatcaagtctagagatctaatgaacagcatcatgacaacagttaataatactatattctaggctggatatttcgatattggctttaaaattttcaggtgttctcaacacacacacacacacaaaaggtaactatgtaaggagatgaatatattaattagcttgtgatatgatttggaagtgtgtcccctccaactctcatgctgaaatgtgatcccccaagttggaggtggggcctagtgtaaagtgcttgggtcatcaatggctggtgccctcctcacagtaatgagttgagttcttgctctgaggtcacacgagatctggttatttaaaacagtgtggaacctcctctgctctctcctctgtcctctctttccatgtgacaagtttgctctctctttgtcttctggcatgcttgtaagcttcttgaggccctcaccagaagcagatgctgacaccatgcttcctgcacagcctacagaactgtgagtgaaaataaacctcttttctttataaattgcccagcctctggtattgctttataacaattcaaacagactatcacagcttggctgtagtaataatttcactatgtatatatatattaaaacatcatgttttacacctaaaatatatataatttttattttatgtatttattttttatttttttttagagacagggtctcgctctgtcacccagactggagtacagtggttcaatcatagttcaatacagcctcaatcttctggctcaagggatccccctccctcagcctcctgagtagctaggactacaagtacacaccaccacacacagctattttttttcttctattctttataaagacagggtctcgttatgttgcccaggttggtcttgaactcctgacctcaagcaatcctctcaccttggcctcccaaagtgctgagattataggcatgagccatgatgcctggcccaatctttatttaaaaattaagatcaggcagtatgtgtccaaagtccattctcttaaccaataaaaacaaaacaagccaggtgcagtgattcatgcctataatcccaaaactctgggaggcccaggcaagaggatcactggaggccatgagtttgagaccaacctgggcaacacagtgagacctcatctctacaaaaaataaaaataaaaaattagctgggcatggtgttgcacagctgtagtccttgctattcaggaggctggggttggaggatcacttgagcctgggattttgaggttacagtgggctatgatcacaccactgcgttacaacatgggcaacacattgagaccctgtgtctacaaataaagcaaacaaaaacaattcccaagaaaaaaaaatcttaatcacaggtgactctatacttgatttgtttatctgtgagcttctacatatttctttccttatcttggtgttagaaccctatttaggtggctccaggactgcaaagaggcattttagagagaatataaaataaagtgattagggcatttgccagaacatgagaatgcctaggcaggatttagctctactatttactagctttgtgatcttaggccagtttcttccttctcagagtttcctcatctgtacgatgggaataccaatatacctgcttcataatcattgtaagaactcagtaacattcaacaaataaatatttattagacaactaatatgcaccatatgctattctaggcatgagggacacacatgaaaaagactgacattacatcgtaataggacagacaaataataaacaagtaatcaagtaatttcagataatagtaagcccatgaaggaaaggaaagaaaatgaatgagaaaacactgtggcagagctcaacatatagcttacattataatgatgttgatgattattgcaatttaacagaagaagcttctacataatttctccaactattaatataaagcttcagtgaagatcaccaacaaaacacaaattaaatgtacagtaactgaaaacaaatctgtggttgcctgggaatggggggacagggcagaaaaaaggtccatcagtctatcttgcacttaggatggaccttttctaggcatcattttgcaatatcatgcactggtcatttaaataatatttagttcgctgagtttaagttcattgagttttacagatcttacaaatgttgacacatttcattatataaatataaaaagtcatattctgtaatatcaccaatttcatcagaaaagtctgtagttatcacaaagctgccaagctcagagtatatacaaattttttaaaattctgattttcacttgaaagctcaaattttatctggctcattttatcataaagaattaccatggttagtatatcattcactctttttcaagcaaaaatgatgttccatgacaaaaagtggctagtcagctcacaatccaaactatcctacaggcgcttctccccaggacatccatcctgcttctgtatgcaaaagtgttttatgagttctattcatttcttcagacagaatgttaaaaacctaaacggctgagattaaataaaattagtaatttttactgcttcatcaaagacattcttaaatgaaactggttttttttcaaaactgtgatctaatgatgctggaaaactattattaacataggttgggttgaggccaaggtgggcggatcacgaggtcagaagatcgagaccatcctggctaacgtggtgaaaccccgtctctactaaaaatacaaaaaattagccaggcgtggtggcaggcgcctgtagtcccaactactcgggaggttgaggcaggagaatggcatgaacccaggaggcggagcttgcagtgggcggagatcacgccaccgcacttccagcctgggtgacagagcgatactccgtctcaaaaaaaaattaaaataaataaatttaaaaaattatatacatatagagagagagagagagaaaaagagagagagagagaaagagagagagagagaggttggagccaataccttgatttctgctaaggcaccaacagttttacccattcttgcttttgcgccaccagtacaaatgtcaagacaatccaaaaggcaataatgtattttttcctttttttttttgagacggggtctcactctgtcatccaggctggagtgcagtgtggtgcaatcttggctcagtgcacctttgcctcctgggctcaagccatcctcccacctcagcctcccaagtagctgggactacaagtgtgcaccacaacacccggctaatttttgtattttttgtagaatcagggtttcgccatgttgcccaggctggtttcaaactcgtgaactcaagtgatccacccgccttggcctcccaaagtgctgggattacaggcgtgagccaccacgcctggcctacaacatcttaatattattacaaaaataattttcacctcacagatcactccccaaaaaaatctcaatatctagaactccttggactactccttgagaactgttgccctaagaatcctgaaagaactgtaaggagttggagaatttacaaacattaaaatacagaacagaaaaaaatgactttcagatctctctctagtccaattctcttattttataaataaggaaacgaggcatagagagaataggctttgccatctcacacattagtaacagagatgtgacagcattgaggacttctgagtgggttgctactgtcctttgtattatactattgttcctcttttgtcaaaaattggtttagaaaattccatatcttccttctttaaaactgaacaatggcattaatacatactttctgtggcgaaaaggagtttatcttttccagtggagagttgagttttacagtctttcctgaatcaacttttgcatccaaattgtgtacttctgttccaaagcaatgacgttttctaatctgtaaacacagaaccaaaatgaagtttaaggtgaactagaagtttaactggctagttgttctcaaaggccaaaacagctctatgtatttttttcctgcatccaaaaaaagactatttctaacaggcaataataaaagaaattttaaaaatgcaaataagcacctcattacaacacttaaaggaaatagaacatagtagtgactcatgaatcttagccaaactatctttaattagtgatgtatcaaaattagagtattgtaaaatgaacttctcataaaatagtcccatcatatggacatcaaatatagcaatattggaaagtccaatcttatatctaattggaaaataaaagtaaatcaaaatttaagcataattctacattgaaaagaactcagaataaaacttttaatgtaaacagtcatgatttcctacaggatggaataaattactcgattactattatcactgttacttactagatatttgataaaccaagttgcctttgattaaatttcttttataaataccactaagttttctttccaaactgtatccatgcttttcctatttgtgaaaaatctattcactatataattggggagaaaagcatttctattgataatctcattcccgccaaaaatgaaatgagaaccagtgaagtgagggaataaatgttttatgttgagccctacctgatgacatgcaaatctatgaatacattttgtcggggggaaatctctataggttcacacctcatttgtcattggtactttgataaaataaactagttcattctatttctaaaaacaaggctgaattatagaaatttataaagactgtaagtggaacagttaaactacataagacttcaagaaccttgagtatactcaattaaaagtacccagttacttacctacaaataacatcctaattaataatttttttattttatgtttttatttatttattttttagagacagggtcttgctctgtcaccaaggttgaagcataattgcatgatcttagctcaccacagccttcaactcctaggcttgagcaatcctcctatctcagcctcccaagtagctggaaagtagtctgtagggctacatgtctgatgagcctgtagggctcatgccaccacacccggtctttttttttacttttttgtggagacaggagccttgctatgtcacccaggctggtctcaaactgctggactcaagagatcctcccacctcagcctcccagagtgctgggattacagtcgtgagccactgtattcagcctaataattatcttttttatttgtaactaaatctattaaaatcccagccttcctatctcactgccatgaattctgagaaaatattgtgttcatctgcatccaaatttcatttaaaatatctggtaattcaagccttttagtaatttttagaaataaatatacatattttatcatgtatcaatcttaaaaactcagtaagaatacatcttgtcattacattaaaactatcaattccaaaatatccataacatgaataatcatatcaaaggtattttagccaaaaggaaatgctattttaagataaaaacaatggaggagttaaaaagtacaaagtagtatatcactaagatatgccttaagtaaatattttactatcaaattcctcatatataagaaacaccatgcagtttcacttgaacgacatgttactgtgaataatctgctataataaactcctttgtaacaagtaactctacaaaatgaaattacaacaaattattaatttatggctgtcacatgacccaactaatctccacaagtgcattaaaaacatgatacttgactaccatgttcagctgtaactaactgggttatttactgccaataaactctgtttacctgctgtgtagtttctaagggtcgaattcttttcttctctacttgaaaatcatcattttcatctctgtatatggatgcctgtttcttagcagataactttgcagccagagtggttttttcaggggagtcttatataagtaatttaaaaaaaacagcataaataacttacaggtaggcaatttttctagaagaaaactggaaccaggatgtaaggcttatttctagaaatttcataccataatctaaaacatgaaacttaaacatgtttaaaaagtacttctctaccattcagtttactttaccaaagattctgagaaacatgctttcaataggaaaagtccaatttgattttttaaatcgccttatgtacttgtagactactcccaataacatgatttaaaatgtataactgcaaggatctctgaagaaaatatatttcatgtctgtaaaaatctttctttacagtatcaacgtttcttccctactaagtttctccacgttctttagagcaaaaccattgattatagaatcaagctcatataatctgtcttttaatcccataatcctgaaagctccttctcaaggtcatccaggacctcttaatcaccaaataacattaattatcccaatcttacaaatgtgaacactaggtttttaaaagtctagtagcttgcccagtatcatacagttattaaatggtagagcctagacatgactgaatcctgctgtgtgactccaacatccatacatgtaacctcttaggcatacagccaacactgtcttcttggaacacagcaaacacattttcttcttccttaatgtctgtaacactgctcttaactattctcatacattggtttctcccttttcctaaatataaatattcttaaaggtaccctccttcctctttgcttctctctaagcattctctccactcccatggcttgaattaatttaacaatcttttttaaccatctttttttttttttttgagatggagttttcctcttgttgcccaggctgaagtgcaatggtgtgatctcagctcaccacaacctctacctcccaggttcaagcgattctcctgcctcagcctcctgagtagctgggattacaggcatgtgccaccacgcctggctaattttgtatttttaatagagacggggtttctccatgttggtcaggctggtctcgaactcctgacctcaggtgatccacccgcctagcctcccaaagtgctgggattacaggcgtgagccaccgtgcccagccaacaatcatttattacactgagtctaacccatggccagacaccatggaaaaacagtgaaaaagagaatccttggccctaaaggatttacagcagagaaagacctacatgagcaggtccaatactgttttcaaaacacaaatttgaggccggccccagtggctcacgcctttaatcccagcactttggaaggccgaggcgagtggatcacttgagcccaggagttcaagacctgcctgggcaacatggcgaaatcccatctctattaaaaatacgaaaattagctgtgcatgttggtgcaggcctataatcccagctactcgggaggttgaggcatgagaatctcttgaacctgggaggcagaggttgcagtgagctgagatcgcgccatgcactccagcctgggcaacagaacaagactctatgtctccaaaaaaaaaagaaagcttgagattacataaactcagaaatgaacctatgccacatagcactgattttcaagttttttctaaagtgtaggaatattttcttcttaaagaaatgttgcagctgggcacggtggctcacacctgtaatcccagcactttgggaggccgaggcaggtggatcacctgaggccaggagtttgagaccagcctggccaacgtgacgaaagcccatctctactaaaaatacaaaaattagctgggcatggtggtgcatgcctgtaatcccagctacttgggaggctgaggcaggagaatcacttgaacccgggaggcagaggttgcagtgagccaagatcgcaccactgcactccagcctaggtgacagaacgagactccatctcaaaaaaagaaaaaaaaagaaatgttgcttaaaatttccaaaatagggatgaaagacccagaacttccctgatccactttcccccttcccttatgagtcatgtttctttctttataaggttcttagaaacacagtttgaaaaccactatactctaaaaatcctaatagttttgcctatcagaagtaggtctttaatctaccttgaatgggcttttgtatatggtataaagtagggctccaatttcaattttttccatatggacatctaacaggcctagcaccacccaagttcttcctttcccctacaagctgtaggggcacttctataaaaatatcaagtttctggatacatgtgggaccaaattagggttctctatacttttatatgagtctatcactgtgctaacctcagtctgtcttaattactctatatttacacacaataaatccgtatatttggtggatcaaatctctcaccttgacctgcttcttcaaaagcatcctggctatccttagtcctttgcatttccatatatattttagataagataggtaattttgagctctgcatgtccaggcaaccagtaaaataaccacaaaataaacctagatcagtgattctcaaccaggccaattttaacaccaccacttctcatcccaggcatactgggcaatgtctggagacatttttcgttgtcacaaaaagagcagaggtggaaatactactagcatccagtgcataaaggccagaagtattgctaaacatctcacaagggagagctcctacaacaaagagttatcccactcaaaatgttaatagtgccactgtggagaaactctgtcccaaataaatacggggcaaactgacatgggcctattaagagggtagggaatgtccacccaaaatgatcatttagttttagaaaactgaactgccatgtgccaaataagggtaaccccaattcataaaaataaaaatcatattatcatcacatacaaaaaggcttatcttcctggtcttgatagcaagggagtttgaaggaagttcatcaaaggggtaaaatctttaagatacaaagttaaaaagaaagaagatatctcccgattatgtttttttaaaatcttcaagaaacctaagaaatacccaatagaaaaatggaggctgggcacggtggctcacacttgtaattcaagcactttgggaggctgaggcgagtgatcatttgaggtcaggagttagagatcagcctggccaacatggtgaaaccccatttctactaaaaatacaaaaatcagccgggcgtggtggcaggtgcctgtaatcccagctactcaggaggttgaagcaggagaattgcttgagcctgggagctggccagtgcagtgagttgagatcgcaccactgcactctagcctgagcgacagagtgagaccccacctcaaataaaaaacaaaagaaaaatggcaaacaacttgattaggcaattcactaaagagggtatccaaatgaccaataaacatatgaagtcaccagagaaatactaactaaaacccaatgagaataccacacatacacaagaatgactaactttttttttaaactataaatatcaagtactaacaaaaatggtgaacaactttcatatactgctgcaggggttggagggatctgaccggggacgcataaattgattcaaccactttagaaaatgttgtcagtatctactatagctgaacatatgtatatactatgaccaggtatgtgtctacagacaatacttacctatttgcaccctttgaacaagaatgttcataacagcactattaaacaatactgaaaacaacccaatgcctaacaactgtagaacagattaataaactgtggtatattcatacaaggaaataatacacagaaacaagaagtactactatatgcaacagcatgaatgaatctcacaaatacaatattaagcagaagacagacacaagattacatatataattccattttttttttttgagatggagtttcactctatttctgtaaaaaggcaaaactcatcaatggtcacaggaggacaagaattacctatggaaagaagggacagtgactgaaaaagaagatgaggagggcctctggggtgttggtaatgtctctctcttttttttttaatctatgtagtagttatgacagtgaaaattcatcaagttatatacttaggatttgcatttttctatatttaggttacagattaaaggatttacttacaaatataaagagcgtatcagaatacaaccttgatttttcccatttagactattctaaataacactgactcacagtaatgtcaaaatcaagttgtgtacatatggataactcattgttgataaagacacaaaggcaatgtagtggataaaggatagccttttcgatatatccaggtgctgaacaactggatatccacatgcaaaaaaatgaacttgaatccataccttacaccatatacacatattaactcaaaatggatcttagacctaaatgtaaacctaaaattctatctgatcaaagacttgtattcaaaatgtttaaagaagtctcaaaatttaacagtaagaacacaaactaataaaaaataggcaattattcgaacagacatatcatcaaacaagatacatggatagctaataagaacatgaaaatatgggaaataaaaattaaaaccacaatgagatactgccacatgcctattagagtagctaaaattaaggccaggtatggtggctcatgcctataatcccagtgctttgggaggccgaagaaggcagatcacttgagcccaggggttcaagacaagcctggggaacacagtaaaaccaacaaaaactataaaaattagctaggtgtggtggtgcatgccagtagtctcaactactagggagtgtgaagtgtgaggatcacttggttccaggaggcaggggttgcaatgagccaagtgagccaagatcacagtactgtacccagcctgggcaacagaatgaaaccctatctccaggaaaaaagaatggctaaaattaaaaggactgaccataccaagggttcacaaggatgtgaagaaactggaactctcataactgctgatgggaatataaaatggtatgaccacttcatgaaacagtttagaaatttcttaaaaagttggccaggcacggtggctcacgcctgtaatcctaacactttgtgaggcacagatgggtggatcacttgacgtcaggagctacagagcagcctgaccaacgtggtgaaaccccatctctactaaaaatacaaaaattagccaggtgtggtggcacattcctgtaatcctagctacttgggaggctgaggcaggagaatcacttgaacccgagaggcagaggttgcagtgagctgagattgcgccactgcactccagcctgggcaagagtgactccgtctcaaaaaaaaaaaaaaaaaaaaaagttaaaacatacacacctacaaagcaatctggtcattctgctcctagtattcacccaagagaaatgaaaacatacatccatacaaagatgtagacacaaatgttcacagtatctgtctttgtaatagcccagaactagcaataacccaaatatacataaacagccaataaccaatttgtggtatatccatgcacaattactcagaaataaaaagaaacaaactattaatacatgcaacaacatagaggaatctcaaaataattgtcataagtgaaagaagccagacaaaataagtatacatcctgtatgaatccatttatataaactatagaaaatgcaaactaatctatagtaacaaaaatcagacaggtggttggttggggaggtgagtcatgtaggggtgggaaagagggataacaaaagtccatgagaaaactttttgggaaagtgagcatgtttaaaaagttttggataaagtgaatatggggttggtgtgtatgttcactgtcttgattctggtgaaagtttcatggaggtacatatgtcaaaatgtatcaaagtgtaccatttaggctgggcgtggtcgctcacgcctataatcccaggactctgggaggccgaggcaggtgagtaacttgaggtcaggagttcgagaccagcctggccaacatggtaaaatcctgtccctactaaaaatacaaaaaattagctgggtgtggtggcaggcgcctgtcatcccaattacttgggaggctgaggcaggataattgctcgaacccaggaggtgaaggttgcagtgggccaaggtcacaccactgcactccagcctgggcaacagagtgagattctgtctcaaaaaaaaaaaaaaaaaaagtaccatttaaatatatgcaatttgttatgtcaagtaaacgtcaataaagctgtttttaaaaggttgtatataaatattatacaccagaattcctataattagctgaaaattaatcccattcattcctaacaacaaatatttatctagcacctaccatatgccaggcaccctgctagagttctagggatacaatggtaagcaaattgacaatattcctaacctcatgaagtagtctgccaaggaagcagagattaataaaagatttagacagacacatataatacaaactgtaacaagtgctataaaggaaaggtacacaaggagaagacagactataataggaaaatcaaatctactctgacagaaaaatcagtgatggataccccaaggaagtcacatgtaaactgaggaagaaaaggataataaattgaagatggaactttgctcagaagagacactaatagaagcaaaggctctgaggaaggagaaagcataaatctttgaaggaaagggaagaaatccaaaaggccaaaatcaaaacaatgtagacaacactattggtcacctatttaataactgttccacttctctttcctcattcctaccagaagttcaatcatctaccctcctctatatagtcacatgctttagaggaagctgactccatccttgattttaggaaatggatactctttgttttgacttaagtcaatcatggcaacctctgtctccctgccagtgactggtaaaggaatagcatgagtaaaagcagaaaaaagcgttattggatgctctaaacaagaaatggtagtttggactatggaggtaccaatggatatggagatgtacatgaagaaataagaaagagcaaagtgtccaggatgttccctaggtttcttaggtaaataatagtctatcctttctatacagccaaaagcaggtgaaatattttttaaatatattattaataatcttatgttactcttaatgtatttctctaaaattagtaaaaattatttaaagatcacacataaacatacctgatacttatgtaggatactggcctcagaaggccaggcaaacttatcaagaatgaatcaatgaggctaattagatttcgtcttaggatacaaacattgttttatagaattctaacatataattaacaataatggctacaaataacatcaattttggaaaatcatttattttgccttgccttccttaaaaaattatttaggacaacaaaatgtctcaataaattaaaagtcaaaccaagaatttaaaaacgtctatggatttttgaccactctgtgctattttaaaatcattccagagaaactagatagagatatataatcagttatgctaaccaaacttatataaattagggcttataacagtaataattaagactcttattacagatatcaactgacccaggcaaaatataaattaccttgacaagttgatgaagtgccatttctttcagaaggtggtgtgcttggatagttgaaatgacgtgaagttccttggttcatgtcattgtttgtaaaatcctttgaatggcatgcacaacaacatgacaattgtacttcagctttttcacttacgccctcatctgctggtttccctaaaaatgaaagaacatctatttataatatatctaattaaataaacatcaatcattctctacagcccagttcacccaggattgggaggtttcctaagataaaagatttttagggctaacaccaggaaggtacctggcaaacctggacaagctggtcactttatctgcagcatcaaattaggacaggagagaaataagccaaaaacatttggttggacacagtggctcacgcctgttatcctagcactttgggaggccgaggcaggcacatcaattgaagtcaggagtttgagaccagcctggccaatatggtaaaaccctgtctctactaaaaatacaaaaattagccaggcgtggtagtgcacgcctgtaataccacctactcaggaggctgaggcaggagaatcgcttgaacctgggaggcagaggtagcaatgagcagaggtcatgccactgcactccagcctaggcgacagagcaagactctgtttcaaaaaccaaaacaaaaacatttatagggaaattatcacccatttatgtaatctgtaaaaatctaataatctaagattaataatgtaataaaagtacaactactcaagtattcatttatattaagatttatctaaaattcaagaatggattgaaacaaggacataaagtatatccttaattactactctttccctaaatgaagaatttgaaagttcaatatattagataataatctaacacataagggttaaatcattcccccaattatacttctatttcaaatagaaacatgttttttgatgtattaattctgatacttgcatcaaaatacattttaaggtcaatattcaaatcaataaaataggtaattttagtgctaaatataataccaaattgtaataagtttacattgtgtgcctacattgtatacaaatgtacaattcatatacccccaaaaaagctaaataatttatttttaaaaataatcagtattgacattgttttcccatttgtaccatataaatattcctaattctattttccagacatctgccattaagacctgaagttagtaccgataaactcatttttcccaaaattaacgtcagtgagaatcaaaatgaacaaccaaaagcttatgaagtatttactgtttttttttttttttgagacagagtttcgctcctgttgcccaggctgaagtgcaatggcgcgatctcggctcactgcaacctccacctcccaggttcaagtgattctcctgtctcagcctctcgagtagctgggattacaggcacacgccacctcaccaggctaattttgtatttttagtagagacggggtttctccacgttggtctggctggtctcaaacttccaacctcaggtgatccacctgccttggcctcccaaagtgctgggattacaggcgtgcgccactgtgcccagccttaatatactcttattagtaacaaacatttcattttaaaaatgtatctatatacctatatacacatacatacatacatacacataccatgtttaacctcaattctcctaatactttaggttaaagccatctaatgtaactaaaatgtatccaatattatatttctgattcattatgtagtttatatagtctttcatagaagtaaatattaataggcatttgttagcaaacaaagtaaaaatagtttggcctggtggctcatgcctataatcccaactatttaagaggctgaagcaggagaatcacttgagcctgggagtttgaggttacagtgagctatgatcacatcactatgctccatcccaggtgacgccactcaaaaaaaaaaaaaaaaaaaggaaaagtagtgggaagtaatataaattcatacaaacaatattatactaaatttctgtttatctggcatttaaacaagtagaaagatcaactagaatgtattcttttttatatattccatgtgctgatgttatgagaaaggaacaggtaagcaaatatattaaaggatttccccccccaaaaaaagcaattagtatgtgttacagcatcatgacagcccatctcttgcatcttttacatacaaattatcatctaattatttttataataactctaagcatccaaaactttgtttgtttgttttctttcacccaggctggagtgcacaatcacagctctctgcaacctcgacctcctgggctcaagcgatcctaccacctcagtctcccaagtagctgggactacaagtgtacatcaccatgcctggctaattgattgtcaatttttgtagagatggggtatcaccatgctgcccaggctgccaagtctttatgtactttccgactcatcaaaagactaaattatgttcaatactattttagcattaattaaacatattttgctatattgaaactcttttggaagatttataacttatttcaaagaaacatctttaaacaaatatttaagttagcgacagcatggctgaaccagtctggataaagaatactgtattatattttctcagatcccagtaagtaacctgaagatatcaagcaactacttaccactaagagattgttgccatgctaaagcagaacaaagtaaggctaagctttttccacttcctgtgggactctccaacaaacaatgttgcttgctgtttaatcctctgagaatctatgaacacagaaaccaatgaaaataataaacatattaactttataaaggtctctctccatctgaagtttaaatagaacagcaaggaaaagtgagattgcactccagggaacacaacaatagcagaaggaactcatatttagttaaatccaaactgtattcctttacacctctccctaagattatcttactaaaatatcaagcacaagagaagaaatgaaaagaggaatctgtgccagaattatgcaagcatcaatgatttctgtaaaaccagaatacattactacctatcaatatatttgatgaaaacttaatgaaggatactgctagtgagagtacaaattgttacaactacttggtagagaaataaacaatttcttataaagtgaagatgcccagctccagcaagtccagttctatgtgtacacccaaaacctttcccacatgaacacaaggaaacatgcataagaaagttcacagcagcagccacgcttgtaatcccatcactttgggaggccaaggcaggtggatcatttgaggtcaggagttcgagaccagcctggccaacacggtgaaaacccgtctctactaaaaatccaaaaattagctgggcgtggtggcgcatccctgtaatcccagctactggggaggctgaggcaggagaatagcttcagcctgggaggcaggggttgcagtgagccaagatcgcgccactgcactccaatctgggcgacagagtgagacgctgtctcaaaaacaaaaagaaaaaaggaagttcacagcagcattgtttgtaactgcaaaagaatgtaaacaacctaaatgtctaccaataagaaaatggacagataaattctggtatattcatccaatggaatttatacaacaattaaaatggattaagaatcaacagggctatacattaaaaataatgctaagttaaaaaactcaagttctgcataaaaagtaaggtaccgtatcacatcaatgcacagtttcaaatatgtaaaataatattctatattgtttatggatacatatatatgtaataaaagtataaaaacatggctaggaaaggaaaagaacaaattcaggatactaataatcttgttaccagtaaataagatatgaagtacatatggcaaaatagctgtaacaaaactggaaagctggtttactcaaatttgtatattaattttctacatgatccaaacaaaacaatggtgagaaaaatagtattctgtgtaaaagatagtaaatactctgtttttacttaaaagtatagcagtttttcattaaaagtatagaaattccaaatgagctgagaacatttttcagaatgttcttctttgccttaaccacagatatatacagtttagctgcaatcagtagtttcccagaggttagatattcttccaagtgaacccagaaaatattctccatttactgagaatatgaatgcagtcaaatactcaatgtactttatgggtcataagtatctatatcttaataaaaacttaactgctgaaaaatacttacagaattcatcatagcaagctgtgacgggtaagctttataaggaaagtaaatcttcaccccaccaattgtatattcagaccacattgaagacatagtgctttcctgtttatttcagattcctaactacaacagaaatgaaaatgtcaaatattgagacacgccttacaaagaaaaccagagaaccaaaactaagggagaaatctggaaacagaaactggaattaataaaagtataaacaaaacaaatggaaacaaaataatttcctagtcttataaatcacagcggtcaagagcatgtcttagagtctaacaaatctagatttgtatccttcactctgccaggtattagttgtgtgacttcgggaaagttagttaccttctctaagccacagtgactgcatgtaccccataggattgtggtaatgattaagtgaaataatgtgcaaatatgataaagtacataccagattaaacatgagctcttgtaacagttagatcagatgtaatcaacctacagaaacaaataagttcctgaggcctctctctctacaactccgtagcatcactctttctccagttcttcccctttgtgttacccctttctgcagtcctccagttagaagaaaaaagctgttgaccagaagtcaggaagcataggttctataccaggttttggtatactgcctggtatgttatctttgactcaggtatgttatctttgacatatctttttacttctctagtctaagatccttacctgtgataacccctaatttaatttaaaggctgttataagaaagagaatgccttggcacatagtaggcactcaaaaatgttatttgaagatcagtagagtattatagaaacaggatgggctttggagtaaggcaatcctaagtttgaattccactgtgtgaatcacttaacttctcagagcttgtttctccatatatggaattgaaatactactacttacctgacagggtttttatgaaaattagccagggcagaatgtacctaacccaggatctgatacagatgaggatcactttaatcctcacctcttctaaaccacttttcttaacctaggatccacggatgtaattcagagacaatgacctcttgaaattgcaagcataagtttctgtacatgattgcatttttctgaagaaaaagtccatagatttctcttcccgtaaatatatctcaaggaaatcaaaatagcgggggaaattacatgcactgttattaaataaggaattatttgcagtcgtgggaaaaaattgtaaattcaacctggggacgaagagatggttaaaatagcaattcaatagattatgaagccaataataacattcaccactgcttgtgtgctccaaaagaagaaccattattctagggtattttccagctctaacattttgcgattctatctgtaaagctctgagaatgaggtatggtggaatctaacctcttaatatgaatcaacaactcaacgctggcctagttactcagatataatctagaaatcagcccgtcctgtaccccggctgtggcaacaatagtgtcaaaatggggtagcttcccccaaacattgcataaaggataaacacacccctctgcctcccgccaagaattaacgcagcgcccgggctaagaacaggcctgcgctcaaaggaggtaaggataggctccctcctcaggttttctgccccgtatctccctcctcccccagccagttgagatccccgagaccctggtgatccagtcaccacccatgggcccgcaggctgtgcagaagaactcaagccctttccgtggacttccctccgacttgcctgtctggagggaaaccgaagcaacgctctgagctccgattcactgaagaaaaggaaaggaaaccgacttctgagagcaaataaagcggagccctggaagagaagaaagggcacgagcccttcctcctccctcttcctgggggtgctgctacttccccggccttgtgtgcaggactggggccgccgttacctttcctcgacccaccagacccctcaaccacacaacccgagacgaattcccgcctcccgccccctcgactcccagcgcccaatagcccagcgagctcgaccaatcacccgccaaggccaggaatcaaccagtcccggtgcgaggtgagggggcgagaacttcggcatccaatggaagtctccgaaaaaaaaaaaaaaaaacaagggctcaaggtacgcggcggaaggttgtcgccactccagcaaatccctagtgtttgtttaaagtagaaagtcgtctcagtttgacttttgaaaccggcgatagagtctatgcagcaaattccttggaaactggaagtctcattcttcacgtccgtagaccagcggaaaggaagtatctttaagctttgccaagttctttgagcatttatcagtgccactcaatttaaattacccagctttgcagtagccaggatagcgaagactcaggcgggaattgccagactgctgagccaaacttaagtaagaaggctctgtgacatcgggctacaatctatctttcataatattcaaggctttcccggatgctaaaataagccagagacaagctctcagggtctccagtatcagatcacttctacttccattaaggcttatccgccttcc

SEQ ID NO: 122 - DNA, 82138 bp, Homo Sapiens
ttgatcttgtataacattttatttagcattcttacacactacacaaaataaatacttggataactcacgtctaacaaactaaactatatatgtattttttccataggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaatagtgtcatagaatagtgtcatagtacagtttggaaaacacttctgaagtttcagatcacctaggaaatctagaaaaggagtttaatgtttttgatcagagaatttgaaaaatagaaatacagagaatgagtttcaaaagttttagataaactgatatactatatagatctatcttctagaacatattactgaaagctaggcacattttatgagatgtgattaacaatttgcttaccttactacaatatggacattcaccaaatatgatgttaaaactctgtctactagttagtagtcctctcagccactgcaaattttaaaagataaaggagaagcgtcagcatgattacaaattacagatactccaaatgtcattccctttgtttttaagtgcattatgtttttattccagaagacttagcttaattttgttttgcaagagtaagggatgtatttcctgagccaatagcagactattaagatgttgagtaacaagggaaatcaacatggaattgaaggcctaaaccactggtttataaccagattatgggcccctttaagaatctgataagaattacgcattttctttatccccagaatagacatacataaaaataatgcatactaagttcctggcattcatagactttccctaaatccattaatcacaaattaacaactcctgctgttaaagatactacaggctcttgaaaatttccctcttagttctggtctgaatcactaacagtgggttaattttcaacccattgattataagcatgagccagtgaatttttaaaaattaaatgaatattcataattacaaaagaaatcacatgttcccttagagtatttctgtaatttgacctgtatttctgtaatttcatgattttatataaggtaaatagatgcctctgcctaagttctccattggcaaagtacagacggcaccaactgctacctctaatcacaaaagtaaagatgtgatattaaggaagactgaaaccgaaggcaacatacaattgcaaggtgttctgtatatagttacacacagtttatcatgtatcaactaggccctaaggtgaagccaggcactaaagacaggaatgaaagtagacttcacatacagtaagtaaagtggcattgcctgagtgctgtgagactcagatcacaaaaggcattcttctcaacatgaaaagtagtagtattggatatattctattcttaaatgcagcctgaaaagtaatagatactacatagtactaatttcattttcactgtattactgccactttcaaccacctccacctcgggtaaacctatgaagcttacattgtggtaacaaggaatttatagaaagattccaatgtaccatcaatttaatttgttatgtgtcaataagctagtccatgaatatattctggatagattttctcccttggatacttcagaacatttctccactcattagtaactgtgatgaagaaatgaagcacataagcatctggaataaactggtaaaaggagttaatggcaaaagagaggatcactattgactcaacagattttagattctgtgtatttcaaacaggaatacttcctatgttgtgttagcggaaaaaagtcttgacaatatttttattttttacctcatataagcatatttgatggaaaggttgtccacactgagaattatcacacacttgatcaggaatggtaccgtcaagttgataagcataacaaattccacaatccatagtaaaatccttcaaaagaaaaatatttataaaaagcgtatgtgtctcactaacttattcgttgtacatatttgggagggtatgtgtgatattttgatacatgtatacagtgtttaatgatgacatcaggataattaagatattcatcacctcaacatttaccttttatgttgggaacattacaattcttctaactactttagaatacgaaatcatctatgtgtttaaaacacaaggtaagatcaggaagaatgttttataaatatagtttttataaaggtgactatattgctgtattataggaaatataattacattactatttaacacctagcaaagctattgtagggtgtttccttttccactcaaatatacacagctaggctaaaaaaagagattccatttttggctggcaagatgtttgggcatcagtaatattcccatatcatacattgttataatgtccctgatagtatttaaagaaaggaattgatattagctagtgattactaaacagcacaattctgtaactaaaggaaaaagaaactcactaccatttagtagtctacaaccttagcagccttgtcaaaaatcaattctattatttttgcagtatagtggtatctattcaattttgagaaactataactgcttcacaaacacttacatcaagctaatcagtatttgagccatccataaacagactatgtagaaaagccaaacatctcattagctactttggagttctccccttatttttaataaatgtctgtcattaatgacgtcactactgaagaccatgaaaaaagtatatagttgacccttgaacaacatgggtttgaactgcacaggtctacttatacacagattttttttttaaccaaatgcagatcaaaaatacagtactgacaagatgcagaacctgtgtttatgtgaaatctctgtatacagagggccgacttcttctatatatgggtcctgcagggtaactgtggaactttaatgtctgtggatttttgtatccatgggcagccctgaaatcaatccccctgttccaagagacagttgtacttaacaaccaatcaaaggtaaacaagttttttgatgcagatcagaagtctgtgttataatatttttctaattccctcctttttcagcctcatttttcactgagagaagcatttaaacttcattatgcaatactgtctggaatatcaaaacactgataaaacttacagatttttccaggatagcacgagctggaaaatcaatttctaaaacatctttcaaattttgtaacacactattttctggatccctgaaagcatggggaaaaaaattatgctgtgaactttgtaaaatcaccaaaaagtaaaaattatattgccaaggtacctaccacaaatgtatgttcctgctcagcttaattcccaggggttttaccacttcagattaaaaaaaaaaaatttaataattgcatgctctactcttggtttctaaagccacatttgatacagaatgtttcttaactacttgattagaaaatcaaaattatatgtattatgttaaaaaacaaaattatacagttcagaatgctgagacattgtcatttaaaataactatcattattgcggtgaaccgagatcgcgccattacactacatactgggcaacaagagcaaaactccgtctcagacaaaaaataaaaactaccattaatatactaatattgtctaataatttaacaatgctaggcaaggattttatgactctattaaaaaacgtttaaatctcagatgtcataccatggtcagctccaagaaagaagcactcaggaagcatagtaggatgcctggggtctacctctatatttatggaaacattattacctagaatgaaacaagattaaatcttttagaagtagaacagctcatcaaacaacccaataaaaaataaagaggtgttggtctggctacctatttcactgtatacccacggaaagattaaccaaatgttttgtagttttatgtaatggtaaatataattgaaccaaaagaagtaattttgatatgattatcattgaaaggatcttaaatttcagccagtcaacaaattgatatatttaattagattgcaattctggtcaactgtattaaagtttaaataaaaatgttctgtggagtgataaaggtctttaatatcaaaactatcacaagtcacatgtttaagaaataactatctaaattatttttcatggctttcctgaaaaagtttacatttcatagaactatggccaaatgtaaaaagaccaacaatacagtaaatggtaaaaacaaacattaaagattcaagttttataaaaatttataaaaacattttctgtattattttgctgcatgtgaaactttcccttataatttaacaaaagatttcattcacattggcaattgttcattaataaccaaaacaataagtaacctaatttcgcaagacctaagaaaattggcactaggttcttttatacattttaactgtactggactacagcgtaagtttcagaaattttacttctattttttgaaggtacatagtgtaactgcttaagatcaatttggatttcattttcatcgtaaaaatgtcttgataaattccatacactgtagaataagcctttcactaaggctggcatcaacataaatgcagttattgcatatctggcaaaaagaggtcattaacagaaaaaaatgactagccattcaatgagacaaataaaaatacaaaaagttataatctcatttggtaacacattatttactatgaacagaaatttcttattagccctcaacactgtcatctggtaatggctccagacagtactttcacgtaatatgggcatattaactaatttttccaatcacttgttcaaaacttggtcttaagaaagcaaatcatgcctggaggagaaaaaagaagctaaaaggtaaatagggaatgaattaaaaactagactatgtatgctgaatgagaaatatagtaagtatatttaatcataacctgataattactttaatggggccacgaaaataatgatttactacatttctttgaagaaaatattttcattcttagtatctacttgttcacaaatataccataatttggttaattgttccaaattaaacacagttagactttttgaaaccaggaaagtaccaatactatttgtagaactgctgtaaactatactttcttctcgtaataccacgtatgtgacattcttcccccagataatctatattatacctaggtataaagtataaaaattgctcactaacttggatgtgattcacatcagaatttcaaaatacccttgaacaacatatctatttagaaaaaaagaaatgggtatcttaaaactagctatggtatttaatgtgagcttaaatatagtttatctaaaatcttgagaaaggctgaagtcacatgttttgcttgcttataatgaaaatacacagccattttatagtcgagaacatgataacattgcacaggtatttatgattataccatatctcattcataaatttcatatacttgtgaagaaaatacttaaaactataaattctttctctgtgctttctgtttactcttcagtggcatggtctactgcaagttcttttatcttcctctgtatttctaacagaaaatattcccagatctgagcacactaatctgagaagattgtaagcttcacaaatgaagactgcattattctgacttttttcttgttctaagtaatgtaaattttgagttacctgttccacgattcctgtgctaattagcagctaattaaactctacttctgaatgttacctccattggatcatcaccttttataatgaaacacctcagtacttctccttttcacctaaaatatttacatttaaatgtgtagccaaaaaaaagtttatactagaaaattttaatagttgacttcatataaagaagtctgagtccaactgtcattgttagatttattttcataatacaaaataaaacacctaaaaacaaacccttaatcctccttgtccctacctaatgcaattctgcgtgctgttgcactccgtggaggtttttctggctcaagtacccaggtcttctcatcgatttcatccataacatcccagaatgcctttagtgattctattgctgccaaaaactgactataaatgcttattaaggagctctgtgaaaaaaatgaaagttgaataagttatatggtactctaccaatagcagataatcttttacttaaaatacactcaatttagaaattttaagctgtttcattttagctacaaagtagactccagtaaacagtagtcgactctccctgcttcacatctcttcctacagcgtttacaggattcttttttattgacagtagactatacacctgagaaagaatggttttttaaaaatcataatttttttattataatgcttgatatactacacgtatgcaatagtaatgagtacaagatgtatgtacacacaactttaataaatattaatgtacatgatatagctaacattggacctatacaaaatgtctataatattttagtatgaaaatcttaatttcatgtttgctgcagcaatcaagttaaatgcagtgctatttgtaatttagtgagattacctttaaatattattaaaaactttggagacctaattaggcagagtatgaaaaggttttacacatttttaaagaattaaaacagaaggtacaaatgatgtttttccacatttaacttttagccaatctctgaattcagcatttcatatattaatccctttataggaattagcttaaatatagtttcactaaataataagtaatgccatcactgactttaaaaatcagtttttaaacaaaggagtttctcatgaaacaatgtggtatgtttaaaagatacaactgcttactaaatacttttgatacaaaatcaaaacagtttaataagaaggatttgtttcaagtacacaaaatgtaaagtcacatactacaaacgttttcaatctgaaataactggccacaccaataatttaagaatatgatacaccctaagatgaaaagaaactagccacttccttaaacatgtattttatacctaatacttaaggaaaacccatcccattttgtcacttcagtcaaggtttacacttggatgaattcatgctcagttccactgtgctggattcaactgttctaaccttctacacatatttttttaaaaagtgggccaggtgcagtggctcaggcctgtaatcccagcactctgggaggctgaggtgcgcagatcacgaggtcaagagatagagaccatcctggccaataaggtgaaaccttgtctcttctaaaaatacaaaaattagctgggcgtagtggcacgcgcccatagtcccagctatttgggagacagaggcaggagaatcacttgaacccgggaggcagaggttgcagtgggccgagatcgcgccactgcactccagcctggtgacagagctagactccgtctcaaaaagaaaaaaaaggtgtgaagtaggaattagagcctaatacccgaaaaataacctttgaggatattgacggtataatgtctgttctcttctggtatactttacttacctgtaagtttaggtgacagaatccagaaatcagaaaattaaactcccaagaagctagttttaaaatcagtacaatagtatatctctgtttctcctttctctgtctgtttctacatgtgtatttaaaatccgtaattacctattcctttgtatacccaagataaggttaactcccctgccaaaaaaagagttataaaatattttcacagtggcatcttttatttgaagttttttccaatggcattgtccatttctcttatgcacaactgcaaataaaatcctaattgcattttgaacagaaaaatgtattcttaataagaaaatagccaaaaacaaaacatccctggaactagaagttacttggtaattacagaaaaagtgaattttaaaccctaaaagccattatacgattttactagctagccatttgaggtagatacattaaacattatttttacattccagatggggaaaagaaagatcaaaaatgtgacaagttggacatagaaacacttctcttagcaatttcaacgaacttagggggtagacatcaaaactattatatcagtaagctatgcgattaatagttttttctccaactgcttattttgtccattaaatcactaaaaacccttattttgaattttttccccaaattgaaaaaaataaattatttctaaatattaccaatggaattaaatactttatatacagcaccacaaatgccaagaaataatatggccaaaattaaaatcaaagttcagtaagtattttgcagggagatgaattctctaaaaaatatttttaaaaataaaaatagctaacattcttggtggctggcaagatggccaaacaggaacagctccagtctgcagctcccagcgagatcaaggcagaaggcaggtgatttctgcatttccaaccaaggtaccggctcacctcattgggactggttagatagtgggtgcagcccacagagggcgagccaaagcagggtgggctatcacctcactcaggaagcgcaaggggttggggagctccctcccctagccaagggaagccatgagggactgtgccatgaggagtggtgcactctggcccagatatgcttttcccacggtcttcacaacccgcagatcaggagattccctctggtgcctatttcaccagggccctgggtttcaagcacaaaactgggtggtcatttgggcagacattgagctagctacaggagttttttttttaataccccagtggcgcctgcaacaccagcaagacaaaactattcactcccctagaaagggagctgatgccagggcgccaagtggtctatctcagtggatcccaccccaagaagcccagcaagctaagatccactggcttgaaattcttgctgccagcacagcagtctgaagtagacctggggcactcaagcttggtgggggaagggacatccaccattactgaggcttgagtacgtggtttacccctcacagtgtatacaatgccacgaggaagctggaactgggcagagctcaccgcagctcagcaaagcctctgtagccagactgcctcaccagattcctcctctctgggcagggcacctctgaaagaacagcagcagccaaagtcagaggcttatagataaaactcccatctccctgggacagagcacgtggggaaaggggcggctgtgggcacagcttcagcagacttaaatgttcctgcctgctggctctgaaaagagcagcagatctcccaccacaacactcgagctctgctaagggacagactgcctcctcaagcaggggtcaaaagacaactcatacaggagagctccagctggcatctggaggatggccctctgggacgaagcttccagagaaaggaacaggcagcaaaatctttgctgttctgcaacctccactggtgatacccaggcaaacaaggtctggagtggacctccagcaaaatccagcagacctgcagcagaggggtctgttagacggaaaactaacaaacagaaagcaatagcatcaacatcaacaaaaaggacatccacaccaaaaccccatatgaaagtcaacaatatcaaagaccaaacgtagataaatccacgacgatgaggaaaaactcgcacaaaaaggaggaaaattccaaaaaccagaacaccttttctccaacggatcacaactcctcgccagcaagggaacaaaactggacagagaatgagtttgacaaactgacagaagtaggcttcagaaagtgggtaataacaaactcctctgagctaaaggagcatgttctaacccaatgcaaggaagctaagaaccttgaaaaaaagttagaggaattgctaactaaaataaccaggttatagaagaacataaatgacctgatgaagctgaaaaacacagcacgagaactttgtgaagcatacacaagtatcaattgccgaatcaatcaagcggaagaaaggatatcagagatttaagatcaacttaatgaaataaagtgtgaagacaagattagagaaaaaagaatgagaaggaatgaacaaagcctccaagaaatatcagactatgtgaaaagaccaaacctatgtttgattggtgtgcctgaaagtgatggggagagtggaaccaagttaaaaaacactcttcaggatgttatccaggacagcttctccaacattccaattcaggaaatacagagaacaccacaaagatactcctccagaacagcaaccacaagacacataatggtcagattcatcaaggttgaaatgaaggaaaaaatgttaagggcagccagagacaaaggttgggttacccacaaagggaagcccatcagactaacagcagatctctctgcagaaaccctacaagccagaagagagtgggggccaatatttaatattcttaaagaaaagaattttcaaactagaatttcctatcccgccaaactaaccttcaggagtgaaggagaaataaaatcctttacagacaagcaaatcctgatagatcttgtcaccaccaggcctgccttacaagagctcctgaaggacgcgtgaaatatgcaaaggaaaaaccagtaccagccactgcaaaaacatacgaaaatgtaaagaccatcaacactatgaagaaactgcatcaactaacaaaataaccagctagcatcataatgacaggatcaaatttacacataaatgtaaacgagctaaatcccccaattaaaagacacagactggcaaattggataaacagtgaagacccactgctatgctgtattcaggagatccatctcacgtgcaaagaaacacacaggctcgaaataaagggatggaggaatatttaccaagcaaatggaaagcaaaaaaaaaaaaaagcatggtttgcaataccagtatctgataaaacagactttaaaccaacaaagatcaaaagagacaaagaagggcattacataatggtaaacggatcaatgcaacaaggagagctaacaatcctaaatgtatatgcacccaatacagaagcaaccagattcataaagcaagttctcagagacctacaaagagacttaagactcccacacaataatagtgggagactgtaacacccccactgtcaatattagacagatcaacgagacacaaaattaacaaggatattcaggagttgaactcagctctggaccaagcagacctaatagacatctacacaactctccaccccaaattaacaaaacatacattcctctcagcaccacatcacacttcttttaaaactgatcacaaaatttgaagtaaaacactcttcagcaaatgcaaaaggatggaattcaataaaatctctcaaaccacagtgcaatcaaattagaactcaggattaagaaactcactcaaaactgcacaactacatagaaactgaacaaccttctcctgaatgactactgagtaaataacaaaattaaggcagaaataaataagttttttgaaacttaagttattgagaacaaagacacaatgtaccagaatctctgggacacagccaaagcagtgtttcaagggaaatttataacgaaatgcccacatgagaaagcagaaagaactaaaattgacaccctaacatcacaattaaaagaactacagaagcaagaacaaacattcaaaagctagcagaagacaagaaataactaagatcagagcagaactgaaggagatagagacacgaaaaacccttcaaaaaaatcaatgaacccaggagctggttttttgaaaagagtaacaaaataggggattggagccaagatggccgaataggaacagctccggtctacagctcccagggtgagcgacgcagaagacgggtgatttctgcatttccatctgaggtaccgggttcatctcactagggagtgccagacagtgggcgcaagacagtgggtgcagtgcaccatgcgcgagcagaagcaggacgaggcactgcctccctcgggaagtgcaaagggtcagggagttctctttcctagtcaaagaaaggggtgacagacagcacccggaaaatcgggtcactcccaccccaatactgcgcttttccgacgggtttaaaaaacggcacaccaggagattacatcccgcttggagagtcctacgcccacggagcctccttcattgctagcacagcagtctaagatcaaactgcaaggtggcagcgaggctgggggaggggcgcccgccattgcccaggctagcttaggaaaacaaagcagccgggaagctcgaactgggtggagcccaccacagctcaaagaggcctgcctgcctctgtaggctccacctctggggacacggcacagacaaacaaaaagacagcagtaacctctgcagacttaaatgtccctgtccgacagctttgaagagagcagtggttctctcagcacgcacctggagatctgagaacaggcagactgcctccttaagtgggttcttgacccctgacccctgagcagcctaactgggaggcaccgcccagtaggggcagactgacacctcacatggccaggtactcctctgagacaaaacttccagaggaaccatcagacagcagcattcgtggttcaagaaaatctgctgttctgcagccaccgctactggtacccaggcaaacagggtctggagtggacctctagcaaactccaacagacctgcagctgagggtctctgttaacagagggtctgtttgttaacagaaaggactcttagctgagggtctgtgtgttaacagaaaagacatccacaccaaaaacccatctgtacatcaccatcatcaaagaccaaaagtagataaaaccacaaagatggggaaaaaacagaccagaaaaactggaaactctaaaaagcagagcgcctctcctcctccaaaggaacacagctcctcaccagcaatggaacaaagctggacagagaatgactttgacgagttgagagaagaaggcttcagaccatcaaactactatgagctacaggaggaaattcaaaccaaaggcgaagaagctgaaaactttgaaaaaaatttagacgaatgcataactagaataaccaatacagagaagtgcttaaagcagctgatggagctgaaagccaagacttgagaactacgtgaagaatacagaagcctcaggagccgatgcgatcaactggaagaaagggtatcagtgacggaagatgaagtgaatgaaatgaagcaagaagggaagcttagagaaaaaagaataacaagaaacgaacaaagcctccaagaaatatggcaccatgtgaaaagaccaaacctacgtctgatttgtgtacctgaaagtgacgaggacaatggaaccaagttggaaaacactctgcaggatattatccaggagaacttccccaatctagcaaggcaggccaacattcagattaaagaaatacagagaatgccacaaagatactctcgagaagagcaactccaagacacataattgtcagattcaccaaagttgaaatgaaggaaaaaatgttaagggcagccagagagaaaggtcgggttacccacaaagggaagcccatcagactaacagctgatctctcagcagaaactctacaagccagaagagagtgggagccaatattcaacattcttaaagaaaagaattttcaacccagaatttcatatccagccaaactaagcttcataagtgaaggagaaataaaatcctttacagacaagcaaacgctgagagattttgtcaccaccaggcctgcccgaaaagagctcctgaaggaagcactaaacatggaaaggaacaaccggtaccagccgctgcaaaatcatgccaaattgtaaagaccatcgaggctaggaagaaactgcatcaactaacaagcaaaataaccagctaacatcataatgacaggatcaaactcacacataacaatattaactttaaatgtaaatggactaaatgctccaattaaaagacatagactggctaattggataaagagtcaagacccatcagtgtgctgtattcaggaaacaaatctcacaagcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaaacaagtcctgagtgacctacaaagagacttaagactcccacacaataataatgggagaatttaacaccccactgtcaacattagacagatcaacaagacagaaagttaacaaggatacccaggaattgaactcagctctgcaccaagcagacctaatagaaatctacagaactttccaccccaaatcaacagaatatacatttttctcagcaccacaccacacctgttccaaaatcgaccacatagttggaaataaagctctcctcagcaaatgtaaaagatcagaaatcataacaaactgtctctcagaccacagtgcaatcaaactagaactcaggattaagaaactcactcaaaaccgctcatctacatggaaactgaacaacctgctccagaatgactactgggtacataacaaaatgaaggcagaaataaagatgttctttgaaaccaacgagaacaaagacacaatataccagaatctctgggacacattcaaagcagtgtgtagagggaaatttatagcactaaatgcccacaagagaaagcagcaaagatccaaaattgacaccctgacatcacaattaaaagaactagaaaagcaagagcaaacacattcaaaagctaccagaaggcaagaaataactaaaaccagagcagaactgaaggaaatagagacacaaaagacccttcaaaaaattaatgaatccaggagctggttttctgaaaggatcaacaaaattgatagaccgctagcaagactaataaagaagagagaagaatcaaatagatgcagtaaaaaatgataaagggtacatcaccaccgatcccacagaaatacaaactaccatcagagaatactataaacacctctatgcaaataaactagaaaatctagaagaaatggataaattcctcgacacatactccctcccaagactaaaccaggaagaagttgaatctctgaatagaccaataacaggctctgaaattgtggcgaaaatcaatagcttaccaaccaaaaagagtccaggaccagatggattcacagccgaattctaccagaggtacaaggaggaactggtaccattccttctgaaactattacaatcaatagaaaaagagggaatcctccctaactcattttatgaggccagcatcattctgataccaaagccgggcagagacacaaccaaaaaagagaattttacaccaatatccttgatgaacattgatgcaaaaatcctcaataaaatactggcaaacaaaatccagcagcacatcaaaaacgttatccaccatgatcaagtgggcttcatccctgggatgcaaggctggttcaatatacgcaaatcaataaatgtaatccagcacataaacagaaccaaagacaaaaaccacatgattatctcaatagatgcagataaggcctttgacaaaattcaacaacgcttcatgctaaaaactctcaataaattaggtattgatgggacgtatctcaaaataataagagctatctatgacaaacccacagccaatatcacagtgaatgggcaaaaacttgaagcattccctttgaaaaccagcaggacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttacacactaataacagacaaacagccaaatcatgagtgaactcccattcacaattgcttcaaagagaacaaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccacactgcccaacgtactttatagattcaatgccatccccatcaagctaccagtgactttcttcacagaattggaaaaatctactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactacctgatcgttgacaaacctgagaaacacaagcaatggggaaaggattccctatttaataaatggtgctgggaaaactggctagctatatgtaggaagctgaaaccggatcccttccttacaccttatacaaaaattaattcaagatggattaaagacttaaacgttagacctaaaaccataaaaaccctagaagaaaacctaggtattaccattcaggacataggcatgggcaaggacttcatgtctaaaacaccaaaagcaatggcaacaaaagccaaaattgacaaatgggatctaattaaactaaagagcttctacacagcaaaagaaactaccatcagagtgaacaggcaacctacaaaatgggagaacattttcgcaacctactcatctgacaaagggctaatatccagaatctacaaagaactcaaacaaatttacaagaaaaaaacaaacaaccccatcaaaaagtgggcaaaggacatgaacagacacttctcaaaagaagacatttatgcagccaagaaacacatgaaaaaatgctcatcatcactggccatcagagaaatgcaaatcaaaaccacaacgagatatcatctcacaccacttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctaggactagaaataccatttgacccagccatcccattactgggtatatacccaaaggactataaatcatgctgctataaagacacatgcacatctatgtttattgcagcactattcacaacagcaaagacttggaaccaacccaaatatccaacaatgatagactggattaagaaaacgtggcacatatacaccatggaatactatgcagccataaaaaaggatgagttcatgtcctttgtagggacatggatgaaactggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagctttaggagatatacttaatgctaaatgacgagttaacgggtgcagcacaccagcatggcacatgtatacatatgtaagtaacctgcacattgtgcacatgtacactaaaacttaataataaaataaaaaagattaaaaaaaaaagaaaaagaaaaaacaaaaaaaacccaaatagaccgctagccagactaataaagaagaaaagagagaagaatcaaatagacacaataaaaaaatgatgaaggggatatcgccactgatcctacagaaatacaaactactatcacagaatgctataaacacctctacacaaataaactagaaaatctagaagaagtggataaattcctggacacatacaccctcccaagactaaatcaggaagaagtcaaatcccgaaatagatcgataacaacttctgaaattgaggcagtatttaatagcctactaaccaaaaaaagcccagaaccacacagattcacagccaaattctaccagaggtacaaagaagagctggtaccattccttctgaaactatttcaaacagaaaaatgactcctccctaactcattttatgaggcctgcatcatcctgacaccaaaatctggaggaggcacaacagaaaaagaaaatttctggccaatatccctgaacatcagtgtgaaaatcctcaacaaaatactggcaaacctaatctagcagcacatcaaaaagcttatctaccacgatcaagttggtttcaaccctaggattcaaggctggttcaacataagcaaatcaataaacgtaacccatcacacaaacagaaccaaaaacaaaaaccacatgattatctcaatagatgcagaaaaggccttcaataaaattcaataccccttcatgctaaaaactctcaataaattaggtgttgatggaacatatctcaaaacagtaacagctatttatgacaaacccacagtcaatatcatactgaatgggcaaaagctggaagcattccctttgcaaaccagcacaagacaaggatgctctctctcaccactcctattcaacactgtattggaagttctagccagggcaatcaggcaagagaaagaaataaaaggtattcaaataggaggagaggaagtcaaattgtctctgtttgcagatgacatgactgtatatttacaaaaccctatcatctcagcccaaaatctccttaagctgataagcaacatcagcaaggtctcaggatacaaaatcaatgtacaaaaatcacaagcattcttatacaccaataacagacaaacagagagacaaattatgagtgaactcccattcacaattgcttcaaagcgaagaaaatacctaggaatccaacttacaagggatgtgaaggacctcttgaaggagaactacaaaccactgctcaaggaaataagagaggacacaaacaaatggaaaaacattccatattcatggataggaagaatcaatatcgtgaaaatggccatactgccctaagtaatttatagattcaatgctatccccatcaatctaccactggctttcttaacagaattagaaaaaaactactttacatttcatatggaaccaataaagagcccatatagccaagacaatcctaagcaaaaagaacaaagctggaagcatcatgctacctgacttcaaactatactgcaaggcatgctgtaaccaaaacagcatggtactggtaccaaaacagagatatagaccaatggaacaaaacagaggcctcagaaataacgccacacatctacaaccatctgatctttgacaaacatgacaaaaacaagcaatggggaaaggattccctatttattaaacggtgttgggaaaactggctagccatatgcagaaaactcaaacgggacccctcccttacaccttatacaaaaattaacacaatatggattaaagacttaaacataagacctaaaaccataaaaaccctagaagaaaacctaggcaaaaccattcagtacattggcatgggcaaagacttcatgactaaaacaccaaaagcaatggcaacaaaaactgacaaatgggatctaattaaactaaagagctccttcacagcaaaagaaactatcattagagtgaacaggcaatctacataatgggagaatatttctgcaatctatccatctgacaaagggctaatatccagaatctacaaggaacttaaatttacaagaaaaaaacaaccgtatctaaaagtaggcaaaggatatgaacagacatttctcaaaagaacacatttatgcggccaacaaacatatgaaaaaaagctcatcatcactggtcattagaaaaatgcaaatcaaaaccacaatgagatactaccacatgccagttagaatggcgatcattaaaaagtcaggaaacaacagatgctgaagaggatgtggagaaataggaatgctttgacactgttggtcgaagtgtaaattagttcaaccattgtggaagacagtgtggcgattcctcaaggatctagaagcagaaatactgtttgatccagcaatcccattatggggtatatacccaaagaattataaatcatgctactataaagacatgcatacatatgtttattccagcattattcacaatagcaaagacttgaaaccaacccaaacgcccatcaatgatagactggaaaagaaaatgtggtacatatacaccatggaatactatgcagccataaaaaaggatgagttcatgtcctttgcagggacacggatgaagctagaaaccatcattctcagtgaacagaaaaccaaacactgcatgttctcactcataagctggagttgaacaatgagaacacatggacacagggagggaaatatcacacaccagggcctgtcggggggtgggggactaggtgagggatagtattaggagaaatacctaatgtagatgtcgggttgatgggtgcagcaaaccaccatggcacgtgtatacctatgtaacaaacctgcacgttctgcacatgtataccagaacttaaaacataattaaaaaataaaataaaatacaataaaaatagccaccttctcattttttaacataagcggtctcacatctcaccagagctactgtgccattgtttaaaggttttttgtgtgtgtgtgcccatttgtaatgtgcaaagtaatcaaaaaagaaatcgaaacttttcagaaaaaaaagtgagagtactaatattaatgagataacattaaaataataaatgttaataaggacacaaagcaactgaactctcatatactgtcagtgcgcatgtaaatggcacaactgttttgaaaagatttgacaatttctttaagaactaaatatattcctaccttaacctggcaattctactccaaaaaaagtgaaaagatatatccataaaaataccgttaccggaatgctcacagcagctacattcataagcaccaaaaactggtaacagtccagatgtttgtcaacaggcaaaaggattaacaaacctcagtatattcatgcaatggactattactcaggaataaaaaggaatgaactattggtccatgtcacaacatggataaatttcagaaaatggatgggtaaaataagcctatgtaggaaagagtacatactgtatgcctctgtttataatatctggaatagacataactaagctttggtggaaaacaatcaaaataatggggatttactaggatgggacaaaaccctgtgatgttaataatgttctgcatcttgactgtggattgcactggtgtatccatttactggaacttatggaacacttaagatttatgcactttactgtttccaaattttacaaagaactgaactctagttaaatgtatgcatgccgatgacatattttgaagaaagtattcagatacctgcaagttactttgtatagaactaaaaatggctggatttatgggtggaagaaaggatgaataaatggaaaaacatgataaagcaaatataggaaagattaactatcaaatttagatggtggatacatgggtattcaccattaactttttcaatgtttcttgtatgtcagaaaatttgtaataaaacattggaggggggaatgaatctcaaaaatattaaataaatgatataaattacgtatgagttatttgttataactgagaaagctgaccaaattattatttctggattaggttatagactaatttgcttcatttaaaaaatatttaataactggccttttaaaataaatcttcaaatctatatatttaaataatatatttaaaaccctctctaaaacacacaaatacgtcttctcagaaaaaaagctcactatataagacaaattataatctttgaaatgtctatgataagcattctgaatcagagaatctcaaataggctgaaaaaatacatcttaacttctaagtaaaatgtagcatttccttcaactatggatataggtaagaaaccacagaaatattatcagtaactgtaactttttccacaatgaaaatcgtactggaatcacctaaggaacttaaacattaatatacaaattctattccacccattcctttttaattgatattagttcaatacagcctttatactgggacttttaaaagtttctcaagtgattctaatgtgcagataaggttaaaaaccactagtggaagaatgaagaatagccatgcttgtttcagtccaaatattaccagagtcacacttccatacaattcacaaaaagaaaggcacccttaagaacattttcatcataactttgactttcgttgttaatgtttaaaataatattctattttattcctgcgataaattttggaatttttgaggggtatacaataaatttgtaagaaataaaacccattttatacaactaacccacggaagaaacagttttatcttcaacttaaaatagtcaatttgtaaccatattcaacaaagtatatgagtcaagcactgaagaatgcaatcctcacttacatcacatcaggttatacaaaattaagtaaacaaatattacataaatgaatgatgtcctaatacaattcaatacagcaactctgaataatgtgtctactgagtgttacagtcaatactagatactggtgatactaacaatatagaagatgcaatagagtatgctgattaagatcaaaaactatagtcaagtaagtctcatccctagctctaccacttaacattagttgcacctttttagcaagttacttacctcccttagcatttgtaatacggaaatagtgttaatcctcacaagatccgagtgagataatgaagataaaatgtcaacttcttagaagagagtaaatgtataaaaattgggagccattattataagacatatagtactcatcctagagaagttcacagcctaatgaaacaatagcaaaatatctgtaccatattggacaaaggattgatacccttaatatatataaggttactaaaaaatatttaaaataaaaatgaacagataatagaaaaaaatgaataaagacataattccctaaaaagtatatacacgatcaaataaaaatatccaaactcttaagtttagagattatttcactaattgcagagcttcagagttacaggatggtgaaaaaaaaattaagtatatgggtgtaggtctgaattctccaaagtagcttttccatcattaactgagatagcttaatcccatggtttggctcctctcttacagcactccccttattagttactgcttttattaccaaacctcagtgaagaggtcagcattttgtaggtcctattgaatctttatccatgctcttaatccactgcagaataatcaagagtggttttgttctcactctgcttcattgattttattctaatctttcactggtccctaattagtgtggttatattttaaaaatcctcttttatgacaatgacaattttttattctcttctttgtacctttccatattttctataacatttttataatcctagaaaagcacatgtagaaataaaaataagtgatctgttacccatcctttcatttcctgatgctcacagtatagcaaaaaaatacattaaagttgattcaatgaaattaacattttagccatgtacaggactacgttggcttctctgatataaaagtacccagtttgcaaggaaatcacagctctcatattgatggtaacaaggtatttgatcttaagcaagacatactcagcctctctaagctttaacattgcacctataattgtggatggtacaagagacaacttctaaggtaacttctaaggtgacttccaggtatagaagtcaagaattctaaatataactgtttgaaaatccatgaagtaggtattgctttccccttaaaagtaccaagattccctttcaagatgccaattattacaatgtaatctcatttattaccaattcttgtttataaagagattttaacaaatatgaatacatccattaaatataaatgtctatttatatgatttaatatacaataacaatttactctttgatcaaaataattttcacatcagaatcaaaaaccttttatatgagaatcaaaatatttggattacattatactttatatctccatgtatttaaaggagaagtaaaaaatgcattataaatctactattattgtctaaaatatgggagaaaaactgcaatagtcaataaactcttgagttttggaataggttttgaaccacaaattcttaacaggaatagcaaaacaactgtacagcttaaatacagtgaagatccaaaaattacaaccagaactttgcaactgttagatctgctaatcaaagcaaaatgccgtctgttttgtgcatacatacaataataagaataaggaaatgaataaaaatataagagaaaaattaaagacaacagaaattagcaacagaaaacaacccttaaacatacatacataaggctgcatgccccaaaagcaataaactgtcttataggaagaaaagtatcctagaaatcaagttaatgcagaagcctctcagctaagccttagcatggtatgagaaggaaaagaacacaattctcagcaacgtcctgaccttaaaaagtcccccaaaacgggaggaaacatcgtgagaaagttaggaaacataaaacaaggtgagaataaataatagccaagtacattctacttcgccttccacaaaaggtttgcagcaaaggtccgtgttgaaggcacaccaacccaccacagactttaaaaaatctatttgttggtatgccttaacgtggggtaggactgcaggagaaaaaagaggcacaggccaaacaagagaaactagaaaactacctctataatactacatgcagagggagcacagaagctaagtttaacagggaaatattccctgatatggaatctaatcttcctatggtgaaaaatcaaaggtcagaagaataaaaaaaaagaattaatcttaaggaaaaaatagacatctccacatcatttgaaaagagcaagcataaagatattaagagatcaatccaatattaagttctcctaaggcacttaatgaaattctctgcacctaaatcagaaataccctgactgttccgtatacgggcttgtccatgaaaagatctgtatttgggatctctgtgttaatgcacctgaaagtttctgaacacacatactgaaaagatttctgaacaaaccatccaactagcatatctgacatttaaaccttgagatcatgaaccattagaaagttactctattcaaaggtcaccaaatcacgaacttacaaaaaaactaaatggcttattctacttcctgaatagtcttataacactgaagcaccatcagttgcttttggcaatgcttgccaatttttatgctggaagttatgaatgagtcaaagaccccgataattaagcagggtaaggacagggttggttattcttgctcatgtttaataaatgaaataaaccactcgaaaactgggtatcattattctaaagccttaaaatgtatctcatttttgaattattgcttaagaagcacaagttaaggaatcaggagataaacaaaaattctgttagttccatgactagggaatataattttagtcaaggagtcagtagtttggcttgtacagtgttattttccactgctgaattacttgtacacttaggtctaaacattttaaaaaacatattagtacctatcactgaaatattgagaaacacttacattctgcaaactaggtacaagtgcagctaagaagtcagtgcctattacccactgttagttatacagtagtcacagaaaatttttcaaatagtgacaagtcaaaggaagccgacagcaactgtgaagaagattacaattttctaggggcaaggaaataatttgagagaagcctagtgcagcctttgatttataaattgattttaaagaaggcctgccaagttatactgcttaggaggtcatatataattgcataggttttgttcaatcttgaaaaataagtcaaataatcaaaaagcaaacatcagaattttctttaagaaggtaaatttctgggccataagtatgattggtatatttggacccttgtcctacatatcttcatctgtagcatacaacaatgacaattggcccaagcttgagatttccccagaaggcaaagccagagacaaggacatgtatggggaaaatttattggaagtgaactcagggaacgaagagtggggactggaaagagtgaaacacagtagggaatgccaaaataaggatgtgctttcaagctggttattgtagtcaatggtagctatgtaagcagctgtagaaaaagttcctcagaattcctgtccaagaaccagaatgcaagagcatttttttccggcttccatgccactggctgaattgccctaaaggggattcagtctctcacacttacaggtgtagatatgtatgtatgccttgtggcttccacaagcatccttggtcttacagcattagaaaatccctggggcaaaaagaagtaaagtggcggaaccgcagtgaattgttttgtcaacatacaccaccacgaagctgactgaagcaatgtggttgagtaaaaagtgctgcaaaaatcaaaaccagaatgagatatcatctcacaccagttagaatggcaatcattaaaaagtcaggaaacaacaggtgctggaggatgtggagaaataggaatgcttttacactgttggtgggagtgtgaactagttcaaccattgtggaagacagtgtggcgattcctcaagaatctaaaactagaaataccatttgacccagcaatcccatgactgggtatatacccaaaggattataaaccatgttactataaaaacacatgcacacatatgtttattgcggcatgattcacaatagcaaagacttggaaccaacccaaatgtccatcaatgatagactggattaagaaaatatgccacatatacaccatggaatactatgcagccataaaaaaggatgagtacatgtcctttgttgggacacggatgaagctggaaactatcattctcagcaaactatcgcaagcacagaaaaccaaacaccgcatgttctcactcgtaggtgagaactgaacaatgagaacacttggacacagggcaaggaacatcacacactggggcctgtcgtggggtgggggggatggggaagggatagcattaggagaaatacctaatgcaaatgacgagttaatgggagcagcaaaccaacatggcccatgtatacatatgtaacaaacctgcacgttgtgcacacgtaccctaaaacttaaagtataataataaaaaaaaaaaagtgttgcaaagaaagtgaagttggaagcaagaattacctgatttctaggcagaaaaagacaagcaactgacataagttcaattccctaagagctaagtaaatatattttgaaaactttttacacatgaaataaatttatataaagctttaatggtagtaaaagtgttatccttgaaaaatctagaacgtgtgtatacataaaacaacgtccattttgagttttattattgaactttgagagttctttatatattttaaacacatcagatatatgatttgcaaacattttccagtctagcttctaattctcttaatagtgtctttcaagaacagaaatttttaattttgatgacgaccaatttatcaatttgttcttttttggaccttgcatttggtgttatactaagaaatatctgcctagcctagagttacaaatacttttccctgtgtttcttctagaagctttatatttatgtttttacattgtttataattcattgtaagttaatttttgtatatggatcgatgaggtcattttcacttacagatatctaattgtctcagcaccatgtgttgaaagactgtccttcctccactaaactatctttgtaccttcgttgaaaacagctgtctgtatatgtatgggtatatttctgaattatctattccagtgatctacttgtctacctttatgaaaataccatattatcctgaaaaaagtagatttttaagtcttgaaatcaggttgtgttagtcttctaactttttttctttttcagagttattttaactatcacaggacctttgcagcctttgcacatacattttggaataattctcttaatttcggggtttttttgttttttggtttttttttgagatagggtctctctgtcacccaggctgaagtgcagtggcatgatcacagctcactgcaaccttgagctcctgagctcaactgatcctcccacctcagcctcctgagtagctgggggactacagacacgttgcccccacacccagctgatttttgtattttttgtagagacgaggtttcaccatgttgcccagatggtctccaactgctgggctcaatcaatcttctcgtctcggcctcctgaagtgttgggattacgggtgtgagacactgcgaccagccataattttgtcaatttcttaaattaggaaggaaaaaaaaaaaaagagctgttgggattttgattgcgaatgcattgaatctctagatcaatttggagaaaattttactagccaaattctgaaaacaacccatatgcccatcaaaaggtgaatggccaatatgtggcacatccatcaatacttaccaaaaaaagaatgaactatattacatgctacaacatggttgaatctccaagtaattctgccaaggaaaaaagactggcacagaaaagtacccagaattatataagattctgtaaactgcaaacaaatcaatggtagcataaagcacatcagtagttgcctgaggccctggtggaaggttgagaaggactaaagggagggacaataatgaggaaggaggtgactgggatgtgatggatgtgtttattatcctgattgtggtgacaatttaatgtgtgtagatatttgtcaaaactcagcaaagtgtacaccttaaatacattcagtttactgtatgtcaattatatctcaataaagctatttaaaaaaccagtcattctgatttatgaacagtaatggatctacacagcagtagatgtgtagaaactaacagcttctcgttagttttctcaacaattaggaacttaaaaaacacaaaatagtaacaatcctcacagtaaggacaaagaatgcagaagagttcatacacccaacacttaaaagaataaaactgtattacttttatatgtatatatagatacataaatgtatatatattggagaagagggaaagatatatgtgagaactaagatgttagctatttccccataactgttattaaattatgttgagctaggaaagcacttaagcaggaaagtatgaacactgccaatctcagaatgtaacgcttattatctttaaaagcattttgttactttcataatacctgaagtgaagtaataatgtcagtcacttaaccagatcttagagtataatatcttcatcttaagtactattatttccagtattttaataatttccacaaagtgccagaatgtgatcttttgtgctatgatgacacttaaattaatagcataattttctggtacttgcaacagttgttttcaattctgatcttttttattcttccctataatacttgcagataaatcccctaataatcctttttttttctttatctttgggggattccaaaagtataaatagaataagagaatattaagaaataaagctttttaagaaatttaattttagtattacttgcaatatctccatcaggtatctttaaacaggtgataaatctaaatattcagttcatttgaagttacttacaggcttcattgatgttttcaactctttctacaggtatatctgtaactgaatttgtctggtcaaacactgttatctgtcaagcaatccgtaaagaacatatcacctcttctatacttaagttattttgactataactgatcactgatcacccatcatttaaaaaatctgctagtgtttttcattcatgtgaaaagggtatctgcccacaggaccaaatgaaacatagtcacctcatgtgtagccatcacagagtaactatagcaattccacttttgaaaagtgaaagaaagaaagctcctcaagcacatgctgaaaataagtaggtactttcaatcttatccttagcatcctatattgtgtactattcaaaaagaaaaaaaaaaaaaaaaggccaagccaattagtggaccagaaaaaaagaaagaaaaaagaaaaaagactagctttttgttccagttaggttatacccaaaagggtgctaccatccataaagaaaaaagttagctatatctaatttttcatcactctaaaatcaatgaaataaaaaaagatcataaaaacctttacatcacataagttcaaaactaatagaaagaataccaatttgctgctagctgacaatgttattctcacagccagagccaaggaactaacagtgacatcatttaattaattaattaatactgtctcagtgtctctactatttacaaactccaatattttccaattctatatctatctaataaattggtttggcttctaaaattcaacttttattttggcacaaaaagatgaggggggaatattttctagctctaagtattaacatttcttagtgatgctaggaggtcatatttgaattaacactttttgtcactgaagtatctatcatttctgtcttcaacctattggatctttattctccaatgggcatgtttttcagaaatgaaggtttaaaacttataaacacatacatgcatgcatgcacaagcatataaacacccacatattccaaattagcccctggattataaaaaaaaaaattcaaatagacatatagacatagtgtatcaatttaccagagtccctgtcaggaacaaaacatgagagaatgttaataaattatactcgcattaaaataaatttgcttcactaatattgaaaaaaataatttttatccaaaagtattttaaaatattgatcacaacattaaaggagtcatttggagactgatactcacatgttttctcttacttaggacacctgctatataagaatattttactgagttactccaaaccataacattaagcattaagttcatcaaagtactcacaatatattaaccaataaaactgtgaaaccaaacagtatttctctcaacatctcttatctctgttatttatagtacaatgtatatgtagtcaccttccacatccacgtagcctggtgagattgaccatgatttttcattaatcatccctatttcatttttgagcatagaaaactccttgtttactgcacgtaaataaaatgctgtctttaaagtctttaacatatacataattcaatatatagataataattgctgtctgacagatatgtgtgtataaatccacaaatatacaatatcattacacatggagagagactacttctttgcccatattagctctcactatattaagagttcaccagtttacaaactgcattaactccctacatcactttgtacatttgtacagcattttacaattcaaaaggattttcatatacaacaccccaatttgttctcatatgtaatctatgacacagatattctttctctctttttataaataagtaatttacacaaggtcatgcactggtaaagacagagccagaatttgatccagactttaagactctgtattctctttatactatgctacagtggctgagcagatatgaagcctactgtgaaggtctatagtaaagtcatatttattaacatcagcaagtaaatcagttaacgtaccaatgaaggcatttgattaaaaaaacctgttccatgcaactagtttctttgggtctttaaattcatgagagagctttgccattccacaagtatctcatgtgctcaaaatgcacagatctcaaatcttctacaaagcttaaaccaatttttataatcttagaaatcaactgaaactatagcgatataatatcttctttaatctggcaagtaagtgagattcaaagtcatatatccatcccactgcccataaaacacatttacttaagaaataccattggtattttagtatatggaggttgaatgagttataacaacttagaaaactaaagaaatggaaaagttttttaaaaagtgacctctaggaataataaaaacgagggtgacaaaggaaaattaatcaccgttaaccacattacattagacataagtaaccacattacttatatctacataggatacaaatatcttcataataatgtaaacactgaatattattatccaaattacaatatagttatttggggaaagcaggaagataggatggagtgagggtaggtggagaaaacaacaaactcctcattatctacggtggaatttagtagataatgcctaaaacaaaaagtagtataaatacaaaagcatgtaatgacaaattaactactgaaagaatcagctaacagccaaaagtgtttgcccctggagaaacaggtgagatgaaggctatgctgttttttctaaaaagaaaacaaaaacaacaacaacaaaaaaccttgcaaacttaacttctgaagctatgttcacatatttgatcaaaataaaacattttaaaaaatcaatagcttgcccacatcctgatgatcaactaaaaaatacaattaaaaagattgcattaaaaataacaaaaattttaaaatacttaagaaaaaattcaacaaaaatatgtaacatgtagattaagaaatcattgctactttactgaaggacctaagtaaatgtagagataaatgtttttctagattttggccatattaattcttaatttgctggataaacgtaaacccaattgtaactaaaacccaagtaattctaagaattatttggaataacaaatgcacagtattatcaatgatattttttaaatgaaactttgttaagtgacaagcatagtttcaaaacaattatacaatgacacctcaatactactgcctaaataaaagcattaatggtaactttacattttaattttagttgcttgtatttttcctctttctcttcttttttagaatcaatataggctgctttttaaataaataattagctatcgagaaagaaaaataaaagaaaggcagctgataggtgactaagtctataggtcaaatgactgctacgcttatactttttctaccatatcacataatctcaataataaattttctttgttttgatccctttgatgtcttttcagccataccactgtggcaacagtaagactgccaacaaagaaaaagcataagaaattaaccaatttaagagtgaataaaattccactactgtaagtcctccaacaaaaacagcagaggaaaaaatggaaagaaaaagaatccagttggtcaaaagaacttccacaggattattacagtgaaaaactaggggatttgccccaacactgtgtttgttttaaactcgatttatttttctttacatatccatgaaaagaaaaaaggttcaccatttccatatacagtacatacgaactgaggcaaagggcagttatgtgacttgtctgaataatacaattaaattaatgactgaattgtaaacacaacttagaatacccaaatgctagtatactgctctaactaatggataatgctccctgctatgtaataggactgactcctttaattacaaattcttcattcaccatcagattatcagccagaggctttatcattagttttgctcttcttgcattcatggcattattccaagaatgtaagatttccatgataaaaaaatataaagaccactatttactacaccacactgaacctgaggattccaactgcccatggcaagaatacttcaccaagcctgcacttagtggcacacttacaggcaaaaccgcaattttcacatccatttttgcttgatcagtgacctggacaaaaggaatttcgtttttttataatcataatatcagtgcacttaaaatctgacatttaggcattctacagtctcagtcaagagtatttacacatctgacctgtatgtaaaattctaaagcattaaggatatattttgaagcatttgtgatgttagaaagtagaataaaattatgagatgttctcatcgtctatgctaaaatctataaaagattaactgagcaaacaaataaagcaaatatctagaaagaggtgcttagacacttgtctttgagaagcactttgtgcttctttggcacatatcatggcagcaatagtagcagcagccttgcccttggtgctgatttcttactactctaaatgtctcctctgagccagaatacactggctgttgctgatcatgctgtgagacacctgcactggctactaggcttgtcatgacgcacaaaaccctaccatcttcagcttgacattgtgcaagttataattattcatccaaatgaatatgtcagagcagcagcagcagacctctcatcagagcaaaagaaaaatacatcaaaacattatcaacccagcaggaagacagggaccataaggaaaattacccatttttaatatggatgccacaaagccatgtctattatatcacaaaaaaaaaagaaaaataaagatcttccaagtttaaagtccagaaacactgactccaaagagaaaatacacaaaagcagaaagggatttttaaaaaatcaattatctgaaatctatttaccatctcttaaatctaactctgctattaaactacaacagtaacatttatattgcttgagagacaactgtttaaaaattgttttaaaaaaactcccacaagcagaattgttttcagccagccaattaaaaaagattacacataacaagaagtctcacatttcttcttattttcaaaacataaactatcaacactcttatcatgtctaaaagactcagagttcacactgctggtaccatccaaagtccttatgatatacagccagaatcttataggtaaatgatatattttttaaactttctaaatattaatggcatgtgtaaaagaaaaactgtgaaatcagcccccaacccgcacaaatgaagaagacacattcaaattgtataagcatatagaatataggggctatctcatacttaaatacttaaatagcaaaaatacctttctgaactatagcagaatatcttttcagaaaaatatatgaaagattttatttgaaacacaacagaaaccacaagagaaggatgtgaccagactgaaagttaaactctgtatgacaaaatatatacaaagttaaaagacatgccacagagatatttatatcccatataactaacaaaaaattagtatcaaaatatagataaaatgtttataataaaaggaaaaaaatataggctaaggctatggacacaataataactataaacttataagaaggtcagactaagatgagactaaagcttgcaaagaatatgcattgctgaatgggaatataaacttatacaacaatctagggaaggcaatttgtcaatactgcgtaaccccaaagaggcacatagcctgaaatccagcattttcacttctaggaaaaacccatactaaaagtctcatacatgtgcacaaggaaacatggaaggatgttcactgcagcactgtttgtcagaatttgtgaataaccttatcagtagtgctacagataaatcaagttgctgattaacataatggaataatataaagtatttaaaataaatatagtagacaaacataagattatggctaaatcactgaaattatataatgttaaaaaaagagactgcaaatatggcataaacaaatatggcaaaaagtatgcacggatggcctatataccaattttgggtaaacagttactacttaaagggagagaagcaaagaaaggaaagatgggaaggagggacagaaaagggggtcaggtcttagctattcttaaaacattttatttttaagacaaagagaaatatagatgtatctgaaccaaaagtgacaaaatattaacatttgtcaaatctgagttgtgataaaaggctgttttaatttatctgtattttgcttagaatttcagtatattccacaaattaagaatttataacactcattactacgaattctacattttcttagagttactacaaaacaaaacttgtatgacccaattaaacctgaaacttaaatttgaattaatattattaatataatatttattccatgcttatatgaataaggcactgagcatgtggatataaaatttaaaagaaattgccttcaaagactttccagtctagtagagagtcacaaactgattttgttaaataacaaaataaagtactaaacaatcttttcatggcattgcaaacttttccacagataaatgcctggggaaacttctagaattatctacatctaaaacacaaagaaactcataaacagtgtatttttcaaccttggaattgtgataaatattaaagtataatttagaaataacacctggaaagagtaacacaacctagctataatattttctcatgatctcacttaaaacatcaagattgaacttccagagccaaatagaaaatgtgtattttaaaaaaagggacatgggtctcatgaaatttttttaaaataaaaaaagaaagctataaaatttatgcataattccaattctttaatagaaaaaaaaatcaacatagtattttacttatagcatacatcaaaataccaaaagcaaattacaggctctctcttctctattttgctatgttttctcaacttccattgtggggagattgggactttaaaaaaaaaaacaataaaaggatatgagaaaaataatttttggataaatacaatatataattaaaatggcattttggccttgacaagactatttaaatcctattaggctttttatttttttactaatttcttatatatttactttactcatgtatttatgttttaaaatacaagcataattttttatttaaatctaaccaaaattttatagccaaaatgagtagcctccatttacggaatatttgtaaaatgtcactagaaatgttttttctctttgcctaagaataaaaatgttctctccattttgctatcaactgccacaatttacttggtgaaagaactatgccctaactaatcacattgtgccacatccttaaaaatcacacacatgaaatggtgatagtactaccgataatcataccaccttatatctatgttatagtttacagtgcacttctaaaaaacattatcttgctaatatcatcaatgtactgcgaaattcaactgacagaagcaggagaatcttctgtattctttactcaaaatattgaatgttctaaagcacaaaataaaagaatataatcaaagtttaaagatgaactaaggacaaatactttaaaacaataaaaatggagtagaaatgccaaggtttatgttttcagtcataattcattctcctctgaaaaggattctctgatattatgtaatcaatgtcaaaagttttagcaatataaaacatttcactcaacttttcagttaccattcactgctttctacagagttctttggaatttaaatttaaaggaaaatgtctgtcaaaagtgcttctgcatgtttactgaaaatgaagcataaatatctacaggctggatggtgtgtgtgtgtgtgtgcgtgtgtgtgtgtgtatttatgcatgggtgtgggtgtgagtgggtgtgtttgtgtgtgcatgtagagagggagaaagaaaatggacattaactgtaaggaaatataaaagaagcattatagaaggtgtgtttataaataaatgcttaaggaaaactgaaaaaacaaagattacttcataacctataatgactacctaagtaaaaacagttacagttggccctacccacggattccacatgtgcagattcaaccaactgcagacagaaaatattcaaaaataaataaataacataactatttacagtataacaactacttacatggcaaatgcattgtattaggtattataatctagagataacttaaagtatacagaagagtgtgcacaggctataaacaaagtcccatttatataagagatttgggtatgcatggattttggtatttacagagggcccaagaaataatccccccatggatactctgggacaactgtactttttaattacttaaaacaaatttaagaatttacctgaggagaatttacctgaggtgtccaggaggcacaaaatggaacaggaaaatccacaaaataatctggtgattctgcaggatactattaaaaaagcataacattagaccatttttgcttctgtgtgttaatatcactgaggtattttagaaaaactagatgtattaggggccgggcgcggtggctcacgcctgtaatcccagcactttgggaggccgaggcgggcggatcacaaggtcaggagatcgagatcatcctggctatacggtgaaacctcgcctctactaaaaaatacaaaaaattagccaggcattgtggtgggcgcctgtagtcccagctacttgggaggctgaggcaggagaatggcgtgaacctgggaggcggagatggcagtgagccgagactgcgccactgcactccagcctgggcgacagagtgaatctccatctcaaaaaaaaaaaaaaaaagaaaaacgagatatattgggggaaaacatattattataactgaaaatgtattacatataaatatttttgctccactttcatagtgatgtgaagagcttatttatagtcaacctatggaggtgcaagtttggtgatttggaagtgccaaagcaatcggtgttgagtaaaaggtaatgaattaagtcagcgttgtgtcagctgctgaagttatgatttgaggaatgaaccaaactggatctctgtttatctttaaaataagagatcaaatgagttgatatttaattttcttctagtcctaaatttaatttcaaatagcatcagtcactatttaaataggcagtatcagttaaaggaattaagaaatacacaaacatgaatacatatagctgtcaatttaaaaaattattttctatattaaagatattaattttagcaagaagataaaaagaatgaaatatcttctggcttattaagaaaaaataaaacagtttttagcaagaaaaacctttgaaagattgctaaatacaaaattatttcttcaactagtcatataaaaactggcagtcatgaggacaaaccaagtttttaagttaacaaaggcaaaagataaaatttcttaaaatcaatttccttattagagaatcatacttaatgatttctctataatccaattctgattcttcaaagtcacatgtaattaaaaatacccatttcttttcattaaaaagctaaatgtactgaaagaaaattagttttaggaaatctttcatttgacaaattattaaaagaagttttaggctttcacttttttcagcctcttatttttcagtactctgctgggtaagtaaaagggaagaaaaaaatcactacagtatttaacaaacatttgaaatcaacactttcaaaaaaattaacatttagctacaataataagttggctaaaaagatttactatcaatatacactctgactaatggaatctggctatgtagaactaattaacacaaaggcaaatagataagaaatcatataaaaatattccagtggtctacttctggaaaaaaaaaaaaagaaaaaaatatcatgctgaaattaaaagaggaagttctatttcagacaattaaaaatatcagatgatgtgcttcagagtatcattgctgtaatcactggaaaaacaatttgtatgccatatttaaaaatcgtgattatctcaaagtaaatgtagacagagacctcagctttctttggttccagctctgctaactaagttgtatgatcctgaacaagtcatttaatttctctggctgtttcacatgtaaaaatgacaaaactcaactagaagtgttacaaaatctcttttccttctaaaatgtcaaaattctttaaaaataatgtgcacttgaaacctctgtgggtcaaaaatggaaaatttagttcattttgagttgctatttatcttagtgatgctgacaatgaacaatatcaactctctaacttcaatgaatcatcaatgtagataaaataagactaatgaaatgtttactgtatttggagtagatacacaaagtaaagtatctgtggccccattaagtacatacacagctcattatgctaaaagagagtaagatactacattcaagtaggattcagtatagtaaatggtatcaatgtcctgatatggaaagagatccacaaacagttaaacaaaaaagcaagttagagtaaatatatgatcctacatatataaatgagtccagtatgtagtttctgagataatgacatctttcaaatatatttttatatttgtaatacaatatgtatataataaattagactgatctttatgcaagtggctttacttcatatctgagttaaatgagtatttgcaatatgtgttaattacattcatgtgcaaaatcaattttgtttatataacaaacctcacataacagtacagagcttaaaaagaacatttatgtaagtctggatgatttatcataaatattaaaatataaactagcatactagatattcattttcagaatagcttctgaattataatagtattaactacagtgtagatgactaaatacaatataagaaagtaacttgatcaaaattaagatacttttcaataataagttgtataggtatatataaaaccactgacaactaattgtcaaaacttttcctttcaaaagtaatttacaacaacaaaagctccatatcatataggaatattaactgaaaaataagtatagtatttaattattttcaagtaaaacatagttctccaaatctcatttgcagaaaatcaaatcaataactaaaaaaaaagattacataatattaagtatatatttttatcacacacagtattttttagactctataatattaatatattctaaaacaaattttaaccaagtctgttctgtgactagactacctaagcagtaaggctgatccccaagtaaatacatacaaattgcagcagagaaagagtgcccaccctctgatgcatatatgtaatttgtttttcaagtagtactgatcttgattgaccaaagctgaggaagccctgggctgctacttttgtaaagcaaaggtaattcagtactgaatgcactgtaagcattgcataaaaatatacctataaaaaccaaaaaatttatctggtttacttctacttatttattatttacatatttacttttaataaaggacatctagtcaaaataggtatttgttttctttgtgagtttcttggagatcgtgaggggaagtggtagaattgggaaagtatgtattccagaataaatagaacaaatgcatttatttactgtatatttaaaaaatcaagtaacagaaataaaggtttgtgtatttatgaaaaaagcctactttgaggtatgttattaataaaaaaaattcagcattccacttaaaacttagtttggattaagattttgcataatatactcttaacatacagttaacgtttcaactattagtgtagttgactgacaatcgcaggcccaatttctttttttttccctaaaatttttgtttcctaaaatatttttcagttaatattcctatatgtggagtttttgttgttgtaaattacttttgaaagtaaaagtttgacaattagttgctggtggttttatatatacctatacctttttcctaaaaaaaaaaaaaaaaaaaaaagacttcctggttttcttcaaattctcatgtttccccagtgattactaggtaaatgattaatatgctgaacttgtttattctacttatttgtccaaattcacaatctagaactaacttttttttcctaaaaaaaaaaattatcacatctcaaagacagctatggtgtatatatgaaagctaagctaaattgagaaataaagattctaataaatcataccaacataagattcagttacatgcttttgtttttccaaaacagttttttttttctttttttgccaaattccttcccagcttaaataaagctttctcttctcttttgcaagaatatctataaaagtgcttcgtaactacagatgttgcaaaactgaccctggaaaatattctccagagaaatactaaaagcatcatcttatctaccttgaaaaagtatagaaaaaagcagacaaaatggaccatattaaattgtcacaacctcactctgaatactgccaataaatgaactaaatgtcatcaacttggattaaaatcttgtaggtatagttaaaggcagcacaaatttacagcaacatcttcttaggaagtagaagagcttgtaaaaatgaggacagggtgtatttaaaatctttagttttggtcttcatagaaaaacggctaattttactaaggtacaaaatataaacaaatagagctttgaaggaaatgacagaacccttgccactggcaacatgtgaccctttggaaggataaaggcaaatttctcttaaaaaaaaaaaaaaagcacacttttacaaactaaaaaataaaaatcttttcaatttaataaaaataattatctaacttattttacaaataatgagatttccatcccactaattttttccaagacttatcacatatggatcttaaaattagacctacatacatattctgtgtgtgagagaattagtcatttctcaacctgtctgttatagaaccactataagatatcaacttttctgtgtcatccagtacagctttagatattaattttctcttgtggaaagcttaaatgccagacacatttttaaaaaggacaaacacaattgatcttttcatcactacaatcttctgaaaaagagttgattgattgactccaagaataattaaaaaaaaaaagttggacatcctggttttcttcaaattctcatgtttctccagtgattactaggtaaatgattaatatgctaaacttgtttattttacttatttgtccaaattcacaatttagaactaaaaaataaagatgaaacaaccatgttttgtgccaataaaatttgtgattatagatcactatcctataagggatctataaatagaggcataacctctgcaaattcttaaaatacttaaaaaaccccagccaaagcaaacaaactataaaaaagtatgcatatatgttgtttgtgttagggagtggggatcacagataagaataagaactacaaaagaaatttatagtaacagctgaatgcaaaagattttctcagtacaacttgggatagtggaagtgtccactgtcttctacatgttacatgtaggatgttacaaaattaacaccatggtactctgagtctataaaattgtaactgtagtatttgttataaagtctgtattttgagcaaatttggactaaaatatgacataaaactgtctaggcttttggaaacgtggtgaataaattctttgaggctttccaaaatcaatgttttaaagcatgatatatgtatttttagatgtaactagcacttctttacattgagagcattcacagagttcatttcacaaagtattttctgatcacaataacagtttaacgaggcacatacctttgccttcaacttgagagtgattaaatgctctctaccagaagcatcttctgcttttaacttgatggtactgaagcaggtatccgcatacacaagtctggtgagcagaggagaataaaaaatgatcacaccggggagagctggagaggggaactggagatggttgaatttgaaatgaaaatatttgctatattcctattaatccattataaaaatcagagcaatttctgcatgccaaccctttctgctgctatagatttactgccgttcatataccagcctagcacttaatgcagtcatatatctctggattatttacaatgtgtgtcaaggctcatgctgtggtcagtgagcactatgtttcagttttccatcactggaacctttggcacacacagcatgttcctgtcagcctctacttatgtacacattaaacttcctgtcaaactctttgatccatttctgtagtttcatacagtatgagactttaatgctccctttgtttttctcctcaatgaacttctcctatattatcaataatgttaccgtacaaaaatctagctggtatttgttcatatactcaaattgatcctctaaggaaaatgctgtataagcacaggtacagcctggtctcctaacaataaattttctttctgcacgatatatagcttctgacacttaacctatgcatgtattcaagatgactaatattctaaacatatagcacaagcacaactgctttggctttaagttaccctaaatgcatgaattttctacaatggaaaccaatatcctttgaaatatataattctgtaaaaatacggtcccttgagtagcataagctactgccaaaaaggttcaaatttagcagtatatttactagtgaactgggcatatggatatttttgacatttttacaatgctattctcttataaagataaaaagtagtctaagagtattgcaaaacttatcacccaggctgatagtaagacccattggagttcagaatataagcctcctaacttaggaaatatattttttaatatcactatatgccatttagatactgaccaggtactatataatgataacatgggctaatttcaagaaatgcacaatgaagttgtgaaacactgtaatgaaaatatgtctaaatctgaagatatctatcttcaataatacaatggaaattttatcataatctgtagaaagtctagggtcttagaaaacaaaactattctagaaagtgttttatacacataaaaataacaatgactatattttctttcagctatatctgtaaatgcttcacctccaaaaaaaattagaatgtctttatcacgttttaccatatgactctgaagttcagatatatcaatacctgactcttaaaactcccacacttcagattcaagatgttaagcacatgcatttatattctctacttccagaaaaattaatcatttaaaaaatgtttcaaaggtataaacctacagttacaaaaaaagaagaaggaatagtattaattgaagcaaacttcaacaacttttaggaaaatgtagagtagttaaaagagcactggctgataaaacagaaaagaagagagaacaaggactccaggcagaaacagctggcaaaaatgcagtgttcaggatagagagtatgactgatatactggcagaaattatgggaatttttaagtgcatgataaaagggggaagaagaaactttaaaccaaattataaacaataaaactgcattaaaaatggtaattactctgccactaacttttcagttaaaaatatttatgtagtcgtaaaaaattaaactgttactagttacaatttttagaatccaagaatacgcaatgctaaaagacttaattatagttatagagactaatgtaaatatatttgactactacaatttaaaatgaagaattgacaaaaattgggaagtagaaatgggaaagataccagaatggaaaattagaaacaataaaatctgtaattgctaatttgaaagtcaagagataccatctttaattgaatggacgtgaaagaggtttaagaaacagtaaagctaatggaaaaataaaaaagaaaagcaaaagagaaataatacattagctaaattctttttcattaatcagttcataattcctaaaaaataaagaaatattgcatgtaggcagattatttagaaacatggaagttgtaaacatgaatatttcaaagtatttgtctcaaagaataagactggggatagaaaataatatgggagactgcttttctttataagccttaaatagttcataaccatgatgaatataaagagggagagagaaggcatgcacgtttaagaggggtggaagaaaaaactacatcaccacctactactttctgtacttcacattgttgctcaccatcacaatgtttaaaatcattttttaacatctataaaataacacagaaataaaagctctttagttctttgtttgtaatcacataacataaaattatcatcatcccacaatgtaagtcagagaggtaatacactacagaaaaagtgccacgctcaaaaatatggcctgtaagccaaaatggccatgaggttgattttgttaaactttaagacgcaatttaaataaagcagtaaaaaacatttatactttcagattaatatcagcatggccatttaaaatcaaggtacattttacccatgctgcttcctggtcactttgtttggggcacagaaagaaaccttactgtgattattaataggttgagtatatgcgaccttgattgtcaattgccctctagtatttaacttaccttctccagtttggtaataggatccctgcccccactcaactctcaataaaaccaagttttagcaggatccacttcacccagctagtgacttgtcctagctgcccttgcaaggaggtgttggcatataactacattttggccagtggactacaagcacaagtgatgtgtgcttttgggggttcatttataacagaactatgctttcctctcttccctcctcttactctcctttcctgtagactacaatttggacaggccaatatgagctagcaaagatcatgaggacaggaacaacactctataaagcagtaaccaacacaacactctgtgatgatgaaggtatgacatatctgcactgtttaaaacggtagccaccagccacgtgtctatgagggactcaaaatgtggctagtgggttttttagttaagttaatttaaatgtaaatgtcaatagccacacatggctactgaacaatgcagtcacagcggatggctgagaaacaaaagaaacctggattcttgaatgtccttgtgaagagaggcaccaacccactcttgaccatctgcctacctctgaattgttaaatgagagatgaataaaattctaccttgtttcaactactgaggatttacatttctctttgttaatagtggcctagcctatgatataactaatagagactatttgtatcaatttatgacagaaaaaaatatcttggtgtttggtgtatggaagagatcttaaaggaaaaaaagagtgataaactcttacaagtggtatcaaatcagtttgtctaaggaagtctgtttcatgtcgggcataatgactcatgcctataatcccagcactctgggaagctgaggggaggattacttgagcccaagagttcaagaccagcctgggcgacacagtgagacctcatctttacaaaaatctttttaaaactaactcgtcatggtggcgtgcacctgtagttccagctattcaggaaactgaggcagaaggtttgcttgagctgaaaagtttgaggttgcagtgagctatgatggcaccactgcactctggccttggtgaaagacagagaccatgtcactaaattttttttaagtctatgttaagttggacgtctcactttagacaacaggaaataaataactttcattcacttaaataaaatataaatcattcaaataatgatttaggaaacaatcatcattggaaagctcaaatttttaaataaaatgctagcaataagcccacaaaataagaattaagatttgtatttagaaggagtttagatattatcactaagctaagcatattctaaaattgacaaagcaaatataaaactgaagtataaaatctaaagaaataaaatattttacttttggcactccactttgtatttatcatttgctatatttctttataagttaaattttttaaacatttaaaatgtttgttaataataaagcttcagggatgtttttgttgttgtccctgttaatagctgaatgtcaacaagtaaaacaaagtagaagaaatgtgttttacatagctcataaaatactgcacttatattgaccaagagtttaagttatttagcttttattttctttagccatctagatgcatttaagtagtattaacatcaacaggcagactgcttcaaaagacagactgaagaccttcatgtttgaataaagcatccaagtttccacttttattgccactctcaagtttaagcattaactacttcatatctggattactagaaacaatcttcctaatgcgtgtctttacttcgtctctgtacaccaatccattctgccttctgtgtctaatcttcctaaatacatttttaatcatatcaatcccttgctcaaaaatattcaatgagtccctatcacctgcatatagagaatcattagcctcgtagtcaagacccctctgtttagccctaatatgttaatccccttatgtgagccactgatctactccaaagtcaaaaaataaattgcacatttctattgctacaaccttgccttcaccattccttccctttaaaggctctgtatattccttcaaagcttatcccaacattcatctcctctaagaactctcctaaattatttgtagcccaaaatgcttcaaattcctccaaactcacattgctccttttcatgtaagttttagcttgccaaacacataataaactttttaataaggaatatgaaagctttatattcctatgtatgtgtcagtgtaccatgttccatgtatatatgacaatgtagaggatgttgtcagactggttcacatttactgattcatgtgtaagtttcaaacaatagctgaaagcaaactgttttaattaaatactgttaagcatattaccaacctagaaaaacatgattttttttttactactagataatttgcagttattcaatgacatggatttatgtatgaagaaaaatcatcctatttataaaggttttcagtttaactgaaaaccatactggttaatgtctatgctattatgttttacaaaaaattatcattattggttgtaattaagtcataacactaattaagtactataaaactcagaggcagtctgacagtcagttgaactagtatctcaacaacttgatacacctactttacactaggaactatatgagtcacataacatgcctctttgaaatctttattattaggcattattagcttcctttaaaaaatgaaaaaatgtgacttaaagagattaagtttgcccaagatcacacagcagataagcaagaattaaagctctggtataattattggaatgaatttagtatgaacaaggatctccatttccccaatatgttaaaaatcttcaaatgcattaacaattatacaaaatatcaccattaatcagcttctaagatagtgggcttaatcaaaaacctaccaatatatgttgacaatctcccagttcgcacatcagatttagtaaaactcagttagctctttcccaagacaaacttgaaaagttcaactagttgaagtgtactcactctagactctaaatgataaataatatattgtttaaaaaggacaaaagtatcagcacatttctactagaaccatttaacttctgaattatctaggaacatatgattattacaataaatgtatcttataaagtgtattagtctgttttcatgctgctaagacacacccaagacttggcaatttacaaaagaaaaaggcttaattggactcacagttccatgtggctggggaaggctcacaatcatggtgcaatgcaaggaggaacaagtcccatcttacacggatggcagcaaagacagaataaggaagatgcaaaagcagaaacccaataaaaccatcacatctcatgacacttattcattaccatgagaacaatatgggggaaaccgccctcccacaacacatgagaactgtgggagtacaattcaagatgagacttgggtagggacacagagtcaaaccatatcattctacccctgacccctccccaaatgtcctcacatttcaaaaccaatcatgccttcccaacaggccccccaaagtcttaacttatttcatcattaactcaaaagtccacagtccaaagtctcatctaagacaaggcaagtctcttccaccgatgagcctaataaaatcaaaagcaagttagttacttcctagatacaacaggggtataggcattcgataaatacagccattccaaatgggaggaattggccaaaacaaaggagctacaggccccatgcaagtccaaaatccagcagggcaatcaaatcttaaagctccaaaatgatctcctttgactccatgtctcacatccagatcatgctgatacaagagttgagttcccatgaccttggggagctagacccctgtgattttgcagggtatggcacccccacccggctgagttcatgggctggtgttgagtgcctgtggcttttccaggcacagtgtgcaagctgtcagtggatctaccattctggggtctggaagatggtggccctcttctcacagctacactaggcggtgcctcagtagggactctgtgtggggactccaatcccacacttcccttccgcattgtcctaacagaggttctccatgagggccccacccctgcagcaaacttctgcctgggcatccaggaatttccatacatcttctgaaatctaggcggaggttctgaaacctcagttctggacttctgtgcacccacaggctcaacaacatgtggaagctgccaaggcttggggtttgcaccctctgcagccacggcccaagctctacactggcccttttcagccacagctggagcagctgggatgcagggaaccaagtccctagcctgcacacagtgctgggaccctgtgcccactttttcctcctacacctccagggctgttatgtgagtggctgccgtgaagacctctggcatgccctggagacattttccccattatcttggggactaacatttggctccttgttacttatgcaaatttctgcagctggcttgaatttctgctcagaaaacgggattttcttttctatcacattgtcaggctgcaaattttttgaacttttattttatgctgtttcccttttaaaactaaatgcttttaatagcacccaagtcacctcttcaatgttttgctgcttagaaatttcttccaccagataccctaaatcatctctctcaagttcatagttccacatatctctagggcaggggcaaaataccaccagcctctttgctaaaacataacaagagtaacctttgctccagttcccaacaaattcctcacctccatctgagaccacctcagcctggaccttactgtccatatcaccatcagcattttgggcaaagccaagcaactagtctctaggaagttccaaactctcccacattttcctatcttctgagccttccaaaccgttccaacctctgcctgctacccagttccaaagtcgcttccacattttcaggtatcttctcagcaatgccccactctactggtaccaatttactgtattagtctgttttcatgctgctgataaagacatacccaagattgggcaatttacaaaagaaagaggtttaattggacttacagttccacatggctggggaagcctcacaatcatggtggaaggcaaagaggagcaagtcccatcttacatggatggcagcaggcaaagagagaatgaggaagatgcaaaagcagaaacccctgataaaaccatcagatctcctaagacttattcattaccatgagaacagtatgggggaaactgcccccgtgattaaattatcttccaccgggtccctcctgcaacacatgggaattgtgggagtacaactcaagatgagatttgggtggggacacaggggatacagaaccaaaccatatcataaagtgatatgtatttcttccaaactgggacatatttgagactgacaggggccaaaacaaaaagcataaattagggctgtcctaggcaaaatggtatgcatgataagctactcaaagcaaaagtatttggtactttcaactctaggatactcttaataccaaacagaaaatcttgttaaacacaaaggactgtttaattcttatttttttaataggccattctgtaaaacaacatgggcagaagttaacagaaacccaccaagacatcattttgtatcacttacctttgtgagccagtgttacacccaaaataacccagacctgtcataccatcttcacgttaacctttggggaagttgctgttttgactgtgtttttatagaaattgaaataagaacagaaattataacaatagcaatcaaacttaaggtcaactactaattctcaatattatttccatatttctttctaaggaaagaaagggaagctttcatcttattttaaatatttctttttcttttccaacttagaatttgtataatgtctaatcctatagagttgattagaaataccaaatatgtaatttaaaaacacagcaaggccagcattatctaacaaggatttttctgtatcagattttatgattatactgacaaatctacaagattattatttagagtgtaaggaaaatacagacttattgacagagtctagaaatcattaagattctgtaaatacatttaaatcaatctgtcatgcaaatcattgtgtgtgtcatttcaaaagataatttaaattaagaatttagccagctcctcaggcggggccttaaacagtagcaattctagtatgtggacagcacagttcaggtctcagctttagatcagcaggtcctgaaacccaattttatcagtgtatgtgtgtaccagacctaatttaagagttaagccataaaaataaagttgataggttttgtcactctaccagacagtaatggattaacacaaacagaattatcttctttggcttctcacaatccatgcacaccacttctcttctgctaaaacattctttatttttaaacagtataaaacaaatgattaagtaacagcagctaaatcgaaagtcatttattcatcctaggccaggcatggcagcgaacacctgttaatcccagcattttgggaggctgaggcaggagaatcatttcagcccaggagtgtgagactcgcctgggcaatacagcaaaaccttgtctcttaaaaaagaaaaaaaaaaaaaaagagagggaaaaaaagtcattcatccaccttagtaactataattaaactataatctttcacaaatctacgcaacagattttgaaactctccaagggtgtgttaattttgcaaatcgtccattttattcgtggtaagatactttttattagtttcaccctcaatgtgtgactatctccaggtagttggggagaatttattaaaggctccatatcggagctgccctatgggacaactctagggagcatcattcacacagaatgcctgagtggtgttatgtacccagccctgtctatatacacttgttttatagaaaaagttggaaataaaaatatttatcctaaaatttatcctgagaaattaaataagaatacatgaagcacctagcacagtcagtggcacacaacagaaacttcataaacaacagtcccagtatgtaacaatcttagtgaaaaaaggaggcaattatattgtgataagtgacatatgatagagatattcatatccttatttttggctttcatctattatcgaagttagaaatctgttcctttttctcctacattagaacaatgggtataatacaaagcaaaagacaacactttctatttagctcacaaaacacttactccatattttatatacttgactatttctcttataactctcaagaatcctataattatactctacccttcttatcgtggtcataattcagtattactatgatcaactacctaaattctgactcttccactagatataagttccatgaggaatctttattgttgttgctcttgttgacagggtctcactgtcacctagactgaagtgcagtggtgtgatctcagctccctgcagcctcgacctacccaggctcaagtgatcctcccacctcagcctcccgagaagctaggtgcgtaccaccacacctaatttatttatttatttatttttgtattttgtagacacggggtttcaccatgttgcccaggttggtctcaaactcctgagctcaagtgatctgccccacctcagccccccaaagtactgggattacaggtgtgagccaccacacctggcccatgaggaatcttaagtcttgccttatgtatccttagtgctttacattataggaagtccataaatattattagcagggtaaaaaaatgagtgattcaaaaatctcatatcacatccttaacgcttcaactgatttttcttattgcacttctctcaaccatgtcagatccactgaggtaggctgcctcaaactcaccatctcaatacaacagaaataaaactagaacatttcctctgtccttgacaaaccctttctacatttccaactatgctctaaaaaacaaatattaacattaagcatctgaagataagtcaaaataatatttctttattccatcaatctatacctaaagaatgactaggtccatgacatcaatgcctcaaaactaatcataacctcagcaggaactgctgctagggcatctcaactttttgcttgtcttccctgtctctcctcaccattgttatgcttaattttatttaaaaggctccaaccatcccaaatcctactcaagactaatgtcttaataaataaagcctaatctcatgaataaatatcaaccagtcctcaatatcataatatagtacacttacaattatatgtaacatctatttctggcctaaatggaatagcttgctaaagaccaacacttctacagtgaacaactaaagtaggctgataaaaagaaaatgggggaaaaaaattgaaagcatcaaagaattgctaaactgaccaggccttgaagggccaaagtcctaaagaagagggaacagaagtgaagtaagccaacattctgaagccattttcctcaatatatttatcaattctggcacagggcaagagaagaaggatctgggcaaagagcccagattgagagctgctattaagtggcaaaaaaaaaaaaaagcatcatttccgccaatctcttgaggatagagagagaaaaataacagactggaaaggccagaatctggggaaaggtaggcccagaacctggcctaacattctgccaatattccctcaaaacttctgataaatccttaaactgtagggaataagaggataaaaagtcaagcagaaaggcaatgaaaaacaagatttagaaagttcataatacaaggagaaattaattggaattcagggcctaccagtgagacaaagtctcagtgaataccccaggatctctgtgggaactcttgaaagactgctcctaaaagcaatgctaacaaaaagtgatagagctttgtcaaaaatggaccccaaactgtaattgagaggtcttgtggagacacaaaggttagagtttaggatctaccaggggggaaatcccaatgaatatacctggctcttgcttggaagctctaaagggttatagcttgagacaggaagggcagcaatcagaggtagactgacctctatgaaaactacaacccatcctgaacccacttgggccctttgccaatctgttcccagtctatcttcccaggaagagaaaagctaaaccctgtacagaagaaaataatatcatctggggcctctaaactattttatgtgcaatatccaacagtaaacatagcactacatagcactgaagtctgaatagccaagggcaaatgcagcaggggcaatgagaaaaggtacactaactagtatgcctccaaattaagccagtttcctcatttatctcctttcaccagttcttttgaaagaaagaatagttaccttattgagcagagacaagatttaagattttacattttttgttacagaacatttcaattctgtattgaatcagttatgaaaataaagaaaagtagagaaaaaccctttagttttcaaaaagtattagggatgccaaaatataagatcatatgacaataaaccatacacaaaaaagtgaaaacagaatgcacactgtccaccttcccattcacacacaggtaccttcataccttgacctctgacctcacctacaactgggatgtacctagagatgtggggtagttctccttaccgcccaggttggaatccaagcacgggggtaaagcgggtgaggagaagaggctcgcttctctaccatccttcatgattcctgaccccccaatcctttttcccatttcctttgatgttattttattacagctttttaaatatttttaaaaaattatttaacccttggcagcagagactaaggaggggaataaggaattgcagactctgtatgactgaaataaagagaaataaaaacaacagaaagggatccagaatacaggactttgaaaaaaatacacacacacacacattacatatatatatatttttatatatagatttatatatatatttatatattttatatatatatatatatatatatatatatatatatatatatatatatatacacacacacacacacacacacacacacatatatatgtttggctaaaacaagaggaatttattctctcatagttctggaggccaggggttccacatctgttcactgggcaaaaatcaaggtgtcagcaaagatgtgctccctctggaggctctaggagagaatctattccttgcctcttccagtttctggtggctgccagcaagaaaaatattttaaaactatgaaagaaaatagagaaaaagaggaagaatttcaatacagcattaaaatctgttttaaaaaaatgcaaatggtaaagagcagtttttaaaatatgtaactaattagcttgtgtagttataacaaagtagacattaagacaagaatatttctagagatgaaaagaaacatgtcctaataacaaaagggaaaaccaacaaggaagatatagcaattataaatctgtatgtacccaataacatgactgcaaatagacataaagcaaaattttgaggaacaaaaacaattccaaaaattcacaatcatattgggagaatttaacacagctctctccagagctctcaggacaagcggacaaaaaaaaaaaataaatcattaaacatattggatatctgacacacataattaataaatgtgaggaatgaataaaagcaaagcactgtacccaacaagagattacatactcttcttaagtggaaatagaacacataccaaaattgacaaggtgctgggtcataaagcaagcctcagtaaacttcaaagtattgagataattaaaaggatgatttctgacaaaagtagacttaaactggaactcaataacccaaaaatctccagttgtttgaaaattaagagatatactaaataagtcaaaagaaatcacaatgaaaattaatatttttaactgatagtaatagaaatataacatcaaaacttacgggatcaagctaaaattgcttacaaatttacagccttaaattaatatataataaagtaagataaactggaaaaaaatcaatgacctacatatccatctcaacaaattacaaaggaagcaaatctaaaaaaattaaattcttaataagcagatattaatgataaaaaaatatacaacagagaaaattaacaacgctaaaagttgggtctttgaaaaaacttaaataattgatatggctcttgcaaaactgattaagaaaaattaaaaaggcacaaaaaactcatgtggaaagaaaaaggcagcatcactatagatcctaaaatcattttttaaaatgaacgtaggatgaaacagagaatgtgacaaaacaatctgtgttacaaatatgggaaagaagtacattgaagtgggtggaggaaatggttctaacctaagtaactgaaaatgagtgaagcctataaaggcaaaaaaaaaaaaactataaaaataagcattgtatagttgataaagttgtcacccatggaggtacagattaataattctgatagtgctctgcacgtatactgcaactgaacaattaagtaaatggataacagataatgggagctcggtttctccctgttggagtatgagatttcagatataccaagcaagtgggctacaaaactacatatggtaatggactggagttgtagacatcagtataaaatcatgtttaccttaatacagatataaatggttatatacaaaaacatttacaagtatgtacacgagttagtataaacacatttgttttccatttttcagctaagaaggcctagaaacaacaacacaccaatagcaacaagcacccatagtgcccacatcctagtttctaataccactcacaaataaaagcaaccaggactccttggaaaaatggctgattctaggaaagggcaggaaatatacaaaatttctttcagtgccagaaagtaaatacatgctaaaaaaaaaaaaaaaaaaaaaaaaaaaaaaaatatatatatatatatatatatatatatatatatccacaatgatgaggcctgtcaaaaggacacaggagccaactgaaagagctctcaatggccaaagctagaacaaattgagcaagaaaataaaatagtatttgattataacccaaagtataaaataaatatccatgagtccatagtatttcaaataaatgactgaaaaaacaaataaatgagagggaacaaaatctgagcagaaaaattccaaatctgtgtaaatactgtgccctaaaggaggtgtgagcgtaactgcccactcctgaagtgtgagctacatatagtgacttccaaagagtaaagtgtggagagagagaaaaaaacagtaactttacggtgcagaaacccgacaaatactacctcaccaggtaatcaagatcaagatcaacagtgatgagtcacagagataacatgtacccttgatatgaagagaagaatcacaggagaacaaaagtcaggtaagattagcatacagaaatataaatcctatatccagcatggctctaaaaagtgtgccaaaaatttgactctaaatttcctagaggccaagtcaaagagaacatagtcaattacatagttcacattattcattaagtggcaggttggatagtcaggcaaagcatgacttttctagcatctgaaacagaataaaacttctttcatggcttctcataaagatagtgctattatcatacaatggaagacatccaaacataaaatccctactgcatatcttaggactatttcatacaacatcctttaatccaagtcagtggcatcctcaagagcaattatacaagagagcaaaataaagtagctcggttctaatatccatgggtaaaactgagaaaacatataaaataagattacagagactttaagcagtccatctgcagtgaaacactattacatgcaatcgcgattttagtaaggttttaacagttgaaatccgaggctgtaatttttatcaagaccaggatttaaataacttggctcttaagtacagatcgtacacactttgactcttaatcagggaggcggtaaggaaaacggtaaggtaaagaagtattcataaaaaattaagtctacataaagtcatgactgaaggaatggctaacctatctctgcacataggtgcaccaaaagaggtatggcccactcagtcaaattttagtggttaaaacaaaagggaaaaaattgatctacacataagaagagaaactgttctaaataaaagccttttaaggaatataaagggaagtagaaggcaaaggcaacgaaaataattcttatttctgtaataatcacagtgcatttttatcacctctagaaacaaatttacatgggaacaatttggaactctaaaatatgtttaagtctctatttagtttttctttagttatcaggtaatggtataaaatatattaaaggacatatattctgcacttaagatatgttccttgttctcttttaaatggcgatttgattttctggttctttttaggttagttatcaaaaggccaactcatagaaaatagctaaaaaacagatgaataataagatgtttaaaacatattaagaaaaacttagtggtgaaaaattgcacattccttccacattgtacctaagttagccctcgatttatcttagtaatagggcaatctaaatggaaataataaatgaatactaaaatactattgataacggttaagaagtgataagaattgccgggcgtggtggctcacgcctgtaatcccagcactttgggaggctgaggcgggcggatcacgaggtcaggagatcgagaccgatcctggctaacacggtgaaaccccgtctctactaaaaatacaaaaaattagccggtcgtggtggcaggcgcctgtagtcccagctactcgggaggctgaggcaggggaatggcgtgaacccgggaggcggagcttgcaatcagcctaggcaacagagcgagactcggtctcaaaaaaaaaaaagtgataagaactaaaaattggcatatttttactggtgctttagctcaaagtagaaaggttataatacacttaataataaatgtaatgtttcaaagtatccacactaagaaggaagctaaattcagaaactgaatagcaaacaaatcatcacatactttttccaggtggtatgtggattaagttttaacaacttgcatacacgtttactgaacttaagtttctttatgcatcagttttaaaaaaaaaatcatttttttcaaagaaagctggatgattcttacaaaccctagttgctaaaatttaccactcaaattacaaaagcacttataatgttatatatatgtaaatttagacatgccaaattgtatattaaccaaaaataacaattattccagaaatactgcaatttttccagtctctttcatgtgtctcagcattactcttcaaacatggaaaatttagaatacagttgtatgttcagtgaaagtatctattacggtaacatcttactgtgtacataaaaatgtcattttttccaaattatatttagcattttactttgtaaggcaattttttatgatgatatccctctctttaattcacagcaacaataaggatcaaatactctagttacaattaaacactttgactaaaatcaggtataaactgctaaaactagaaatacattaagttaaaatatataaaacaaaggcatttaaaacatattttaaaacagacatacttatcccaaccaagagttcctatctcttcaataaggcttgagtagaactggggaggaggaggtagtgcatacagctcttgtctattctttaaggcaacttcctgtttaaaagaagaaaacctgaattagctgtggaacgcaagacaatgaactgttaatacctgattgcaaaacataatttcattatcttcttagtgcctaataaaagtgcctgtttttttacggaaatctggctgactcattcccctgctcatgaaaaagagacaagaaaaagttaaaggactgcactgaaggtcatgcaaaatgtcaatttttatgccatgaaaataacttgagattttaatattctcctggactattatgcctatcggagataaaaaaaaaatttttattaaattcatcctcaaggcttcactatggctctattcccatgaatatgatgtttgatatatacattttttaaaaagtacctctaaagaaaggcctgaactctaagtacattacctaaactgacatatttgtataccattatgaaccacatcctaacaaacaaactcattatcagaacaaatatccacatgctaatttttttcactgacttatactctgtactattcttcaagcaggtaagtcggagtattatgccatccatctggctagattacagtcccgttccttgctaggcctatctatgaaggctttaaaatgtttatgttctcccaaccaaaactaaaattttttacaagacacataaacatcactagaattgctgaagctaaaattaccaattattttgaagttaccaacctagatagacagcttatttggaaagtaaaaataaatctatctacaaattacttagatgttcatatggtctgaagtatcaaacggtattacaaaaagtaaataattaattaattaaataaatcagctacaataaataacgaaagtagatagggacaagttgaaaattataaacacttctgaaaaatataatcctaataaaaggttgtaatttttattcttttaagtatatgtttaatcttattttttaagtatatatcaattttttttaaccaggataggacactatcaaattgagatcatattagaaagaacagatattacaaaacagcacttcaaaaccaaaactattaacgggaactacttcaatttcgttctgaatctgctttatgatgaaaaaaaaaaaacaactgggaaaacagatccgtacagctgagaatatcaatatggatttaattagagggtaagctcctagaagacaaagtatatgctgccttttttataatataaatgactaatgttgcctaaaaatagactgatggtccaccaaaataaattcgtatttaggttgtgcaccaacctaatactatgaagattgtgctctactagttattaaataaaatgcattaatatagtatagtacttctttcaagatttgtttttattctgaaatattaattattgctattcacaaaaattgaaggtaaaaataaacctggataatagtaaaaacacttttcaatcttaggtttatgacatttatacactctaccttctattctgagtcaggtaagttactcctactgtagaaccgtaacagctaaaaaggcaaaagcagagaagcaacatattcttcacagaaaagaggcaaaggtacatagcggaaaggcttcacaaacagaagttttaaatactgactttaacaattcctattttgaggccttaggcttcagtggctcagctctaaaatagaaataaaataacctaccacttaggattattttaaatataggtaattgttcacttgttaaatatatactgaactcccactatatgcagtaattactaggaaactccatggaagatttacaacattttctgaataagttcaataactactgatttcatgtgagcatcactctcaacatatttattggtgattatagtataggaaccctattacttacaatacagcctaacactaataattcttatatctttaggtatactatcttaaatgagcaataaaatcaccaaatttgtccgtaatttctgaagaaagctaaaatacaggatttcatttttattcagaaattgaataaatatactaaatagatattgtaaatcagagatctcaaaattttattttagttttaaactaataagtgtttctccaaaattacatggccaagagagctgtgacttacaatttaatgaagttatttttgataagaagagtttaatgggacatgatatctatacttttactctggttcccttagtctctccttgtatttgtattgtttattaaaattataataaaaagataaaataaatgttgcaaacttttctccaatgtcaaggagatgtaaaccaaatatgcttcacttgttcactttacctttttaaggttattacattaaggcctttgatgtaatttgtaatcaagtttgataacccttattaattaggatttatgaactcataaatcaaaattcaaactttagaaattaattttaaactattattctaatctcacacatttaatcaaagtcctaccttagaaggttcttattagcattaaaaaaggactccagaaaacaacctagcaactaagttatcaatatgtagtagctgctgctaggaataaaatggtctcaacaaggatcacaaagaaatatcaaaactttccattgttagcaatattagtattgtaatttttatataaactaacaacacatagacaggaaaagcataagtgaaatataacaagtagaacataacaaaaaaccatactacaatgatgttaacattagaaaacagcattttcagagtaaaagtgatacaagcaaacaagtaaaaattctataatgccaatttgaattgtaaatatcaatacaaactcataattatattctttccaaaaagtattttttctcagttttgtccactgaaaaaacctacaagtaacagcaatgcacactcaagtttccagattgaggcatccaaatactatttcccacaaagaaatcatgattctttggagaaatggctgattacagttacggaataaaatgaataaatgaacctggggcaactggtatcagaaggcaaacaagcttgggttatattaaataaagagccaatatgaagggacttgtgctgaccaaaaaaatgggacaatttaagcatcaaaaagaaaatgactacaataaaaaaattaattaaatatataaaaatctatgagttcataaagatactttaaaaaaaaaaacactttagatccctgtgacagttgctaggcaccaactcattattctaaaaattggtttctgttttaaaaggaaaagaaacaagcacttatccagtctctccagtataagctgtacctcaaattaaccaaacaactgatgagaagttctctacagaagattttcaactaataaatgcagatgatggaatttttaaaattaccatttgtaaatcctaatgaaacattagatacaggcaatgattgttattagaggctaaaatcattaggtgacagtctgatgggaaactttatattgaatggatctaaacctattgatcaatcttaaatttactaaaacaggaaccaaggaaccatcagataccacgtggatcctcatgtaatataataaatacagagcaccaagtaatctcataagaacaaatgaatccaaatctgctgaagcctctagatctaactgccagattacaaagaaagtagaatatgttaaaagataaaccatgaatatcttacaagccaaatccagaatgtagaagattttataggacacctaatttgttttattcaacaaatacatggcatgaataaaaagggtgaggtaaagaggagagagatgatgttatacataagtaccttataagtcttatataaggcttaagagacttatcaactaaatataatgtgaggaccttgtttgcatactaatacaaacaaagcagctataagaaattattaactttattgaggttataataatatatttaaaaacagataaaaagcacttagctgttaaagagatacacactgacatatttacagagggatacatacaatatccagaatttcctttaaaatactatggtgtctttcttctaaaaaagtagaagaggaaataagattggcaaaatgttaaaatttggtcaggcccagcagtattcactataatcttccctcttcttttgtttatgttgaaaacttgggtaataaaatgaacttgggttttaagaaaataataaaatgtctacaggataaactgaataatcaagtattttatgcaacactgattaaacagtacatatgtaacagtatacataaaatgaagcctaataagtttttcagatatctgtagctatacacaaaattatttatacatcatattatatctttaagtaggactacctaatctcttcttagatgttaaactctctgctgataggccaggagtacattttatttcttcaccacctgcccaacactagtgtcaagaatacctagtttataatacaatcaaagaggttccttcgaacagttatgtccctcatgcagttcaagaaatgcgtcatctatatttatgtacacagtaaaagaaaacatcaaatgactgagagttaagaagacaaattctaataatgtcagtttttaaaggagttacaaaaaagaaatcaagacttgcagtatggtaacagtgtcagaaaaaaaaaaaattcttaccaaaagcatcttcaactccatcataaagctcattagatcaggagagtgctgcattctctagatcaaaatatttccaattaatttcatttgcacaataaatattctatccactaaaactgtaaaaaaatgtaggcccaagtgaatgtgaaaaaaagattagctatatctacatctgaaaactataagaaatgaagtatcggtcatcaactttactactcctaccaatttcattttgaaacagtaattaatgtcctcaaatctaatttgctgagatatattaaactgtgttagaatgtcacttaaaacctcacactactctgtttcttgagcactgtttactactgaatcccttgtcccccttgcagggcatgcgatgggagtgtggcttgcttcttcagtgccccgctgcataaacctctaggggagcatacagacgggcaggctgtggagctccaaccccacagcagtgtctaggggtgaatgtttacagctactgaaagcccagtgggtgtgtgttacaaggtgcttttttagtttagccatccataggcagcttgtgttagtcagctcaattagacccctgccttattgcaaggacaaagaactttctgtatcccgtggttcctgccttggtgtactggaaaaattggatcacatgtgggcttggagaatgagtgcaaggttttattaagtgcaagtagctctcagtagatgtgggagacagaagggagacggttttcccctggcgtcgggttgctcagcagcccaggctctcctccaaccaccctggtcgaactccacgtcattctgccggtcaatggcctgccggcatgctgaagtctatcggtgtgctcttgacatgctctcgatgtcctctcgatgtccagccacttgtgtgttcctccaccgatatatttctctcaacgtccagccacttgtgtgtgtgtgtgcctgctagggtctcgggtttttataggcacaagatggaggtatggcaggccagggtggtcttgggaaatgcctgtcctcacctaggtcagtgggcacaggcccgggggtggagccctcaccagggacccatctttctctactcagcacttccctgccgcccttctgtatcactactatgtctagcaaatctaacaacctcatcattactttttttaaagaagaagagaaagaagaggaggaggaggaggaagagaaaaaaaaagagaaagaagaggtataggagtgatgtgagtgggaagaggagtataaaatataaaaatcaggcaactctatgtaatttttaaaatctagtggcagcaataaattaacaattattaattaacaatatggtcattttttttatttttcccttgaccttaaaaactacctataattgtgatttttgtcctctcacaactaatccatattagtcaaaatggagacagtcattcattaaagtaaaacctgttataataaaatggcaaaaaaggaaataatctctaaagtacaataaatatttaagagttactattccatttcctagaaatccttcattcttaaaataactacagaaaaaaatattctcaagttttacattgttttcaacaatgcatgaacacatatgattcacatcttaacatagctttgagtgggtctgtgtagagcaaatccttgactatcccttcttctacattgcattttccccttagtttattacagatgatcaataaatgacagggtctggaaactaaagtccagaggccaaatccagctcaatactgtttttgtaaacaaagttttattggcatgtagccatacacattcacttacctcttgtctatggttgctataacggcagaattgagtagctgcaacagagatcttatggcttactaagccagaaaaacttattatctggttctttacagaaaaagtctgttgactccctggcccatatttactaaaattaaaaatgatacaagaaaagaatagtaatattcactgggactgtaaaataaaaagaagactttaacactgggttctacctaaccaattggggggcaaggaaagataaataattgggatttttttctaggaatcctcttgataacttgctggtgaaaaacagagtaatagatcttaatattagactacataaaccattttttcccatgctatttcaatatgtcaacagatgcatttcttaaattttagtgtacaatataaatagtcaaagggatggagacagggatggaaagaaaacagaaataatttgaacatatccttaaaaaaacttctgtaattatattgccaggatgataaccttcattctataaatcaaatagtttatctcctatacttctttgcagctttaatgctttatgggagagttactgtgattgtcagttatcatagataataacctgcctttaagacacagaaatatagaaaatcaggaaaaaaacacacaaatgcataaagcataaaaagaaaggcaattctaaaaactatttttctaaaagaagaattatattatgtcattattttgcttcagtaactgatttttttttctaatctttaaaggaattttcaggtagaggaacctaaacattaagaataaagaaattaatcctgcctattaacacactaagcagcctttaatttatctcccctcattatgcaagtacacatgatcctaaattatttctgccacatcttttctgttgctaatctaggactaaaatcccatttttgccacagatatcccacagctctaaatgggtctgattttttttccctatcaccaccattcagtctcagaagaaaaatcactgaagaagtgatggatatggataagggtgaatgcatttgaagaacctaaagtctcaaagatggaaatcgatttcaacacaaaggctgcctggagatctcctgaggacactgagatttaaaaacacacagagatgaaacctacaaaacttaacaactattaaaccagtttgttacaacattgtgcaaagcaggtctttaaagaacaataaatttagtaatttcttatcttcactgaaaacataaaccttttaaaaaggacttacctgttgtactattcgatggtatccactaagtattgttctcagctgccaactacataataatctaaaattttaatgagacaaaatggtttattcattgttcagaattaaaaacttatttgtatgctaacacaaacatgcatgtacatacaaaagaatgacaaacataatttggacaagttaataaaatttttaccactgatactgttcaaagtcttgtcttcaaactgttggtactaattttatttcaaaatataaataactgcaatcagtaaatgacatgcaaacagtacatcttgttttttaactttaacacatccgaagcaaagttttccactgaagtagattcttttccaagataggttaaataaaaccaacagttttgataacaatatatcatcaaatataatgtatcaaacatgtatttgaaaaagcatgtgtagcaatattatcttcaaattcccgattaatataactaaaaggatacattttatttttattttttattttttagagacaggatctcgctctgtcactcaggctggctggagtgcagtagaatagctgactgcaacctgaactcctaggctcaagaaaccctcccgcctcagcctctcaagtagctgggactacagacacccaccaccaagcctggctagaaagatacatacttctaattaattgtataagaagtgataagttaatgttcatccacttactggctgacctctgttgtgctcccgatactattaagtaactcttctaaggaattacttttagttacctacaagtaggaagcctctctgagttttccccaacatggccttttcaaactgtcacaactctctccattcttggtcttcaaatccccataaccatccctatctcctctcttagtggcagagtagttcattcaaatgtccattggtaacccctgctcaaaatgtgctttctctcccctgctaccaacttggtgacttcaattaattatccctttattgtggtatccttaatttatgttctgctagtttttttctccttaatgaattaacttgctcaaatatatatctttaaagaacatcataactccttcttgaatgcataccattctctaaccacctctttttcttcaaaatactttatactttcctcccactcatccaacacaaatggcttctgccaccacacaaaacttacttgcatctaacctatctctttgtaatcctcagcattgctaaccatgccttgcttaagcctctctttatttggcttgaaagactctgctgcccaagttttcctcttctctggtcaatccttagtctccttgtaagttcctctttagtgaccagtcctttaaatgttggtacgccccaaggtcttgtcactggctttctcttctaccccgctagacacagcaccaaaaagtctattcataatcaaggtctcaaatccttcatctgttgtaacttccacacacatctgcactccaggtctcacactctatttccacaccactacattactacctactaaatagctcctcttggtatttcacaccaaatatgccttaaaacaatctctcttctacttttccatctgtgacctcttctctagcttagagatctgagccgggaatttgaaaagcatcctctattcctttttccctcttaactacacttctgttggtcacaaaatcctctcaattctactcataaatatctctggattccttttcctccattcttctccagaaatatttagaggcagaattgagatttggggtggtacctaaattttcagtctcatatcctgactagttgtatctaccagcactcaatgttggtacctaatttaagccaggactgaactgatgtgactcttctcatataatgaatatacacattaataatatcagtcaaaagttggaaaaaaagttttctaatccttttgttctccctttatatacctgttcagtatttgttagtgaagtgtacacaatggctgtttactgctttaaatatttttttaaaaatgagagaactaatgtttaaaagcactttagtaacaggtaaatatttacaaatgctgcattggtttggaaaaatcagaaatgtttcttttggggcaaatgactaataagcattttaggcaaaactctagtcactagaatcaatttataccaaatgtactgcctgtcccaccaaaatgcaaaaatgcacgtttataactaaacaccatatcaccttgcattcttcagttgtaaatcttcaggcaacactatcctaaggtggaagtctcttccctgtggaaaatattgaaaaggatcactcaaatttttatctttcacttaatgctgagaagttaaacagaatcacaaagaaaagacaatgttttcctttattttctaaaaggtatcaattttatccacatctttatacttgttaaaatatatgcaacacaatattgcatttgagggaaaataactcaaaactgtcttacaaaaactttgtagttactgggaaatcaaaacactcagataagactttgtttttaaagagaaagtcactcacaaacacaagaaatattacaaaattgctaaccaggcccatagaagaaatttcagtgttatttcttagtaaataaatttatgaaaaaagaaattccttcaaattgctttaatggaagaaaaacatcacaatataaaataaggatatataacattatatagtcgttttcagcttactttctaaattttaataaaatgaaaatatatttagttacacaatctatacagacataagtgaaatacttgcataaatcagagtatatttaattctcccattagtgggcctctaacttttttgaaatcagtaacatattaactatatatttgaacaaacagaattttactcaagagtctttctaagagaagaaagacctctgagacatttattccattttactttcttggaaaagtgaatgggtaagtagtttaaactttataacttaaataggataatacacaggaaacttgagcaaaaatagcagaaaaagacaaacagaaatgtaatcttttactctaacagaataaaatgaaaaagtaataaaattctcaaaaaacaattaccatgtggaattttaacacagtctccctcaaagcagtttcaaaaacagaggaacacaattaaatgtaccctataacctttactttcatggtaatattacagttctgactttcattacatttaaatgtcctttaaaaaaatgaaacaaaatgtactactgaccttttcaaaaggtcaagtaacaataattcactgtttcattaaagcactaaaaggtattatgtagtaactttaacctaacattatagacatcccacacaaaggtgtaagaacaatttggaattcttaatttacacgaaaaatagaagaactattctatatagaaatctgtgctgttatctgaaagaataaaattccaaagtcccttatttgcaaagcccagccattttaaaaggtcaaataacatgtcacatgccacgatactttcctgattcaagaaaatgtccaaaattagctttttagttaaagtatctagaaatattaattgttctcaaaaaagccagattttccaggctttcaggcaacagaaatactaacagttacctaaacctccatctccccacatatcataccaaaaagctacatcaattaccatattaagaataaataaaaccacaaaaatcccatgttttcagccagaagacagggtacacgataaacctcaaattacctacaggaagaaaaatatgaagcactttccaatagaacctactctaggactcccacagcaactctttttagagtgctaggaaggtcaggaaaaaaaatgcatgggagagagactgggaggactaagtaagtgtaaaaaaaaatagtaacaagctctggtaaatcagaacactgacctacaaagagaagacttaatgtgcattaacacaaaagtcaaggagccagtcctgggaaagaatgctttagaggcagaagataggagaaaagataggtagagacaccttttggaaactgggtattaggaggaaaaagaaaagtgggaaacttaggctcttatacgagtaaataaaaaaacaactccttcccacccagcactcgccaacatttcatccattaaataaattgtacaataaataaaatacccaacagaagagggtattcttaaactagtaattttataaactattgcaaacagccaaaacgtccatgaatacaaagatactgtcttcatcaatgcaaagctactatgagacaaagaaacaaaaagagactcacaagatttcaggtgataacagactccatgcaaacaaaacccagaaaccataaacaaattataataataaatgaaataagtgagcatttgtatccagattcagacattttaaaactaaaatgagaaattgtattttaaaaaatgaaaagaaatgaatgagctgaataaacgcagggtgaaatgaaaataaagaaaaacacaaaattatatgaaagtgaaggaataaatttaaaaagagtccaaggaagaacaaaatgaaatacaaatgtcataaagggcaaagaaaaagcaagaaaattaccaaatgagaaaaaaattaaagaccatcagagaaaaggagttgaagtggaacacagacccaaaaaagtccagagtacatataattggagatcttggaaagaaaaataaaatagtagaaaaaaaaatttaaaaatataatccaagtacacttcctggagttccacataccaaaagggataagtggccacatgataaaagtgattcacaatgatcaactcttgagatatatcttaatcaacagattttcaaaataagaaaaaagtccagagtctctaggtaaaagatcaaatatatagaaaacagaatataattggaaacagacttcttaaagcaaattaaaaaatgaagcaagaatgaaatagaaaatgttaagaaactgaagagaactgcttctagctattatggagttaaaaggacaggatttatcttccctccttatttaaaaattggacaaaacatatgaaacaatgattttcagacattaaacaataggcagcgaggacagtgatccttgaaataagggaaacaaatgtgaaaatgcctaaaattgtctggttctatgatgggagtattttcaggctgcaagatagggatggacaaacaaataagagcataatattctccctgatgtgagaagaaacatgtgatcaaggggaggccaacaattgtacaattcgcaaggtatagtaccaagcaggagagaaatgcatggagagtagagaaatatacacagagaaacgccagcgaatttcagaggattcctgacaaggagtcttcagctgagtactgcttgctccatggatatgaggaaaacacccaaaggtgggaacgtacaggaacagtctgcaaaacaatctcaaagttcatacaaggctgggtatagccatgttccaaccagccagagtggaaaccttgcaatgtaagagccattaaatagagtgctcagaaggtgttgcttcacttgtagagactaactaccttagactaaagtctgctctgggtctacctagcaatgcttaaaagcttaaagcttaaaattacttggaaagatcaaactgtttccaagtaatttaactgtagctcacaacaaatctcaagaatacttagagaacaaaaatatctagcatgcaacaggtagcattcattatgtctagcatccaatcaagatataccaagcacatatatttcctgcaaagaagcaaggcaatacccacaatgaagagaaaaatcaagagagacataaaaatggcacagatgataaacctgatttaaaaaattaaaacaattaaatttcatacgttcaagaaggtaaaggaaaacatgagcgtactaaatagagacaggaaagatgtaaataaagactccctcaaaaaacataatgtttgagatttttaaaaaatatgctagatagtatcaacagcagattccaccttacaaaagaaggtattagtatacctgaagacatatcccaaataaagagaaagacattgagggaaaaaaaaatgaacagaccatgagtgagttgtgacaacttaaagtgacctaaatgcatgtatttggagtgcccaacacagaggacagaaaaggaggaacaaaaaaaaaaaaagaaagaaagaaaaaataatggcagatgttttttccaaattaaatgaaaatatatactcagagatccaagaagctccacagaccttacggaggaaaaacatgaaaaaagctacaccaaggtacaacacacatcaaagtgactgaaaccaatgaccaaaaagaaaaatcttaaaagcagccagaggaaaaaaatattctatttacagagaaacaaagaaaagagcagagatttctcgtagaaaacagtgcaagacagtgaagtaacatctttacagtatcaaaagtgacaaaattatatagttgataaaccaatagtgcataaaaaatggaatcctaatattacgttaaggcagaccatgatagatttaatatgtatattataaaccctttaagcaactagttaaaaaaaaaacacacacacacacagccaataaactggcaaaggagataaaacagaattacaaaaaagaattccaataatataaaatacagaaaaataccaaaacaattaaaaatatgtaagacaaacagaaaacacacagcaagagtagatttaaatccaaccatatgaataaccacgttaaatgtaaatagtcgaagcacccccaagtaaaaggcaatgactatcatattgcataacaaagcaaagcacagaagaaacacactaaatattaaaacacaaataagtttaaaataaagaagtaaagataaaccatggtaacatcaatcaaaagaaagatgcaatctatatgttaatattggaaaatacagatttcagagaaaacattattactaaagataaaaaaggtcatttcataatcctaaaggagtcaattcataaagagtgcttaacaattctaaaagtttatggacctaataacagaacttcaaaatatatgaagcaaaactgatagaaattaaatagaaattgaaaaatcaacaaagatcgttggagatttcaacaccccctctcactaactgatagaaaaagcagacaaaaaagtcagtgagcacagtgctacccaataagggcctgggtagcactctgaaccaatttgacctaactggcatttatataatactctacccaatagcaacagaatagtcattctcttagagtacacacagtatattcaccaggatagactatattattggtcataaaattaaggctcaataaatattttaaaaatttaaatcatacaagttatattctgtgaccaaaatgaaactaaattataaatcaataacaaaaagatatctagaaaatccttaatattgagaaagataatcataattctaagtgagccatagatcaaagaagaaattaaaaggcatttggaactgaataaaaacaaaactacagcacaccaaaatgtgtgtgatatagctaaaccagtattcaaaagaaaatttaaagcactaaatatctgtactagaatagaagaaagatctcatatcaataatcttccatctaaagaaatcaggaaacttaagatcagaaaactatcatatagaaacataaaaataatagaaaaaaattgaagaaattaaagacaggttctttgaagaaatcagtaaaatttataaacctctatctagatgtatcgggggaaaaaatgagacataaattacctacatcagatatgaggatgaaagctatttttaacgtatatccataaattatttgacactcctacctctaggagttggtgcctaatttccctccttttgaatatagactaagaaacttgcatctaacacaataaagcagaagtaaatgtgtgtgacttcagagactaagagattaaagagaatgtgcatctttattgatctctctgttgtatcatacactcaggagaagctagctgccatgtgtgataacagtcaagcaacactataaagatccatgtggtgaggaactaaggcctcctgttaagagcagtaacaaactgaggcctcatggccaatagctatgtgaatgagcaatcttggaagcaaatcctccacctctagcttgaccaactggcagcccaggacagctctgaatgcagcccaacacaaattaataaactttcttaaaacattatgggattttttgtgatttttttttagcttatcagctatcattagtgtattttatgtgtgcccaagacaattcttcttcttccaatgtgacccagggaagccaaaagattggacaccctgttttagaccatcaaagtcttggcaaatatcttgattgcaagatcatgagagattttgatcaagaactaccatccaagttgttcgcaaatttcaaatccacagaaacagtgagacaataattgtttttgttttaagccactaaggtttgaagtaaatagcagcaaaagataaccaacatagagagcatcattacagatcctaaagacattaaaaggataataagggattattgtaaataactttaagccaataaaatcagaaacctagatgaaactaacaaattccttgaaagacacaaactaccaaagctcactcaaaaggaaagagaaaatctgataatagagacaacacctaaaactgattacatattaggtcacaggaaaaagtaccagtaagttccatggagacttttttataaacaatactgtctaattacaatacaagaaaaattagaaatcagcaacaaaattaaaaaccaaaaaggaccttccacgagaaaatttttacaacctattaaggtgcatagtaaattgacatcatatagcttctaaaaatggtggttataaggctacatgtcagcatctataggatacttttaaaacactgatgagaggaaatgcaaagccttaaaaacttacatacataaaacctgctcactggccaaatctgggacaattcgaggatcaaaataaataatgattataatcaagtaatttttttaaaagtccatgcatccattctaatataattaaataaatgagaaagcaggcaatgctactccttataatgaattgccacttcataaatatagaaatgacaagagttagaaaatcatcatttggcaaccgtgatagtaatagtcgactcaagcaaaagtcaatggacgctaaaaccagagaatgtgtgtgaaagtttgatgcctcagagtacctccccaaaagtacttattaattacaaaaggagactctgacagatgataccttaaccaggtgatcaaagttaacatcattaataatggaaccaaccaggtaacctcacaagccttgagaaggacaaaacaatctttctgtagtatccctgccaaaaatgcattagctgaatttaatagtgaggaaatatcatccaaacccaaattgagatacattctacctaacagccaatctgtactctttaaaaatgtctagcttataaaaaacacaaacagactgagaattgttccaggttagacatgacaactaaatgtaatgtgggatcttaacaacagatggtaggggatgggggtataaaacatacaactgtatcataaacaaaatttgaaatatggactctatcttagataatagtatatcattaaatatcctgattttaatcactgtactgtggttatgtatgagtgtgtcctcgttcttatgaaatgtatgctcaagtatttagggataaaggggaactacgcctgatttgacctcaaatggttcaggaaaataatgtgtatacacacccacccacatacatatacttaacaatgatcagtaaaatggagaaaatgtaaactggtgaatctaggtaaagggtatactggaattacttgtactgtatatccttgctacttttctgtaaatttaaaatatatacaaaatatttttagacacgtaaaatgtttaagatttaaataaactgctaaggcaggtacaaattggaattctagctatagcaatggtcataaaagaaactttcatctaatctcaattctaatgggtgtacttgtttcctaaaaggccttagcagatatagacatacataacagtattttgcctaaaattaggtataacatgcttcctgtaaaaaaaaaaaaaaaaaagtaacttaaaatttttcaacttttctaaatgttgtctacaagagaatcatattttcagctaggtaattcaagaagaatacttctaattggagagggaaaggtggattaacttttttccatatggaataatgaatttttaacctctactttctgtgatggtcatatggtaattccacatatactcaaagactatgcgtgatggtggggaagtgggcacaaggttgagtgtaatggtcagaaaggaaaagtctacactcctaacctaaggtatcctggtgcaatgtaaagagaaaaaaatccaggactgaaatcacacagcctgcgtttaagggattctgatgtgatcatcagcaaataacgtctccggtttcccataccttgatttcttcaactagaaaatgggaatgatgattcttttaaaaatttctgcctcaaagggctgaggattaagtgaactatttacctggaaagcgctttgtaaacttcaaaaccctacacatgtgttagtatgtgtaataaactccatatgagaggccactggaatcagcaaagttaattaattccattgctgtcatgcttctcctagaagatattgtaactgtgggtgtacaggtacatacgacttggcaaagggccaaaataaggttttcttcccaaatgttctttctacaggaaacacgaaaataattagcccagattcccgagtgaactcatcaacatccgtggaggtggagggtgttaaaatcgagttaaggcaaaatttacaaaaaaaaaattaaaaaacagtcaattgcgggacactgaacgaagaaggaagccaaactcggggaagggctagggagagaggaggcgtggccccagccccgctccacgccgcgcgcctcctcgctccccatccagcgcggcgaccaccggggtggcggcgacagcggcgcttctcaaacctttagtctcccaagagccgttacgcgccgcccctctcaatccccacaagtctgggcccctaacctcctagcccgtcacagacttctccgcgcagctacgctgcaagaggctctcttagctagaaagcaaccactgggcgggtacctgagccgagatgaatccctcatacacggttttcgaccggttctggggcagaagcagggggcactggcgcaacaggctcgcttccgtcaccgccatggctcgaagtccggagaaacacagaaaagctctagacctgctgggtcctgcacatgcgcagtccgct

SEQ ID NO: 123 - DNA, 64952 bp, Homo Sapiens
tgtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacaggtatcttagactggactaattttgaagtaagagctgggaattcctgacccatgtggaatagttcccaagctacaacatgtgcatcttacgccctccctcttaaaacattctctacttgcagcaagcccaaaactgatgaatagggttgctttattcaatcttcagagaatatctgcagcttgtcatagtattttgaagctattatgtgcgtataccccatgggtaactgaacatgatatttcctggcattcttcctgaaaaagatttctcagttgaagaatttgcctctcttcaaatatgccattttgtaggaattttctaaagacaatttggttgtagtcctagataagtgccagctttgatatttggaccacaccagaactttaaaatgtagcattccgatgaattgtcaaattgtttttctcttaatgttaccaaagcatgtttgcattctgaaaaagccagactatttatattttatagataacagtctgaagtttagaatgtagaatgtcacttttattttcagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggtaataattttgttaaacggtattttgtattgtaactgtactgttaaagagaattttggcgaatagttactagtgatggaagttattgacaatattattataaaaagcctttacgtctattatctcagaacagatggtgataaagaatatctgtactttctgtcatccattcaaatcagtgtcttcactgccttttgctgttattgttgttttctttttcttttcttctattttaagactaaccagataattagtgtcagatgtagatcatgagagcctagtcatggttgggacagtgatctaaaatagggtatgaaaggagttttgaaattaataaagattggtagtggatatgcggtgtctcttcttggcggctaggtaaaataatgacataatgtatgccacatacctaacacagtgccttccagttgagtactccaggaatataaaataagatgaagtagtgggatgtggttgcaaacatcattcatatctttgcactgaatgaagttgactttctgtttccctcttctcctaagggggattttgcctcttctactcaaggtccaggtcattaatattttatgcttaatagtttgaaagcctttgtaggccataggggataaaggtggtggggactcattaaaaaatgtttggctgggataacacttaagatttgaaagagattagagagaagaaggctaaagacagagtatctaatgaggggtagaagggatgtaggatgacttccagatttctgacttggaaaactgtgaagattgtgagttctgggtggagagcaggtttagggggaacgtggaaagatgatttagatgtgttgagtttgaggtgtctatgaggaattcagctgtagatattcattaggcgatacttgatagaagtatggatcttgctggagagttctgaggtagatagagatacagatttggaaattataaacatatagatggtagttaaaactatagtagttggtgatgataggaggagattatagagcaagaataaaagagggaaaggtagggaaagttaatttcatttagggcaaagacatgaatttctctgccagtttttgaatttgtatagtcatttctttggggactgtaaacgttattgtattatatctctgtattagggataattgtcatcttttttaataattgatcttcctaattatattcaggaaatgaatataatatatttttccacttattgatatcattccaaattaaattaatacatagcatgttaaaaatttccatctgagaggggcatttaaaaaattttagcttgaggccaggagtttgagatcagcttgggcaacatagtgagaccctgtgtctacaaaaatgaaatgaaataataaaacacttaaaaattttttaaaattcaaactgtatggaatacgttttgaagatttagctggtaattattttattttcaaaacatttctaggcattagatttttttttaacagcaaggctttatgaatataatgaaacatgcattgacttcattaataaccagacagccctgacagcttacaccgcattgaatattccagatatacattccaataggtacacctgctccatgaggcacacaccaccatttcctcttctacaagatgcttgagaattcttcgtgaaaagaagtaatgtatttggcttacttttcatatgtaatagttctggaaggcatattgatacatgtgccatataacaacaaaatgatttcactcaaaactgcctcacaatctgaaagaacactttgaattttggctatcatacaaaacatttttaaaagcatcaatccagtaagcaatctttttgtcttccttactgcactcatgacttttcaaaaatccttctattatatgtaaggaccatcacttctagcattaagctaaactgaaaatggtcactagggatattttatcttgcatcagtttttaattataattttacttgtttctgaagaataataagtataatgttatgtcttcatatgcaatctgtaccatatttttaaaagctcgataaatattttttcagtattaatcaagattcagtgttagtctcattggatttgtttttgtcttgggttgaaattggagtgatttttggataatctggttttattgtttaatcctgtgtttaatttgggaactatggtatactgagagctgttcctgcaaatcagtctacttggaagtgcattttcctctgtattgggaaatgaagtggtatatgggaatctggcaaattatcccagtattaatcatactagaatgggtgtcgagttcaaaccagaaagtgcagatggtggtttggtgctaccgaggaaatgttttaggatttaaaaggaaatttagattttaaagattacctcaaatgactatattttttaatgaatacacttaatttatatattgtgagctgggcgcagtggcttgaacctgtaattccagcactttggaaggccaatgccagggatcacttgaggccaggagttcaagactggcctgggcagggtgactctgcctctacagaaagtgaaaaaattagctttcactacattacaggtatgctggcgcatacctgtagccccagctgcttgggaggccaaggcaggaggatcacttgagccccagaggttgaggctacagtgagctatgatggatggcatcactgtgctccagcctgggtgacagagtaagaccctgtttctaaaaaaaaaattttttgtgagctttccacataaaatgtaacttaaaaaaaaatctttcccaaaatttcaaatataatttcgtattgctatttaaaattctgtgcagttttatctgttaagatttctcttaatctgtcaagtgtgcatatgggtatagccgtaaggctgaactgtggcccagacaatggaaactgaactttcttcctcttccatttgaccttaaagcagtccttttgagtttttttttttcttttgtagagaccaggtttcaccatgttgcccaggctggtcttgaactcttgagctaaagtgaaccacccaccttggcctcccaaaagtgttgagattacaagcgtgagccactgtgcccagcacctttgagtattttgatttgccctttgagtattttgatgttgcagttttttctgtagaagaagccctactgtgttcttgatcagcatagagaataaacctaaatcatttgctcttcagataatataactggtggtagttcactcactagaccatcaatatactgatgaaggaataatgataagggaccatgtataataggttgtttaacagaaccactgttatttttgcattgaacagatgaaactaaagaactttttttttcttaaggttgtaagagaactagtcaaatatacaaatcactttagaatcttggctctaagtgccacaccaggtagtgatataaaggtaagtaaaatgtttttccatttattacagttaagaaaataaagcttttggccaggtgcagtgagtcatacctgtaatcctagtgctttgggaggtggagatgggaggatcacttgaggccaggaattccagaccagcctgggcaacatggtgagacctatctctacaaaaaattaaaaaaatagtgagcatggtggcacacatctgtagtcccagctactccagaggctgagtcaggaagattgcttgagcttaggagatggaggctgcagttagctatgattgccactgtgctgcagccttggtgacagagcaagacccgtaatcccagcactctgggaggccaaggtgggcggatcacaaggtcaggagatccagaccatcctggttaacacggtgaaacccggtgtctaccaaaaatacaaaaaattaaccgggcgtggtggtgggcacctgtagtcccagctactcaggaggctgaggcaggagaatggcgtgaactcgggaggcggagcttgcaatgagccaagatctagccactgcactccagcctgggcgacagagcgaggctccgtctcaaaaaaaaaaaaaaaaaaaaagaaagcaaaaaacaaaaaacataaatgaataatccaaataataagaacttttatatggggccagatcagttttccattttggtatttatctagtttaacatgagaactacaacatttcctacaacctgcctagctttttttcagtggttgcaggactcccctcccctcccctcccctcccctttctcctctgttctcctccccctcccctccccttcctcctccctgttcccttccccttaccttacgttcccctcctttcctctcctttcctttctttctttctcttttttttttttttgacggagttttgctcttgttacccaggctggagtggaatggcatgaccttggctcactgcaacctccgcctcctggattcaagcgattctcttgcctcaccctcccgagtagctgggattacaggcgtccatcaccacgcctggctaatttttgtatttttagtagacacggggtttcaccatgttggccagctggtctccaactcctgacctcaggtgatctgccggcctcagcctcccaaagtgctgggatttcaggcgtgagctactatgcccagcccaggagtttctttaagttagtagttttcagactgcagtgtgcataagaatccctaaaacctgttaaaaatacaggatatttttaaatagtaaaatgatttttaaaagttgttactgttttcagttttttaaagttttgtttggaaataactttagattgccagaaaaattgcaaaaatagaagtcttcgtttggtcctctcccgtcttcccctaatgttaacgtatcatataaccataataaaattatcaaagccagaaaattagcattgctataccagtaactaatctgcagatcttgtctgaattttgccagttttcccactgatgtacttttctgctccagggttcagtctgtgatctcacattgtgttgtcatggcttcttagtcccttctaatctgtgatggttcctcttttttcttttttttttttttttgagacgaagtctcgcactgttgcccgggctggagtgcaatggcatgatctcggctcactgcaacctccacctcccaggttcaagctattctcctgcctcagcctcctgagtagctgggattacagtcacccgccaccatgcccggctaattttttgtatttttagtagagacaaggtttcactatgttggccaggctggtctcgagctcctgacctcgtgatccacccgccccggcctcccaaagtgctgggattacaggtgtgagccactgtgcccggccgcttcctcttttttcttgttttccatgaccttgatgcttttgaagtgtaggtgccagatattttgtagaatatccctcaatttgggtaagtctgatgttttctcatgatgtggtgacgttatgcatttgctaacaataatccagaagtgatgctgtacctttctcagcatatcctatcagggaatagatgatgttgctttgccttttttacttgtgttgtaatcttgacttagttaagatgatgtcttcttggtttcttcattgtaaaattactgttattccctttgtaattaataactgtcttgtgggggaaatactttgagactatgtaaataatcctgttttagcatccagtggtggttcttggcttgcaacaattattgttgtggtatttgcctaatcattctttctctcttttatatgcattaatttgaattcttctgcaataaagattttttttccttctgtgggccacagtccaatactattttatcaattttattaagattgttccagctttgtctgttaggagctccttcaagctcctgtgtcctttagacatgcactttttttttttttttttaaacagggtctcactgagtcctccaggctggagggcagtgcacaataatactcactgcagctaaatttcccaggctcaggtggttctcccacgtcagcctcctgaggagctgggactacaggtgcctgccaccacacccagcaaatttttgtatcttttgtagagacagggtctcccattgttgcccaggctggtctagaactactggtctcaaactcctgggctcaagtgatccacctgtctcagcctctcaaagtgctgggattattggcatgagccaccataccttgccactctttcttttgatgcttctgtaactttctgacatcataagatacattatgctcctttagtattttttcggcccagccatggaatcaacagtatgtctgggaaattctggtttcctttattgaagaatggtaaaaatgcagattttgagacctgtcctataatattctgattttagtagctctgaacggtcttccatattgagtaaggatttttttttttttttttttttgagacagagtctcgctttgtcacccaggctggagtgcagtggcgcgatctcggctcactgcaacctctgcctcccgggttcaagccattctcctgcctcagcctcctaagcagctgggattacaggtgcccaccaccatgctcagctaatttttgtatttttagtggagacggggtttcaccatgttggtcaggctggtctcgaacccctgacctcgtgatctacccacctcagcctcccaaagtgctgggattacaggcgtgagccaccacgcccggcttgagtaaggattttattggatacattctgtggcagccttttaaaactttttttttttatttttatgggtacatagtaggtatatatatttatggtatatatgagatattttgatacaggcatgcagtgcataataatcacatcaggctaatggggtatccatcaccttaagcatttattctttttgttacaatccagttatactcttttagttattttaaaatgtaaacttattactgactatagtcaccctattatgctatcaaatattagatcttatttattctatttttttgtacccattaatgtagtgtcccctccacccccctcgcccactacccttcccagcctctgtaatcatccttctactctctatctctatgagttcaattactttaatttttagctcccactaaaaagttagaacgtgtgaagtttgtcagcaagttcctccaggccccgggcaagtccagagatgccatctaggagccagaaactagagtcagaaaccttagaaatctaccttgtgctctatactactgcagctaagcttgcactcaaagcacaagatgaagtccttctcactctttctttccacaggcagaggagcctctccccatggtcaccactaccataggcccatgaggtgtactgccagtctactgctgattttcatttaaggcccaaggactcttcagtcagcttgtgctgaatgctgccaggcctgggactcacccttcagagaagtgggttcccctctggcctgggacagtttcagaaatgctgttcaagagtcaaggcctggaatcaggtccccaagagcccatttgttgcccttccccactgtggctgagctggtacctgaggtgtaagacaaagtctcctttacttctgcttttctcaagcagaagtttctcatcatagccatcattgctagagatgtgctgggtttcactggaagccagcatgtctaagagtctcacccaaggcccatgacatattacctgggtattgctgatggttatttagggcccaagggctctttagtcagcaggtaatgaatcttgccaggactgtgttcttcccttcaaggtagcgggtttccttctggcccagggtacgtctagaaaagttgtcagggagctagggtcaggaacggagacctcatgactctgccctgtcctgttgtggctgagctgatatccaggatgcaagacaaagtcctctttactcttccctcttttttcctcaagcagaaggaaggagtcactttcgtttatgtgagctgcccagactggggttgaatgaagggtggtgcaatcactcctttaactgtcccacctggtgtctcactaggtcacgtgccccccatgttcatcgtctccagagcatttgcaggaacttaagttccaaccactaggatggggaattcccttctagctagggctggtctaaattctccttctgtggtggcattgactgagttccacctggttttgcttttcactgtgacagagcaacacttagttcaatgcacagtctcccagaaactgcactctccttcccccaggttcttagattctttctccacaccacagggcctctgggggatgagggaggggtggtgtccatgattcaagattgtgtttcctggctgagcgtggtggctcacacctgtaatcccagcactttgggaggccaaggcaggcggatcaggaggtcaggagatcgagaccacactggctaacacagtgaaaccccgtctctactaaaaaatacaaaaaaatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggccacagagcgagactccgtctcaaaaaaaaaaaaagaaaaaaaaaatacaaaatattagccgggcgtggtggtgggcacctgtagtcccagctactcgggaggctgaggcaggagaatggcgtgaacccgggaggcagagcttgcagtgagccgagatcatggcatggcactccagcctgggtgacagagtgagactccgtctgaaaaaaaaaaaaaaaaaaaggattgtgtttcctacctcaaagtgcctcttttagcaatatgaagtgaataccaggtactgtgattgctcacttgatttttggttcttatgaaggtgctttttttgtgtagatagttgtcaaatttgatgttctgtgtgggcgattatctgtatttccatcttgctccatgcttccaatgatagcttttaactcttgcaagctgcaagacttttttcttctatccttttttttgatgagcttagaaattctatcctatctctggttttctccctgacctcgtttaaacattcatgtttttcagtcagcttaaaaatgtcatccccctttgggaggccgaggcgggtggatcacgaagtcaggatatcgaaaccatcctggccaacatggtgaaaccccgtctctactaaaaaaaatacaaaaaattagccgggcatggtggtgggcacctgtagtcccagctactcgggaggctgaggcgcaagaatggcgtgaacctgggaggcggagcttgcagtgagccgagatcgcgccactgcattccagcctgggcgacagagcaagactctgtctcaaaaaaaaaaaaaaaaaaaaaaaaaagtcatcccttcagaaaggtctattctaactaagctatcttgtcagtgttccttattttgttattttcttcttaacatttgtgataattggtcattcttttgcgtattgattattttggtctttcagcgccagtaaaatatcagctacatgaatgtagggattatgccgattttggtcgtttctctgtcattaactcaatacctggcatgtgggagttactcatgtatttctttcatgaatgaactattaaaagcaataagcttaattttataaaatggtcacaaatgtattctagattttgaatacgtataggccgccagtgattatggtgtgccgtattgggcactgcgccaggtattgggaataccaagatatgattcttgccccaggctgttccccgccccccccaaaaccaagccctcaaagctttctttttttcttttctttttctttctttcttttttttttggagacagggtcttgccctgtcacccaggctggaatacagtcgcaactgtagttcactcactgcagcctagaactcctgtgttcaagtgatacttcagcaggtgcttgccacttcgccagcaattgtcattttttttgtagatatggggtctcactatgttgcccagggtggtttcaaattcctggcttcaagcagtcttcccaacttggcctcccacagccctgggattacacccttaggcgtgagctgctgcccggcctaaacccacaaggctttctatttttgtttggacaccatggctcacacctttaatcccagcactttaggaggccaaggtgggcggatcacagaagtcaggagttagagaccagttaggccaacatggtgaaaccccatctgtacccaaaatacaaaaattagctgggcatggtgacatatgcctgtagtcccagctattcaagaggctgaggcaggagaatcgcttgaacccgggagtcagaggttgcaataacctgagatagattgtgccattgcactgcagcctgggcgacagagggaggttccaaaccgccccccccccaaaaaaaaagccgggcgtgatgcctcacacctgtaatcccagcactttgggaggccaaggtgggcgaatcatgaggtcaggagttcgagaccagcctggccaacatggtgaaacctcatctctactgaaaatacaaaaaattagctgggtgtagtggcaggcgcctgtaatcccagctactggggaggctgaggcaggagaatcgtttgaacctgggaggcggaggttgcagttagccgatatcgtgccactgtgctccagcccgggtgacagaacgaggcaccgtctcaaaaacacacacacacacacacacacacacacacacacaaaacaacttttaatttttacatactctcaggatcctctcttttttttttctttttaattgttaatcgcactgtcagtaccatagtctcctgctacagaatacaacagattatatgttttttctccagtttcctaattttacaatgaagtctctttataagctttgggtacatgaaatttagtcctggaaatatattcacatcatatatgttgatttaaatggaaaatattctactaatttatcaataattgattgagtattgctaatctgaaatttttgtctgagtctttataaagactctatttgtaaagtaccaaactacatttgaggaactttttggacatttacaaatattcttatttctcggatgcttggcttgaaggtctgtgtggggaaaagatgtttcggaagcacttttcacctgttgtgctacttctgatgtactttttttataggcttatcttctttcttttttgttacttaatgatataaatttctggtgcttctttcaaaattttactgctattttatttctgttagtgacttaaactaaaaaattttaacatgtagtttataatcatacttaattgatttcatataggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccaggtaaaccatttttatgacatttagggatttcataaataaactggtaattgaattatttcagctaacaggatttggatgtgataatatagttatcttatttttatataattgatatgttgaaaaaattctttgaagttaaaatttttggaatgagcactgtgttttgtatgtactagcaaactgttattgaaagggaaaatacaaaagatgggccatttgtaaagcaaataatagccttacatggttttgtatttttttaagtaaaccttataactggaatatagaacatgcacacacacacacacacacacacaaacagcaaaagtagacaaagcataagtgtattgctcagtgaattttcacaaattgcacacacccgtaacatgaacacgtactgagattcagccagaagtttctttgttttctttttgttgttttttgttcagctcactgcagcttccacctccctggttcaagcagttctccttagcctcccaagtagctgggattacaggcacatgctaccacatctggctaatttttatatttttgaatagagacgaggtttcaccttgttggccaagctggtcttgaactcctgacctcaagtgattttcctgccccgacctcccaaagtgctgggattacaggtgtaagccaccatgcgcccggcccccagaagtttctttgtattgaaatatattttcactgttgtcctccctgatctttatgcagcagtgcttttcatctggaaattacttcacctacctggcaacatttggcaatgacttgacacatttttggttcttacaacaacaacaacaacaacaaaaaggcaggagagaagggggaggtaacaggtgaaatgtggagttattattggcatctagtatatggaggccaggaatcagctaaacatcctacaatggataggacagcaaccccacaacaaagaattatctggctcaaatgtcaatattatagctgttaaggacctgcttagacaattgtcattttcactgggagaaatttgtggtaacacattgtttttctgtagttcataattagtgtcatggttgaacaacatggtttcacattttcattgccatggattaaagatggttacagaaatagataaccaaaaagttatctgtcacttaatctatagtaagcctttcttaaagagacattttgtagtaatacagcttttttgtttttaaattgtttgtaacaaaattctaagcattattgagttaagatatggcaaagtctttttgtaattgtctctttgatactagtgcatttttaattgaaaatcattccatttataacaatgtaaatatgataattcttataatcatatacaaatgtaatttaattttgttagtatttttagagtgccttattaggcagtatgatcagcaaagttggaagggaggaaaaaaaatgtattaaactagccataatttagaaaatacaaattaggcaaaaatttaaacacttacatactgcggtagtaggtcttcatctataggtctccttttgtgccattaagctcatttccgcctcaggactttttgtttgctgtctcctctctctggaatcctttgtccttagaacctcacatggtagacataccttatcattcacatgtgaactcaaatgttctcttctcaaagagagtctttgttcaccttatttaataatgatccctttcctctcaaagactctacagcattattgtgttttagattcttaaatgcatttgttataatgaaaatgatctactttctttgttcgcttctttattcttcggttccctccattggaatgtaaactatatgagagcagtgacaaataaagtcttagccacactatccccagcatttagaacagtgcctgttacatagtagatggttaataaatatttgttgaaaaaaatgcatcagtgagtaaaattaaatatattcaggacatttcaatttattcagtactttacaaactactctacaaatatctgctgaggacctaagtgccaaactggtctagatactgaggatgtaacagtgcagaaatcaaaggtcttcgttcatggtacttacacttagattatagtgtgtgtaggttgagagagagaggagttaagaaataaacagataaacgaatgtgttgttaaattacagttgtatataataattgcttatgttgatttttatatggatattatttggggatagatgtcaagtagttttaaatgttatcattgctgagtttacttaaacattcattgtaagacaaactttattaaatatataattcctattttaatatgtgagaaaatgattgtacttgaaaaaggactttagagcaagcttaaactagattgcttttaaatttgcagattttggaatcatttgctcgttctttgattcagaggaatgttttgatgagaagggatatcccaaatctaacaaaatatcagataattctggcaagagatcagtttaggaaaaacccatctccgaatattgtggtaggtatttttaaataaattttgatgacagattaaattttcactgaaagccaggataaaacataggtaatgatattttgggtacctattagctcatcaataattgaaaaatgaggccgaacacagtggctgatgcctgtaatcctaacagtttgggaggccaaggtgggaggatcacttgagccctggagttcaggaccagcctgggcaacatagtgaggccctgtctctgcaaatgtaaaagaaatagccaagtgtggtggtatgtacctactcaggagcctgaggcagggtaggattgcttgagcctgggtggtcgaggctgcagtgagctgtgattgcagcattgcattctagcctaggtgacagagttagacctgtcttaaaaaaaaaaaaaaaaaaaaaatcagaaatgtttatatagtttataaaagcatgagaaaaatctgcaagaatacaatgtaatgatttgaattaggataaattttaccttttaactttttcttttttttttttttgagacagaatttcgctctattgcccaagccggtgtgcagtggtgtgaccttggctcactgtaacctctgcctctcaggttcaagcaagtcttgtgcctcagcctccctagtagctgggactacaggcacgcatcaccacgcctggctaatttttgtattttttagtagagagagggtttcatcatgttggccgggctggtctcgacctcctgacctcaggtgatctgcctgtctcggcctcccagagtgtaatcccaaagattacagatgtgagccacagtgcccaacctttctttttaacttttaagaagaatttgtcttttagtctatttattttgtaaagtctcaaagccatgagaaggtagattgtaactgaattttagacacagaacatttattcttactctcaataccagagtttgaaggaagcatcacagcaagcttcttatttctaacctgcattggaaaaaaataaatggataaaaaaatatctatcaaactaggtccaaagtcagagaagacactcatagacacaaaaaagggcaccgagtcgatctttgaactgatagggaatgcctgtgcaaaagaacagaggcaattgaattaaagcatgtgggagacagtgagcagaccaatttggctgaggatttggaaactggatatgataatataggttgtactacatgagagtagctttaagtattataccacgaaaccggatatgataatataggttgtgactacatgagagtaactttaactattataccacgaaatgtggtctttatcatatagtatctggggaagcactaaaggagtcttttctgcaaaattatagtatattattatttaaaactttaaaaagatgttttgatttctgctaggaaatagtaaatctaaacctgttgaactagatcttaactggaactggtgagaggtaattagggtaccattttagggcatttgttagtatcctggaatatttaaaatcactaacattgatgttaagtgctactaaaaatgttagaaaacagtagtcttcatctcaaaggaaaataattagaatatgttctccatgctctccttaaaaactatcttatcagatagatacacataccatgtacttccataaaggaatgtgtccttcatttttccatgagagtagtggttgaaagcacaaggcctcttagccaaaattcctgggtctaaatagtggttctgctacttaacatttgtatgagcttcctcatctataaaatgagcataacatagctacctgctagatactaagattaagtgaattgtgcaagtaatgtgcttagaatagtttctggggctcagtgtcagatattttcacaggacgtatacttggtattaaaggttggcattaaaacagtctgattaaatatttgtacttttgccagtaacattcatgaggataggccatatctaacttatttcccatttccattgtatctagctcagtgcttgacaggtagtagatgcttactatatagttttgaaagaacaaatatatctatatactgccaattaatttacctgtaaagaaaaacaatataatttttttttcctttacttattatttttaaaatgtaagtttcctgtttaattaaagaaaaagaaataaaggggcagattttacatacaaaatacattggtacctttccatagcaacatcctataagatgacatttaataaccaatcggttatagcagtgtagaagggaatgatgattatgatcatttggattatattataaatgttacactgactatggcctgacaacttgggcatggagcatgtatgttcatttatttctctggttaaatttgacatatgctgtttttctagggaatacaacaaggcataatcgagggagagtttgctatttgtattagtttatatcatggttatgaattattgcagcaaatgggaatgagatcattatatttcttcctttgtggaattatggatggaactaaaggtaaattatatcaaattatttaaagaaataatgacatgtattattttggctaaagacatattgaagggctgggcacagtggctcatttctgtaatcccagcactttgggaagccgaggtgggtggatcacttgaggtcaggagttcaagaccagcctggccaacatggtgaaaccctgtctctaataaaaatacaaaaattagctgggtatgatggtgcacgcctgtaatcccagctactcaggagactgaggcgggagaatcgcttgaacccgagaggcagaggttgccttgagtcaagatcatgctgctgcacttcagcctgggcaacagagtgagactgtcttaaaaaaaaaaaaaaaaaagacatattaaagagtttggattacttaaaaatgatttattttaaaaagcattggaataattaacaaatggccatgtttctttgtttttaataaattcctggagaaaaggaaaccattcattaatacatatatgaatgtagaactgcaaaaagtttctggttttcatgtttacacttgaaaaacttacattcattgctaaagtttaatttctttttaataaataatacattttatcagttttattattatttatttgaaaaccttttcttaatttctgaagggatgacacggtcaaaaaatgaacttggccgaaatgaagacttcatgaaactctataatcatctagagtgtatgtttgcacgtacacgtagtacttcagcaaatggtatttctgctatccaacaaggtctggtttttcttttaaaattatgtattgtgttgtgtttcttaatcacagttaattttgaaattttgctcctttgatgcaaatgtctacaattatttatattttgtagcaacagatctgttaaatgtgtaaatatttcattttttaagattaatatatattcaaatttaaagtttatatgctttaaacaatgtttaaacttcttcaaacaagtttacaaactttaaacatataacagatgttggtaattgttagtggtagtaaaaattctcagaactatcaaaacctgatttatagttagatatgtatttttgctttctttgctactgattcctctttaggttctctcagaatgaaatttttatgaaagttcaaagttcattttacagtaagacttacgtgctacctagatgttacctctggtttaagttttttaaaaattaaaaaaaaatccaacatatgcattggaaaagataactttcatatacattagtgtaattgaatatggaaaaaaacagaaaaaaattttgatatttttgttttgttccaggagataaaaataaaaaatttgtttatagtcatccaaagttaaagaaattagaagaagttgtaattgaacacttcaagtcatggaatggtaggtcatatttagtagctttaaggcaagacaaagttattgcaagaggtaaaactttacttatggctgggtgcagtggttcacacctgtaatcccagcactttgggaggccgaggatcacgggaggtcaggagttcaagaccagcctgaccaacatggtaaaaccccgtctctactaaaaatgcaaaaattagccaggcatggtggcacatgcttgtaatcccagctacttgggaggctgaggtaggagaatcgcttgaacctgggaggtgaaggttgcagtgagccgagattgtgccattgcactccagcctgggctataagagcaaaacttgaaataaataatctcgaaaataaaacaaacaaagaaaaaccttcaacctattagtttattctaacatttcttatggagaaggtgggcttttaattaactctggataatgaatactaaaaagctgtgagaaattttggaagggctagggcaagggtggtggtgggaatgttaagaataaggtactatataagttagcatggggtaatataagggaagtggagagtaaaacaatatatagtaccagtaaaagagtaaagtagattaggagagagagagttatagaggagtgctgttttatatagcatggttatagaagacttctctgtagagggatatttaaagtgatgatggagataagggaggaagccttgtgagttttggaggctgggggagagataattccaagcagtaaaaatagcagattcaaaggccttgaggtggcagtagggtgcttggtgtgattaaacagaccagtgtggttagattgaggctacaagtatgactgagcctacaagtggtatagatgagaggtatgcagataatatcagactttagtttttaatttctgaatatttgtgctttgcaaaaccaaacagaggtatttgtagcagtggaatgacatgacattttaaggatcactctggtagttttgtggagcatagacattgataacctagaaaagtattacgatagtcttggatgatgacacataatagtggtgttcatcaaggcaatagtggtcaaggtgctgggagatagattctagatatatgttcaaattggagccaacttatttattgtatttgttgatggattagacgtatggtataagaaaaagggaattggccaggtgcagtggctcacacctgtaatcccagcactgtgagaggccgaggtgggcagatcacgaggtcaagaaatcaaaaccatcctggccaacatggtgaaaccccgtctctactaaaaatacaaaaattagctgagtgtggtggtatgtgcctgtagtctcagctactcgggaggctgaggcaggagaatctcttgaacctgggagacggaggttgcggtaagccaagattgcgccactgcactgcagcctggcaaaagagtgagactctgtctcaaaaaaaaaaaaaaaaaaaaaaggaaaaaaggaatcatatggctgggtatatacatttatgtgtacatgtttgcaaatgattacatgagcaaagtgaaaaatgaagaatagagataagtatgtgaggtaatatgtatgttaattagcttgatttagccatttcacaatgtatatagacatctcaaaacatattgtacaacataaatatatacaacttttatttgtcaattaaaaaaaagaataacaaaagaaagagcaaacatgttaagatgtttttgagacacctaagtgtcaagtaggcattagataaccaaatctggatctcagaagaatgattgctgctgtttttacatatttacatatatgtgaatacattttggagttatcagcataaaggtaatatttaaagtttcaggaatagatgtgattatcaggacaacagtttagagatatacagaggagggtccagaatggagtcctgaagaatatcaacagttaagagtttggaggaaaaaaagcttggggaggaaactggacaagtaaaatgttagagaagctgaagaaagagactatttcagaaggaaagaggaaagtgtgttaaactaaaaagtgtcgattgaacttggcagtatggaagttattgatgattttgctgaaaggagctttagtggaatgagggtaaaaaggcaggctgtgacagattgaaggagatacaggttttgtgatgaaagtagcaattcattcaggagctggtcacatacagagacttgatgcttgatgcaatgatgattcaaaagaagtttgtttagaataattttacttggaacagctgcttcttcaagtcctacgttttgtttttgtattgtaaattaactttatatttaataagtcatttattccttagaggagttgtgaagattaaatgagttaacatacataaaatgcgtagtgcggtccttggaacacatatgatgattaagataataaaaatcagtagaggttggatgtcgtggctcatgcctgtaatcccagcactttgggaggctgaggtgggcagatctcttcagcccaggagttcgagaccagccttggcaacatggcaaaaccccgtctctacaaaaaaattttaaaatgtagctgggcatggtggcatgagcctgtagtcccagctactcagagcatgaggtgggaggatcacctgagcccaagaggtcgaagctgtagtgagccatgatggtgccactgcattccagcctaggtgaccaaacatgaccctgtctcaaaaataaaaacaaacaaccaaaaaccccacacagtatgcaataattagccaattactatatgtgcaaaactatatactgtttcatttatacatcaatccatattagatatgaagaaactaaagcttaaagagtttaaataactaccatgatcaccaatcacccagagaattaagtgcccagccacaaagatcatgttcttattagtgcattctactgcccgccacccccctacctcacccgccccccagcacagacatatcgggagcagctttggaattcactgtagggtatgttctgcagttgtctttggagaatttgaaagtatagtagatttgaggacagaatgcatggcttggattaagacatttcctttagtgaacagaaaggaaagggaagacttatgaaattagggggagctgcatagttctgtgcttctggccatcttagaaggtaaagggaaatgatagccattatgcctgagttgaaggactagtcaaaagtgattcagataattcatatttgatttgtttaggattttattttatgacagccaatggtaataagctaagattattaaaattaatagagaatatagtttaaaaaatttcaagatgtttgaaattatttatttatttgtatgtttgtttattagagactgggtcttgctatgttatgttgcccaggctggtcttgaactcctgggctcaagcgatttccccatctcagcctcccaagtagctgggactataggtgtgtgccaccacatccagctgaattatttttttgaaagaattatcattcgttagcattaacactttcaggtttgtcttttgaactatttcttgtctaaatgctttgtaaaaagttgtaattaaagtttttatatatatatatagctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtaattatttttggaattgataaaaataaaaataagattgattagctttgcacttgttctttttttgttagttttaactcactggtcaattagctacttaaaaagaattttacagtaaacgtgtaggtaaaaataagcatattttgaaagatgataacaaatgttttatgtggttttggaacttttttttttttaaagtaatgtaaagtgtaaaagttaagcagaaaagctgtggaattatattaactgggttggaatcctgactctaccacttaaaagtttctttacttcctcttcctcagttttccttatctgtaaacatacatcatagagttgttgtaagcattgaaagagatcttattgtagagccaccaataaatgtttattaagtcgctttaataatttattctaaacaaataattagcctctttttatttatttaaaaatcttattttagaagtggggtcagaagaaaccatgatagtatttaaggtagccttatgctctgagtaagaggacattcggttttctaagtgctgtgatgttttgagggaaattttacattattgatttttataaaatctatgcagctttttataaattaactatgtaagtctatacttgagtagtgactgacaattagatatctctttaatttctaattaattttgacagatccttttttgattctgcagacgttagtagatgaggttttttttttgtttttttttttttttttagatggaatcttactctgttgcccaggctggagtgcagtggtgtgatcttggctcactgcaacctccgcctcccaggttcaagcaattctcctgcctcagcctccagagagctgggattacaggcacccacgcctggctaatttttgtatttttagtagagatggggtttcatcatcttggccagggtggtctcaaacttctgacgtctggtgatccgcccgcctcagcctcccaaaatgctgatattacaggcatgagccacctcgcctggctgggaggtagtcttcttcttcttttcttttttttttttttttaattttgaaatggagtctctctctgtcgcccagggtggagtacagtggcccaatctcgagtcactgaaacctccgcctcccgggttcaagagactctcctgcctcagcctcctgagtagctgggactacaggtgcccaccaccacgcccagctaagtttttttgtatttttagtagagacagggtttcaccatgttggtcaggtattctttttttttttcttttttttgagacggagtctcgctctgttgccgaggctggagtgcagtggcacgatctcagctcactgcaagctccgcctcccgggttcacgccattctcctgtctcagcctcccgagtagctgggactacaggtgcccaccacgcccagctaattttttgtatttttaatagagacggggtttcaccgtgttacccaggacggtctccatctcctgacctcgtgatccgcccgcctcggcctcccaaagtgctgggattacaggcgtgagccatggtcaggtattctttaaataccttttatacctgccctcactacaccgagaagcgtctgtttaagctgactggatatggtggggagtgccttcctgaatctgaaaataatacttttgcctattatcaagtcagattatacatatttttaaggcatctagtgggtgattactactcttaacatatatgtatgaatgaaaaatgaattggatttttgctgtggaggtcaagcattttcattatttgaaatacctgcagtacccaatccgatctctgatcaatttcagtattacctaaagtcattatttcctgagcttgtcaggcaccgtaagaacattattgattttactgactttatcatttactcatttatgtcaataatattttaaagtatgccaaagtaaaaactttttttattactcctatatgtaattgctttcataacagctgttttattttgaaacgagcttgcaggcaaataattgtacattgtccatttatttagaaacacgatattaagtcagaagaaattgggggggccagatcctttagggccctatatgtcatttccattttaatgactttctcttttactctgaccgagatgagaagttcttggagagtttggggcagaggatggtcttagctcggtttatattttaaaagaatcagccggacactgtggctcatgactgtaatcacagcactttgggaggctaggttaggcagattgcttgaggccaggagttcgagaccaactagggcaacatggtaaaaccttatctctaccaaaaatacaaaaattagctgggtgtggtggcatgtgcctgtagtttcagctacctgggaggctgaggagggaggatgcttgagcccagaggtcgaagctccagtgagccaagatcacaccactgcacttcagcctgggcaacacagtgagaccctgtctcaaaaaaagaaaaaaaaatcatgctggttattgtctgaagaataaactgtaggggctaagggtggaagtggagagaccggttgggagacttataacaatttaagctgaagatgatggtgacttggactagggtggtaacaaggaaggtggtgagaagtggttaagttctggatgtattttgcaggtcaagctgacagggtgtattgacaaattagagtgggatatgagataaaggcatatgaagtctgactgtaggatgactccaaggtttttggcctgagcaactgaaggagctggtattaactaagatggataagactgcaggaaaggccaggtgtggtggctcacgcctatattcctaacactttgggaggccaaggcaggtgtatcatttgaggtcaggagtttgagaccagcctggccaacatggtgaaaccctgtctctactgaaaatacaaaaattagccaggcatggtggcggatgcctataatctcagctacttgggaggctgaggcaggagaattagggaatatcaggagcttggttttagatgagttaactttgacatgcctctcagattaatgcttttcaaactattgaaactggtagaggaccagcttatttcccccactacatgacatactgatacttttgaacaataaaaatgaattactagaaagtaaaatgaatgaaaaataaagttctggtccaatttttaaaatattactagagtcagccaacaaaattactctgtcaagtgtctaaacccttactttcagttattgtacttaccttgttgtcagctagtaataaacagtttttggacaggcaccagtaataaacagttcatggagcacactttcagtagcagtcttttaaacatcaagcagagatattggataaacaattgaatatatgtcttgagtttgtggaaagggttcatggaagtgtatattcaatggcaaattaatatcaatcttaagcatggaagtaacagtttagtttatacatgttaactaaaaagaaaattgacattctttattaatctgttagttatattaagaaaaaatgtatctagcactgtggccttttttttttctttatctgggcaaaaaggacatctgctttactgtgttatatgcaggttggcttaatgtcagtacaaattccaaaggaaatgaattactcttaatgtttaatcatgatcattgtttctccctgtactccgaggatttccatattgaaagaaaatccttggaccagtgcaactgaaatgtttatgagaagacttaacataatacatttatatttattgtcctacttttaaggttgttgtttttcacaatacaactagcttacagattaagttaggtttttggagtcagagacactaacattcaaatgctgatgattattagtgagacattaggcaaatagcttaacttttcagattttcagattgtttaataaaatgcaatgataatatctacctcatagggtcgttggcagtagaaactaatatataaagtacttagtttggtacctggcacatagtgtgcccttgcacatagtagctatcattatttatcagctaattcagcttttgatgttgcattatctcacttaattaccacctccaccactccactgtacacaaactcacaatgttggtattggtctgtatggagaaactgaggctcagagcagttgagaactaagtttataaggcttaagggactttcattaactttttcattaactccttctcacgctattgtggtttcattaaactgatcagagaaatcctggaatggtagtataaaaggtaagatatgacttctaagagtaatacaacattcttacaaatattataagaaatatttataaacctatttcagataaagctatacatttaggtctaagatatgataaataggagtgattgctgtaggccatttccctgccctattcccctttctgtggtgctaaaagtaaactctgggttttctcattcagtgacgaacttaaattgttgacaaatccttttgacatcacaaccattactaaagcaaaataattagaactgtttattttaccataatctcttttggcttatattgctagttggttgcttcttttcctattctatactatccttgatgctgatttttttgctttgttttgttgaaacgaggctttactctgttgcctaggctagagtgcagtgtcacagtcatagctcacttgcagccttgaactcctgggctcaagagatcctcctgcctcggtctcccaagtagttagtgctacatgcatacaccatcatgctgggctagtttttttatttttcgtagagacagggtttttctatgtgcccaggctgagcttgagctcctggactcaagcaatctttctgccttgtcctcccaaagtgttgacattacaggcatgagctgtggccagccttgaggctgatttttaatctgattttactatttttcaggtgagtggggaaaaatatgctttgatctacagttctcttacatttgcatgtagttatttttcaattgtttttattttaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtgtaagtagagctgcagaaacacaatttgacacttgaaatttgagaaatacagcccaaaggtgaatatcaacatgttagcattccaagtccaaacactctgtagatagttttggtttattttcccccactttgtattggattctctcttgtaactaggagaatttttgactggagtcagtttgctaatttttatccatctaaagaaacacatttttaatacttaagtagtaattcagagatacctagatctaaaaaccaatatctattactttgttttactattttcctgtgcttctaaagaaggcctgtgctttgtgtttagtttacttttctttctgaactatagtaaactgagaatcattttttccttttcaagggctgtcaaaataactgactaaataagaaacaaagaacatgtatcagagacagtatgaagcctgaaaaacccaaaatatttactttctggccctttttggaagtttgctgatgcctattttaagtgataaggaacttgagttatattcatactgtgctacaatcttgagtgacaggcctttctaaataagatgttacataaaatattattttgtgtttgttacactaaagtattaactaacttttgtaacttatcgagactagttcagcagccaaatatatagattcacattaaaggtcttaacagccatgataatttttaaaaactgattttaggctggacatggtggctcacgcctgtaatcccagtacctttaggaggctcacttgaggtcaggagtccgagaccagcctggccaacatggtgaaaccccgtctctactaaaagaatacaaaaacgagacaggtgtggtggcgcacgtctgtaatcccagctacttgggagtctgaggcaggagaatcgcttgaacctgggaggtagaggttgcagtgaaccaagatcccaccactgcactccagcctgggtaacagagcgagactccatctccagaaagaaaaaaacaaactgattttaaatattttatatactctttaaaatcatcctgaaaaatgaattatttctctaatacttttcatgtgattatagcatattcatatgtaacatctagtttatccataaaatgatcctaatgaaatgtttggtaaaaggccgtgtaatatcagtgagtggaattgggttctaattgtattccctagccaagttacttaacctctccattcacttgttaggtttcttatctgtaaaatagtaacagtggccccgtttactcagtatttacattgtgctgcgtaatgttccaagtttcagattcattattgtatttaatcctgtcagcaccctgcaaagggagtaacgcttttgttgtatacagggaaggaaactgaaatgtagaaaaacgaacaaactgaaataagggaatagttttaaaaaaacacaagacaaccttacacttctatgtaaatatcagtcttttttaaaaacagcaagctaacaaagatagatttactttatgcagtataactgctaaggtgggcttttgtaataatggactttgaaatgattttctttttaaaaaaaaaaaaacaaaaaaaacggagtcttgctgtgtcacccaggctggagggcagtggcatgatctcagctcactgcaacctccatctcctgagttcaagcgattctcctgtctcagcctcctgagtagctgggactacaggcgcatgccaccatgcccggctaattttttttttttgtattttcagtagagacgagggttcaccatattggcgaggctgatcttgaactccggacctcgtgatctgcccgcctgggcctcccaaagtgctgggattacaggcgtgagccaccgcacccagcctgaaatgatttccattaaaggttaatctaacagtttactgataggttttaaaattcaagacagctgggctcagtgactcacgcctgtaatttcagcaccttgggaggccaaagctggaggatcacttgagccttggagttcaagactagcctgggcaacacagggagaccccatctctacaaaataaagattaactgggtgtggtagctcacacctgtagtcccagctactcaggaggctaaagtgggaggatcgcttgagcccaggaggttgaggctgcagtgagccctgatcacagcactgtactccagagcctggatgacagagtaagaccctgtctcaaaaaaaaaaaaaaaaaaattcaagacaacagaagctccattttctaagtatttaagtggatcggggtttaattttatgtttacaataaatccaaactaataattgcttgttatggataaattgttatttataaaagtaatataatctgacattttctatttgtttttacagatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggtaaataaattttgcatttgacacatgcatttttcccctgttcttacttagcaggtcgtatcttgatataatatttcttgtttgaaaaactgaatatatgttctaattaatatattataggcattctctttggaaaggctgtacgagattattcatgtggcaaatggagagacactggtagtatagagtgacagaaactcagtgttggggaaaattaaacataccctaccaacccagagaatgttctccataaagtttagaaaagaaagaaaacagttttattttttaataagcattaaaccagattacaatgtgcgctgaagataatgtactaagataataccaagacagaaagaaattccctatatgtatccccaagcacttagaatcctttacatacatgttgtcaatattaatagtaacttgtcctcatgtaagagggcaccatttgctatacattccttcatagtttatcccatatttacctggtaattgaggtagccatttgtgttagctggttacctttctcaaatatcttgagatatttgcactatgaaagtgagaaaaaatgtttattttttggattttacttaatctctgaagtgggttttaaacaatcataaaaatcatataactaacatttggaaggaaccttgggagtcatgtggtccaattacttatcaaggtaggaatgcttctgcatcattcttgttttaaatgcatagccagtctcaacttgaatacctctgttaatataaattatatttctttagagggttcattccattgttgaacggccctgtatagtagaagactcttacgctgaaaaatctgtgtctttgtacctttttctcattgatctggtttcttagataaaaagtacagttttcatctttggtttacctttataacagttctctatatatttgaaggccataccttttatgtttgttcaactgtttgttccactgttgtcataccatgcatttttaaggttcttaccctcctactacttgctttcaattcagatttgttaatgttctttcccttaactcagagccgtcaatcaatgtttttttggctatgtctattaaacttaatacaaatgcacttaataggaacatacctgtcatttttcaagattttgccaattatttggttaaaataaaaacacagcatgtcttttgagttttcttgaatttgataaattaataaaagcatcaaaacttgattaggttggataaatcatttttagtgatcattatattttttatagttgctaattaatcttatatttaataattatttctaaaatgttactgaggtcgatggcaaattctttagtgaatatctggaacctatccttttaaaaaattgagataatgttaacttatgttcatttttctatacttgtttcttccccttttctctgatttttcaagtgtcaaagatttatcttagattatgtgatttatgtatggaataattctataattctgtactagtatataaatacactagtgtatttatactaatatataaaatatatactagtgtatttactatgtattttgctaatgtatgctaactatatactagtgtttatacatagtatatattttatatatattaaaatatatagtatatattatatactatatatagtatatgtagtattatatatagtgtatttgtagtatatattatatacactagtatgtaattcatctgagcttagagctctgaattgactattttttattttattttatttttttgagacagtctcgtgttgtcgcccaggctggagtgcagtggcatgatctcggctcactgcaacctctacctcccaggttcaagcaattctcctgcctcagcctcccaagtagctgggattacaggcacatgccaccacacctggctcatttttacgtttttagtagagacggggtttctccgtgttggccaggctggtcttgaactcctgacttcaggtgatccacctacctaggcctcccaaagtgctgggattacaggcatgagccactgtacccagccactctgagtttattttaagggactgggggtacctgcctatttcgaaatcttagagtctctggatgtcaggtctgaaaggggcctgagagatcatttagttcaaacccccttattttacagatgaggaaacagatgcagagaagccttttatttatttatttgttttttttttttcatttttaattttttattttttacatttttaaaaagcttcttacacaagtttggaatacctgagacatgatcctagctcatcatgaagcctcaactcctgggcttaagagatcctcctgtcagcctcctgtgtggctaggactacagggatgcaacaccatgcccagctaattttattttatttttttagacttggggtcaagctgtgttgcctaggctggactcaaactcctggccttaattgatcctccctcctcggcctcccaaggaggaggtgtcagccactgcacccagccagtttcctgatttttaattcagtagcgtctcaatttttctgctctcatctgtattagccagagttactgctttgtactatttagccttttcagtttggtgattcttagagattatagaagctgaaaagaatgaatatactatacatatttttaaaagtctattatgtccttttttaaagcaacaagtctgttccccctacactttactcattttgccccaacccccatttaagacttaagatacatactccttttaaaagtcttggcctttcctgcccactctcaacacccccaccaagcttcagatgaactttccaatactgctatgatagaatcataataccagtttttcatttgtgagttatcttactctgtttcatgccaggtcttaggcaaccaaatgaaaagagtccaaaagaagccaggactgagagccaaggtacctggctctgttctgttaatggattcattaccaaaggatagctcctagacagatgggtactttcagaggtaagagaagtttaggagacatttagaagcatgaagtaataaactgagtggttttttatgaagaatactagttttaaggaatagaatcaaggctgaggtaggatcagttgagcccaggagtttgagaccaacctgggcaacatatcaagacttcatctctacaaaaaataagaaaagtagatgggcctggtggcatgagcctgtattccagctcctgtggaggctgaggcaggaggattgcttgaacccaggagtttgaggttacagtgagttatgaatgtgctgttgcactccaacctgggtgacagagtttgaatggatattgtgggtttttttgctttgcagatttttaaaaagtctcttttccattattttttcaacttataggaatgaggcaaagtagcctaaagaaagattggttcttatcagaagaagaatttaaattatggaacagactttatagattaagggacagtgatgaaattaaagagataacattgcctcaagttcagttttcttctttacaaaatgaggaaaacaaaccagtaagttgaatatattttcagatgttcttttcccccccctcattttaatgccagaacccctcagatgttctttataatgatcaagcaatagctttgggaataatgagataattgtgattggaatgtcaacttactttaagaaattaagaatgtaatcagtgtaagaaatcattaaagtctaagtttacaaaactactaattttcttctattatttattgtatatatgtatttaaccaactgtgatatttttacataaattatgcctttctttcattactgtcatttaaacatttctatataggcataatcttacatggttgtcactttactctgtgatataccatagtttgcttgactatttacctattgtgttttgggattcttttcaacttttttttttttttttaagagatgaggtctcgctctgttgtccaggctggccatcagctcctggactcaagtgatcctcctgcctcagcctcccaagtagctgggactataagtgtacaccactgcatctagctttttcagtattttactaacataaattatgctttcataagcatccttgtaaaccattttttttttaaatttcaatagtttttgaggaacaggtgctgttttgttacatggataagttcttagtggtgatttctgagattttggtgcacatcatccgagcagtgtacactgcacccaatgtatagtcttttatcccttgccccactcctactcttccccccgagtccacgacagagtccattatattattcttaggcctttgtgtcctcatagcttagctcttacttctaaatgggaacatacgatgtttggttttccattcctaagttacttcacttagaataatagtctccaactccatccaggttgctgcgaatgtaataatttcattcttttttttatggctgagtagtagtccatgttgtgtgtgtgtgtgtgtgtgtgtgtgtgtgtgcatgtgtgtcacattttctttatccactcactgattgatgggcatataggctggcttcatatttttgcagttgcgaattttgctgctataaatatgggtgtgcgagtatctttttcatataatgacttcttttcctctggattagatacccagtagtgggactgctggatcaaatggtagttctgcttttagttctttaaggaatctccgtattgtattgcctagtagctgtactaatttacactcccaccagcagtgtaaaagtgttcccttttcaccacatccactccaacatctattattttttgatttttttaattatggccattcttgcaggagtaaggtggtattgtattgtggttttgatttgtatttctctgataattagtgatgttgaacattttttatatgtttattggccatttgagttccttatagattctggatattaatcctttgttggatgcatattttacaaagattttctcctaccctgtgggttgtctgtttactctgctgtgcaaaagcatttagtttaatttagccccatctatctttgtttttgttgcatttgcttttgggttcttggtcatgaactctttgcctaagccaatgtctagaagagttttttcaatgtgacagaatttttatggtttcaggtcttagaggtagggcttcgatccatcttgagttgatttttgtataaggtgagggatgaggatccagtttcattcttctgcatgtggcttgccagttatcccagtatcatttggttgaatatggtgtcctttccccactttatgtttttgtttgctttgttgaagatcagttggctgtaaacataaattatgctttcataagcatccttgtaaaccaaaacaaaaaataaaatttttgttttgaaattatatttaaaactttaaatttgatgttattgtttattttgtttattattaacaaattctttgttaactttgtgaaagtcaagagaactgatcaaaggttgtagatgtgcctggagagctgggaaaacaacctcagaaaagatttcttttaaaatatttaactgtttgctcttaacatggaactatataaacaggaatattgtcaacttgtaagtcatataacagttacttaacaaatatattttaaagggcatctttctgctttatgaaattattttctttttttcttctgagattttagttgggagtatctaaatggatccaaattatgttaagctgattatatgtatattgagtgttttttaaaattagtttgtgaaatctcagtatgttttcatcatttttattactttttaaataattaaggctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagaggtggggttttattgtaactttctcttgctggtatgatagtaaaactagagtacttagcttttatttttcttaatttgaagtaataagaaatactttgtttttctgtatagttccttgtgatctcagtaaagaatgagttttctgccttaagagaagaaatagatttaattaattagaagaagaatatcatctgtaaatattgatagaccagagtagaattttaatatacttaaatgatttatgtaaactgtttgtaaaccttatttaggattcttttggattcggatttattgaaatactctctgtcatctaggttatttgatatctttcttgtatcctggtcctagtttagagaattatagattccttgagcagttccttgattattcttcctagagtcagcatagtgaaccaattatgagtgtgaaatccatagtgcctgggttagaatcctaactctgcctcctactgattgtgtgtttgtaagttatttaacctctcagtgcttcagttttatctgtaaaatagtcatagtgataatacttatttcataaggttgttgtgaggattaaatgacctaatatatgtaaagcacgtagtagctggcatatgataagtacacagtaaattgtagctcctatttttattattagcctttgatcatgcatacatgtaaataaagtagttagatgtggatcccagcaaaatgtgtgcaatcaaattaacatatatttattgagtgccttctgtgtgccacactctattccctgctttatggctataaccgttagcaaacagagaaaatattctgtttatgtggagtatatatactagcagggagacagacatttgctcacattaatgcttattatatttattattcaaaaaagcagagggccaggtgcggtggctcatgcctgtaatctcaggctttgggaggccgaagcaggcagatcacttgaggtcaggagttcgagaccagcctggccaatatgaggaaaccctgtctgtactaaaaatacaaaaattagctgggtgtggtggcacatgcctgtaatcccagctactcagaaggctgaggcaggagagtcacttgaacccgggaagcggaggttgcagtgagccaagatcaagtcaccgtactccagcctgggcgacagagcgagactttgtctaaaaaaaaaaaaaacaaaaaaaccagagaggtaactgcttaagtctataagtagtagaggaatcctgattaaagtagcattcttaggggaaaggagggatggtggagattgtaagttttagctaataacttagagataagtaagacttagaaattcactatacgaatccttgattaggaactttgttacaaatagaagtatattccaggatacaacctagcagacatacaggtactactatgttggacattccaaaagctattcttagtttactgtcattgaaagagtaaatttaacaaatgtatatggtttttattaatatatgtttttaaaatatctatttttaagaaattagaataattcagttaaatgttagaaatgtaaaactcactatattcttatgtattcattcaatttgttcttcctacaaatagttaccaagggtcttttgggtattaagtactggggatacaaaaaagttaactgattaatgataacttgatagtttcacagtagtgtactttataattttgatttatcggaataacttttaaggtataaaagaatatcactggaacaatgtaataatataaatattttaatatagagtgaaactcctctcttagatttggctttctgttttgttttgttttcctgtggctttttaaattttccttatttatagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaaggtaagattccatctttataaagtctataactctttctagaataattactctagaaatactttggtaatttttccaaatgtaattttttagtacatggtacaatataaatattgaattagataattgatgtgttatatttttcttaagatgatcttactaatattagatttatttacatatacttatggcacgcatggtatggaaaaagttattcttgctagacattatgaaatacacgaagatgagtaagatctggccctaggtcttggttgtaaaacataattatgtgacatacgtatttgaaaagatgccagtaaaatgtggaaataactaccaaatgaataataagagagtggctgtttaggaggttcagaggatgatgaaattttgaggttgattagattggactttttttgtttctttgttttttttgagacggagttttgctcttgttgcccaggctggagtgcaatggcatggtctcggcttactgcaacctccgcctcccaggttcaagtgattttcctgcctcagcctcccaagtagctgggattatgggcacccaccatcatgcccggctaagttttgtatttttaatagaggtggggtttcaccatgttggacaagctggtcttgaactcctgacctcaggtgatccacccgcctcaccctcccaaagtgctgggattacatgtgtgagccactgcgcctggccaagattttatatatagtgtagattttcatttgggttccttgggaatatttatgcttttggtatgttgaagatactaaagacataatttaggtgttacaaaatgatgaaagcgaggggaaagaaggaaagtatgattttgggagatagtttgaagtaatagttttatgcagcaaaatatttgagaaataaaaactgtattcagaagattgagaccagaccacaaaaaatcagagaaatctctgggtttctgtaatctaaccattacacttacagaaaaactagatgatatagtgatagatgtttgatatgaagtcgtgctgtataatacaactctacagattattatatcaagtcatttatgaattttactccttatgttaaaagctgaataaaaagtagctgtaggataaaaggaacatttcctctgtaaatcttttccttacattattctcgttagcatggaggacatggttcgtgaatgttctatttaagatgaaagcatgttggaagtaagtactggaaatacatttaattttcaaaacctgactattctatatagtctggggttgtgccatgacatatatattttttcaaagtgtatgatgcctgtgagccttcaatatttgctttaatacctctatatgaagtccacgttaatgagtgagataatttttctggttttgcgtcagatttgcacaaaaacattttttctaggattgtacttaactacaaatcatgggcaaaataattacaaacacgtatcatggaattatttattagagaacatttagttattttttattctacttaattcaagacagaatttaagctcattttctgtattatatatgaaaaacatagttcattaaaacatcatgaaagcactgaaaaagaaagcctcctagaatgagttggttactatagccgagtcctgcatttaactttggcttccttataaggtaatgaaaaaagaaaaactagttgatttatatattgttcatctgcaaaaaggaaatcactcaagtttgtctgtctgggtagatgttttagtagcagaatgtgaggagaaatttactgagtggttttgtatttgttatctattgctgtttaacaaagtacccccaaaaaactcagtggcctaaaataatcagtaaaataaaataagcttcttagaaggcctgttgtttgagaggatctgtgaggagcttctttaaaaaccttaatgggcctggcgcaatggctcatgcctgtaatcccagcactttggaaggctgaggcgggtggatcacctgaggtcaggagtttgagaccagcctggccaacatgatgaaaccccgtctctactgaaaatacaaaaattagccaggcgtcgtggcacgttcctgtagtcccagctactcaggaggctgaggcaggaggatcacttgaacctgggaggcagaggttccagtgagccgagatcgcgccactgtactccagcctgggcaacaaagtgaggctctgtctaaaaataaataaataaataaaaataaaatccttactctctgactgaatagtactgtaaggcacaatctttgatttttaaggaggtcttaacaaagcatttaaactataccctcagctcaccctcagcttcataatattttcctggctgttctctgggtttgatctttgcctagaaaatttcttaattttatcattgttcgccatcaggagaggccgggagttttcataatcagcaaattctaattatgtttgtccttaatgtctttctttttgcattttgctcttatagcaaaaagcaacattttgtctggaagtcttagctagatcacctctcatagattaggtacatcattttctttctttcttttttttttttttttttttgagacagtctcactctgtcacccaggctggagtgcaatggcacgatctcggctcactgcaacctctgcctcccaggttcaagcgattctcctgcctcagcctctcaagtagctggcactgtaggcgcctgccaccacgcccgactaatttttgtatttttagtagagatggggtatcaccatattggccaggctggtctcggactcctgaccatgtgatccgcctgcctctgcctcccaaagtgctgggattacaggtgtgagccaccatgcctggcccattttttgcttttcgtgctaactgcaatgatgccaaattttctggtactacattaaaggatttaagatttttcctacttttctttaagccctcacccaccatttcctcaatggccaactaaccttcctacaatttctttgaggctcttcaagccttcgttcactaaaactgaagtcctttcagcatccaccactgtctagttccaaagcgactttcccagtttaggtttttgttatggcaactccctatttctgggtaccaaaatctgtattatttatctattgctgcatagcaaactacctgcaaaacttaacgatgtaaaataacagacccttgttacctcaaggtttctatacaacaggagtttaaatgtggcttagctgagtggttctggcctaggatatttcatgaggtaatagtcaagacattggccagggctgcagttatctgagagcttgaatagctttggaggatctgcttttaagatggctcagtcatactgctgttagtaggagaccttggtttcttgccatgtggacctcttcgtagggtagtttgataagtatgtggtgtttttttttttgttttttgttttttcccccaccaggcagggtctcgctttgtcactcaggctagattgtagtggtgcaatcacgactcactgccacctctgtctcttgggctcaagcaatcctcctgcctcagccactgggaccacaggcacgtgccaccacacccagctaattattgtattttttgtagagagggttctgtcatgttgcccaggctggtctcaaactcctgggctcaagtgatctgcctcctcggcctcccaaagtgctggaattacaagcgtgagccaccactcctggcctggtatggtcataaaacataagcatctgacttctcccagtgcaagtgatgcaagagagaaagcaaaaatgaggccacaataccttttatgacctagactcataagtcatacaccttcattttcattatatcctttttttagaagcaagtcactaagtatggcctgtacagttctagttacaacattttgtattgaattgtatcttaccaatttttatttcatgtacacaaatacatatggaaaacacatatataacaaagaatcttttaatatattgttttgtagcttgcatttttatgctttaactctttcaagtagaaagagaataagacacaaagggcagaaagactgcagtagattttagagataaattctattaatggaaccagtgactaatgaaattactttttgtgtttttctggcctcatttcagttaatttataaaattgaacttcattcaaatatgtgtttattagcaaaagatattgtcttattttcttcactggcattttaatttttttgtctcttgtttagattttttgttcagagttctccaagactatctttttttgaaagtgaataaatgttgagattgcgtgaaataattcttaatgtagccatcaataaaatagattgttatgattgggtaaacctaaatctattaaccattcattattttaaaaaataaattatagatggacaattattaacaagtaacgaaagtgaagatgacgagattttccgaagaaaagttaaaagagcaaaaggaaatgttttaaactctcctgaggtgagtcattcagtaatcacaatagtataatcatatcaaaggctattttccttttataccttgggcttctgctgagacttttgttgccttttactttatttacttactttaggatcagaaaaatagtgaagttgattctccacttcatgctgtcaaaaagcgcagatttcctataaacagagtaagtaaataccaggtaatgtatagtaatccaaattcctttggaataaaaattttgagagaaatatatgtgtagataaatataggtatttttaatccttagtagaaaagttgatattctattgtatgtgattggaatttctagcttctgttagttttcaaagatgtattcactgtaaactttcctaagcacaataaataaaaatattaagtaattttagactctttaaaaaccatcctatttttgtcagtacacttgagcaattcggcaagcattcattaaatacctcctatgtgtctactgtgtaagatgctggagatactctcaagaatatatcctaaaactgtcataagttactcaataggagagacagagaagtaaacagataatttcagtataatttttaaagttgagtgataagaaaagttaagcccttaacctcgatctcgggagttctggcaagcttcttgaaggtcataccttagttaaaccttaaactgtatttggcagtgaggccaaagaagggagaagagaaggcattgtttacagaataacagcctaaaggaagacccaaaagtgagaaacggcatctctatgttattagattgtaaaaacaaaagagtttcaagaagtaaaattggagaaaaatcaaggtcaagggttagaattgcttattcttttcatttgattactgaatgagtttgaaagaaggaaaggaaggagtccaggatgactctggtttttggcttgagctgtttggcaagtgtgtcacggatttaggctaaacaagaaagagatggtaagtgttgaacaggtttgagtttgaagtttctgtgggatagtaaagtcacagcgtctggcaggcattgatgactgtgaatctcaagtttgatagatggacaggtcttaaggttaatgatactcaccagtttatagctgatagctaaattttgagactagcaaatcttgtctgttttaattctcgaatacagtctaggataatttgtgtaaaattacaggtgcttctcaacttacaatagagttggatcctgatacgcacatcataaatggaaaacattgtatgttgaaaatgcatttaatacacctaatctactgaatatcacagcttagcctagcctaccttaaacgtgttcaaaacacttatatttggtcaaaatcatctaacacaaagcttattttataataaaatgttgaatatctcatgtaatttattaataatactgtactgaaagtgaagaacagaatgtttgtatgggcacttgaaatttggtttctactgcatgcatatcacttttgcactatggagaggtcgaaaaatcattaagttgaaccatcgtaagttggggaccatatgtaattaaaaatacagccagtccgtattaacattgtgtactcatataagacttcattagaaaaacaacttgctaccttaactagaacatctgattgacttatcagaaatgatttaaaatattgataatgctgatgatcaatttgttttaaactaaatttattcctgttaattgaaatgattttgataaacttttgattcttttgactggttttgtgttatcctataagagatatggtgataggcctcatagtcaaaacttgttattgttttatttgtttcttagtttcaaatgattcctatatttggactgattttgatggccaaatttataggcttgttctttgtgaagcccttgaagatcttctgaaggaaatactgttaaactaaaagtatcagttttctaagtcaccatagtgtttgcagaaaaaataaaaataaaaactaaaagtatgttttcatcaaacatattcgatgtaatactatattggatgaatacctatactagtattacttataacctaatttagtattttagcatttaatattacctaagttatttacttttacattcttaagtatttataacattaatattatgtatttataacatggctctgagttgtaagagcaattttacttgtctaggaagaaaatatttttttcttatgcaagaattttgtcgaattattatagtcagaattatcatctagtgatgagagtgagaattttcccaaaccatgttcacaattagaagacttcaaggtttgtaacgggaatgccagaagaggcatcaaagtcccaaagagacagagtcacttaaaggtaatcttttttttagtttctttaaatatgtatgcattttatcagtaaagataattggttttacatcaatgtagatttctctatacattctctttatagaaaaaaattaagtattttgacacccatttagattttttttactggaattaaattcaaagtagtttttttttgtttatctttgtgttttgatgctttatcttgcagtgttgtgttactttgaatgaataccaaaaaactcaagtgtattgagaatttatgtttcaaattgaagaaaatatagaattagaaatttgagttttaagatgtttgcttttatgatcattatattgtttttcttatttgtatccaattttcaaatacttggaaaatgttctcagtacctttcctttctgattaagttcttttgtggtgcagtaattttcttgaaagagctggaaagactcaggaaattttatgcttattaagaaacatcaagcaggctgggcgcggtggctcacgcctgtaatcccagcactttgggaggctgagccaggtggatcacctgagatcaggagtttgagaccagcctggccaacatggtgaaaccctgtctctactaaaaatacaaaaattagctgggcgtgatggcacatgcctgtaatcccagctactcgggaggctgaggcaggaaaatctcttgaaccaggaagcggaggttgcagtgagccaagattgcgccactgcactcccgcctgggcaacaaagtgagactctgtctcaaaaaaaaaaaaaaaaaaagatcaagcaaatataccaacttttactttattttatgacagaattatcagaatttttaaatagataggtaactttatcatttcttcttgggattttcttttttttttttttagacagagtttcgctgttactgccacagactggagtgcagtggcaccatctcagctcactgcaaccttcacctcccaggttcaagtgattctcctgcctcagcttcccgagtagctgggattacaggcatgcgccaccacaccctgccaatttttttttttttttgtattttgtaaagatggggtttcaccatgttagtcaggctggccttgaactcctgacctcaggtgatccacctgcttcggcctcccatagtgctgggattacagacatgcatcactgcactgggcctagaaattttgtttttattattttattaatcttaaaagcattgataagaaatcagttttccagaattatttccaatcatgaaagaaaattattttctcactgatatcttcatgttttctaatttgtcttacttagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatggtaaatgttataatgatccttaaaatttttttcaatgtttttatgtgcttatatttaaatattttaatcagtttttaatgaaactagaccttaaaggtaattaaatgtggtacgtgcaaaatatttatttggtcattttcattcaaattctttaatacttgctttattttagactgattgttcataggcttctgctaatttgaatatttctcttcagattgacctgggttgctcaagtgtgaaatgttcatttcacaagtgtttattgcccgctacatgcctagtactatgtaaggcatttaagaaccatatatgaatgaacaaaatagacaaaaaatttcttcttatgaagcctacattcaaatggaaagagacagacaatatatatactaactaaattatttagtttattgtaagataaagagttacagaaaaataaaaaagttggccaagatgagaaaaatttggagtaactggggttgagggtataaataacagacaagttgccattttattgtattattttttagttttatttttttagagacagagtcttactctgttgcccagagtagggtgcagtggcgcagtcatagttcactgcagccttgaactcctaggctcgggagattctcctgctttagcctcctataggactacaggcatgtgccaccatgaccagttaatttttttggccttttgtagagatgtaatctcactatgttgcccaggttggtctccaactccaggcctcaagcaatcctctcaccttggcctctcaaagtactgggtctatagctgtgagccactgcactctgcctagctgttattttaaataaggcagttaggaagaggcctcattgagaaggtgacatcatcagagactagaagaagagagatttagtgatgtagattgttaagaccaactgcaatacaaagctaaatttattaaatttgccatgtaagggcagtttactttcagaaaacagtgtgttcatccaatgcttgaacggatcttacatacaatatatttagaggagatggttcagattggctgtaacagaagtgagaaatattctgactatatctcttcagtattctaatctttcacagatctcatcatttattctgcttttgcagtctctgatattatttaaagtgacaaagtttctcaaagttcgtgacttttaagaaaaaagtgtttaaaaggcaatgttctcagtactgtccttaatgctgatataatttgtataatttgcaggataaggttttatgtccttgatgttcattaacagaagtgttttgcaggtttacaatataatccagtggaagaatgttgatgcaaagacaacagccagtgcaaaggccccgagtcagtagtgtgcctggcctgttgaaggaatagtgttgtgactggaatgagggaaaagggaaggtagtaggaagatcagagaactagcagccagatcataatctgacataatttagtagaatctctccagcttctgtgttgagaatggcctataggggaacagaggtagactgagaccagttaggagactgttgaggtcctccaatcaaggaatgctagtggcttctaccaagatagtagcactgaggagagtgagaaagattggattctggatacataaagctgacaggattttccaatggattagaaaaaaaggaggagtcagtaggcttgagcaacaagaaggacatatttgctgttatgttattgggaaggctgcagatgaagcaatttagatggtgattatagaggtttgaaattccattttagacacagtatgtttgaactatgtacaatttcaaagctttttttttttttaaagtacctcgaaattcacattatcttttgtttttatgtatcatgtctcaagtacctttcattatattataacttttaaaaatgctagccataaaaaaaaaccaatgtgtttcccaggttttgcttaactgaaaattatgaaatatactttttattggctgtgggttttaatgtttttagtgcatatttgcttttctggctagatttcttattttttttgaaacttctataaatctggtacagttttaaggtctttgtatacctttgttttgaaagaaaagtcaccattttaatcctcattttcagagagatagataaagcagggaacttaagttgtccatgatcactcaactagaaaatctgatttcaaaggctaaactcctaactttatatttttgaataattgtttatagatatcttttaatatttattgtctttgtgtaaaatatttgcacaaggtttgaatcaagtaaatttgaaatagattgaagttaaatactttactggttttcatttaaataattttgctaatttatctaaattcttatctttacacagattctgaaatgagagctatttacatgaaatctttgcgtagtccaatgatgaacaataagtacaaaatgattcataagacacataaaaacataaacattttctcgcaggtatgaactatagaaatataatggagaatttctggatgatgatgttgaaatatgttcctgttagtgaagcctccattttgtttctaaaactgggctgtcagagctatttgagatcatttctgcccaaagtcaggaagctcgactaaatggattctcaagatccctttttggccatgtgcggtggctcacgcctgtaatcccagcactttgggaggccgatgctggtagatcaccggaggtcaggagttcaagaccagcctggccaacatggtgaaaccccatctctgctaataatacaaaaattagccaggcatggtggcacatgcctgtaatcccagctacttgggaggctgaggcaggagaattgcttgaacccgggaggcagaggttgcaatgagccaagattgcaccattgcactccagcctgggcgacaagagcaaaactccatctcaaaaagtaaaaaagattccttttttgtccttggttgatcaaaattcattttttttcataaaaatgttaaatgctgaaaattataggttatgtcacttatggataacattttcatattagttgtgtttgtttataaattgccatgttcagcttggtaatgtgtactctctgtacttccattgtgcttattatatagcatttatcatctattattattgtttactttctacctacctgttattagcccttaaatttctagacggtaaatcattcttttcctttatcctcaaactcattttcctccataaagaatgtacttagtttatgttagttgagtaagtggctgaattaataaagtaaattaaacaaatattaatgcagatttcatgtgcctagaagtatattttaaatacctgttaattgtctgaaataaatataaaacattcttgtgtttttattgtagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggtatggatcaaagaaaggaaaaatatctttagatggttaccagaagtttttctttttctttcttgtgtgtgtgttttgtattaaataactaggtcaaagaaaaattaacaaaaaaattttgcagaaaatgtcttcaaacaagaaaacaatacacaaaattatatgggcaattcacagggtgcttaggttttaattttttaaatatgttaatgttttgttaacactatgtaaggaaacttgataattttattaaaaggttgtgggaaaatagggctttctgcaaggcaaaattaactgaaattatgtgttcagagttagttccctggccagatgcggtggctcatgcctgtaatcccagcactctgggaggccgaggcaggtggatcacttgaggtcaggagttcaagactagcctggccaacatgatgaaatcccgtctctactaaaaacacaaaatcagccaggtgtggttgcgtatccctgtagtcccacctacttgggaggttgaggtaggagaatcgcttaaatccgggaggcagaggttgcagtcagccgagatcatgccattgcaccccagcctgggtgacagagcaagactccatctcaaaaaaaaaaaaaaaaagaactagaactagttcccaggttaacttttctccttctcagaaggctttgggtatgtaagtcctttttattgggtaaaggaatttgggagtaccaactggtttccttcttaaagttttcttccatttccttccagaatggctgctaagtagtccagttttactttctcctattgtgctatttctagaagaatcactgtaaaactgtttctcgtttttaagggtttatagttacagtaattttgctaaataggggttaaagaaataataataggaactatatatattgattcattatttggttaactaggagtgagactgaaaatagacttactaaaaaatactttttagaattgacaattgtatatatttaccaagtataacatgatgttttgaaatatgtatacattgtggaatggctagatcaagctaattaacatatgtgttacctcaaatacttattttttggttgagaatgagaacacttaaaatttactctttcagtgattttcaagataaaataccttgtaattaactatagtcttcttatctgaaattttgtataatttgaccaacaccctccgccccaaccttaacccccttactaaccactattctgctctctgcttctacttctctttatccccaaggtgtttcatcacactctgccttagccacatgcttgacagtgtccacacaatggtcctcatatttgtgtttcccattgcaaattgtccccatttttttttttttttggtcatagttatttcttgaaggcattgttaggaaaagattgactacattaagtctttataatagactggagaacaagaaagtacttcatttctttgagtttcaatatcctcatctatagtatagagattaaaatcccaagatgagttcttattgtgttgcttaggctggattacagtggctatccacaggtgtgatcatagctcactgctgacttgaactcctgggctcatgtgatcctcctacctcagccttcttagtagctgggactatggacatgcaacaccatgcctggcaagattattatttttgtataattccttataaatggggtctgttatttgagaatcattgtgttcctttggaagtatggtgtccttgctttttcatatatgacgtgtccttatgttgatttctacacatccagtgggacattcatctcttcaagttttatggagtaatttcccagggaaagacttatttgtatgaatgtgtcttagggtgtcaatttggtagggtgtgttggccttggttctaggtggatacagtagtgtagtttcttcagctgtaattcacactagtgacatttgcgagtgtctcagtatcctaggcttttctcgacaaggcagagtccctcctgaccctgggctaagcctatctaagcagtggagatgaggctacagagcctgggtgcctccacactgcccttctgggcttctaatcaccatagttgcctattcacccccacaccacactccagtgctctttactttgaaaagagaaataagcactggtaagcactaacactttaagcaatatttgtactttggtatgtcctaactaaaaaatagatataggatagtgatactttgaagaggactatgaaaagggatcagtagggcttagtggaaaaagttttaagttttctactgttattgaataaaattacatatagtgtgattcttattacttgaaattaggaggagaaagaattttttgaggtaaatttgaaaagacataaaatagactaccctgacaaaaatcttcacagattaaaaatactaatatttgcattgtcatgtatattacaaacagtattccttgtcttttgcttttttgttttgtgtttagtgtttcttgctatatgaaatataacttctttatgcagcctagactttttttctttgtatttcctgaccttgttgtcatgtttagaaagccatactctaagaaaactaagtacttccactattttcttctagttctttagggccatttcctccttcattacatttattattcatttttaaaaattaaatattaaatatattttagtgataatttctgaataattgggatgttgatcttagtctaggatgttaaaagatagaaagtccatcttaagttatgatgtagaaaggtggagggagtattgctcccatccttactataacaaagagccagtcatctgcaaaatcatgttttcttgaaacaattacagagctaaggttgtagggcaaacagttaggctgatatttaaggaaaaacaggcccctccaatgaaaagcttgctgattcatggcaatcactggacactgtgaaatctggtaaaaataattcagctgaccaggggcagtggcttacgcctataatcccagcactttgggaggccgaggcaggtggatcacttgaggtcaggagtttgataccagcctggccaacacagtgaaactccgtcactactaaaaatacaaaaaattagccagacgtggtggcacatgcctgtagccccagctattcaggaggctgcgccaggagaattgcttgaagctgggagagagaggttgcagtgagccaagattgcgccactgcactccagcctgtgcaacatagcgagactccatctcaaaaaaaaagaaaaaccaaacaaaagcaacaaaaaaattagcctggcatgctggtgcatacctgtagtcccagctactcagcatgctaaggtggaaggatcacctgaccctgggaggttgaggttgcggtgagctatgatcatgccactgcacttcagcctgggcaacaaaatgagactctgtctaaaaaaaaaaaattaaaaaaaaatttcagctaaaacgttagtgaattgcaaaaggcagtggactagcatgaaagtttagaacccctgggagttgtagacacagtggggaatttatagccactcatgggcttttcttcacacactcatcaggcgttcacaaaaaagactgagaatgagaaaaatgctttttcctagtacagtccttggggaagagacaagcaattactgtggaaaaggaaccatgcctcaccttgttccttccctgtttcccctatggaacaaaaagctttaagctactgtgggaagagcagcaaactctattgccttcagagcttaggtgaagaccacagatcaggaaggaaacaagaaaataccctctataactgggagaagggcaggaaaacatcttaagcctagacaattagaggtctgtaataactgggagggagagtaagatcactgagaaattcctaccttcgagacctggggacacaagtcctgcccaagactatggctgaaccaggacaacagaaaacactaattccatactcctagtgctccctcccaccaggctagcaaacaccaggtaactagagcaatctgctgacacaagtgtgggaagagaacatcttgccaaatccagtcatgaagatttttctttatgtttccttgtaagagttttatagttttaattcttcagggtatacctttgattcattttgagctaactttcgttaatgatataaaagtccagcttttgttgttggtggtgcatggctatcttgcttaaaatcagttgaccatatatgtgagggtttatttctaggctctcagttctttggcatatgtctttttctatgccagtaccacactgtcttgattcctgtagctttatagaaattttgaagttggtaagtctgagttttctaactttgtttttttttttaacattgttttagatattcagagtcccttgaaatatatgaaatttagtatgagttttcccatttctgcaatatatgcttttggaattttgaaacagattgtgttgaatccatagattattttgggtagtattgtcatcttaataatgttaaatttctcaatgcatgaaaatgggatgtctttttatttattttgttcatggtccaaaattaaaatctgcaaaagaatttatattcaacaaattccaggccaggcatggtagctcatgcctgtaatcccagcactttgggaggccgaggtgggtggatcacctgaggctaggagctcaagaccagcctggccaacatggtgaaaccccatctctactaaaaatataaaaatcagccaggtgtcgtggcaggtgcctgtagtcccagctactcaggaggctgaggcaggagaatggcttgaacccggtaggcagaggttgcagtgagctgagactgcaccattgcactccagcctgggtgacaagagtgaaactccgtctcaaaaaaaaaaaaacaaaaaaaaaccaaacaaattccagttttatttttgtgtccttcactgcttccttccttgtacaaaggtaataattaaaaatacctacatacttcgctttgtttatacattgcttgaaatatataattagatacttttatatttttaatcttccttagataagtagtaaaatacaatacatactttatcccatcttgatttttttacttaaaactgtatcctcaggttcacttaatagtaatatacagatatatattcctcattactttgtgcagctgcatacaccattgtatgattatgtaataatttgttcaacatttccatattgatgcgtatgtaggttgtttctaatctttcattcttataataaatagccatgtttgtatcctcttaaatgttgccggtgtaactttgggattaatttcttggagttgctgtaaaaagtaaatgcatatgtaatgttgccagatattgctaacttctctataggttgtgcctttttttttttttttttgaggcagagcctcgctccgtagcccaggctggagtgcagtggcgtgatctcggctcactgcaactccgcctcccacacccagataattgttgtatttttagtagagacagggtttcaccacgttggccaggctggtctcgaactcctgacctcaagtgatccactcgcctcagccacccaaagtgctgggattacaggtgtgagccaccgctgtatcatatttttattactaccagcactgtaaaagaatttctgatttctccagaacctcattaacagagaatattgtaaacctagtgagagatggcttgtcatagtttcaaatttgtgtttttctttccatagcaaagttgaaagcatcttttttctttcagtttcatacattcatatagctcataagagccatttgcatttctttttggagaggacattttattacttgcttaaggtttttgtggatcacacaggtattgtgtattctggctacaagcctacatgagggctggagggccagtatgtagataccaattcgagatcttacctctctaccagatattaagattgagaactactttttcctttctgtttttatggagtagatttattttttatttgcgcttataataaacgtttaactgtttttggggacagaggttcggacatctagcactaatgtttcccatgccctctgcctctgcaaaaagaggagctcatggtccacaggatttggcagattactttggaaaggaaagctgggtatgttctgacttaagtaacttccaaaattctcacttccatgttgtttttgacctcggtgcattccttactttctggtcagaccagttatgtatttctaaatatttttttacaaacatgttagttttttaaaactgaacaggtttagttgttttcaactggagatactttctggttatctgatcttcctattatttttcaaaaatatcttgtctggtttccttattcttcatgatgaactctaatctgctcaaaggttatttcaccttccattcgtttgttttttttctctaggctaaaaattataattttcttttttaacacatttcctttcctgttcatttttagactttctgctatttctttacatccttttgttcttagcttttgttgttaattatagctttagaattttttgaggtgtaagagtagtgacttatgtgttccttcatttattgtcactttggtcaaattgaaggacgaaaactggacattctcattaaggataatcaacttcgggtgtgagacgtttatggcatttttatgcatttaacctgaatgtgaccagtgttttccactttttcaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggtttgtatttttaaatatctttgtttataagactgtaaaggaactttacggttaacttagtttattcttctattattaggatgtgggaaactcttaaaatataaacacctgactggtgaatgtcatttcatattttcatacagccataatggctttcattagtcattgtatttaaatgcagcttatgagaaatgaagggttggaaactgaaggcaagtctgccaaacataagactttttcaggaacccaggaaggatgagggccttaactaaggcagcaatggggaggagaagtagtattcgggagatgtttaaggagtcaggattagcaagagttggtgggaggagttgagaattactgagttgaccaacttcttggttattgggcagttaagtagtggtactgtttattgcaattatgaatataagggaagcaacagatataagggacaagggaagttcaattttgaacacgttaagatcgagttctcaatgggtcactgaagtgggtacctaggatgcatttggaagtgcaggattggagcttcaggtagaagatttctgcagtaattatttaattgtatggcgagccctcaagaacagtaaaaagatcatgagatatggaatcagaagacacaccaattactggcttctctgtgtgatattgcattgacaaatcactccctctgaggaactgataatacacttgttctactcatcttgtgatattatgagaactaagtaaaagcatgtaggtgaaagccactgcggaagaattgaagaattatacttttggtaatagtgtagtttatgtaaaacattggtgtgggagttgggcagccttttcatccccattttgtcattggtgaaccgtgtggccttagataagtcattttatcttttggttacccaattttttttttgttttttttttttgagacagagtctcgctctgttgcccaggctggagtgcagtggcatgatctcggctcactgcaacctccacctcccgggttcaagcaattctcctgcctcagcttcctgagtagctgggattacaggcatgtgccaccatgcccagctaatttttgtatttttagtagagatggtgtttcaccatgttggtcaggctggtcttgaactcttgacctcaggtgatctgcctgcctcagccttccaaagtgctgggattacaggcatgagccaccatgcccagccttcttttttttttttttgaaatggagtcttgctctgtcgcccaggctggagtgcagtggcgcaatctcggctcactgcaacctccgcctcctgtgttcaagtgattctcctgcctcagtcttctgagtagctgagactacaggtgcgtgccaccatgctcagctaattttttttttatattttttgtagagacgaggtttcaccatgttggccaggatggtctcgatttcttgacctcgttatcttcctgcctcagcctcccaaagtgctgggattacatgtttgagccaccagccttctttttaatttgaaaagtcagggataaaggaaatagatttggaatagacaggaaggtaacatggcaaaggttatagaaaagtatcgggggccataatagggaataccaataaaaggatttaagtagaatatggaatagaaaatgaacaagaaagggtagggaagtaattggcaagatgatgttaaaatgggtgtacagggtatttgttgagttattctttggaataaatacctaagataattttatattaaaccagtacttaatgcacccttcatcagagctagcatgaaaaactagagatgagtaatacagtcttggccttcaggagtgaattatctaggaatataagctcttccttattcacctttctacgttgattccagctcaaggcgctcatagttacccctattttctttctcagatatttgagaaacattagttgtagggtttctcattagcagaatgtggcaccagtttgctcaatggtgtagatcttgggattttaataaaataaagtatattaataattctacttaatattagttactgaagtttgcctttccctaaatatgaatatttaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacaggtatgtctgttgtaatatttttaaatgattacttttaaaagattcgtaaaagcattccatagaagtttaatgttaaaaaaatttaagcggcatcatgcctgttagattattttattcagtaaacattttttgcctgccaacatatattagttactgtatgaagctaagggacattattcgaaaaaaagaaaaaagaaaaaataggtgtagggatttcctttgagaagcttagagctctgtggagagacaataaatagcagtttcctttgaccttgcaatctaacatttctgggctgttcagttctgtaacaagaaaaatgagtattttactagttgtgatcattatattgcttgaagagggagattttagaatgtagttcattttaattaaaggcctacatcagatactgtcttagctcatgctgcaatgataaaatacacaaacaacacaaatttatttctgccagttctggatactggaagtctgagatcatggctgggttctggagagagctttctactgagtcacagactactgccttctcattgtatcctcacatggcagaaatagagctagctagctctttgacctcttcttaaaagtgcacaaggatatccacctttatcaactaattctcaaagttgccacttccaaataccatcacattgggattacggcttcaacatatgaattttgggcaacacaaaaacattcagttcattgaagatgttgaaattgttattctagataattttaaggaaaggaaacaagtagctcttttatccaaactaatgttcaagacatatcagctgggcggataatgcttgagatgatttccttaaaggctactgtgtttggtgttctttaggtaatattaaattttataaaagccaaaagtcctagtgtaatgattttgtctcatttatttttcagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttataaatta

SEQ ID NO: 124 - DNA, 38196 bp, Homo Sapiens
gaatgtataaaaataaatatttattgccatttgaagctttatgtacacctttaaaagcacatgtacaaatgtgggaaattacaaaaatcaacctaaaaccctttttctcaaagtatacataaatgtacatccaagatcagtggtgctaccatcattagaataaaaaataagtctgtctggacataaacaagcaatcattttaagtgtcattcagatattctcctttatatttaaaactccaaaaaatactaagaggcccaatatatccagaaaattgtgttttcactttaccctaacttatgaatagtggtatacaaatatatttccatctttttgtccagccagcaaatgagagtctgtacccgaccatttcacaaaagaccaatgttggtcagagacaggtgggaggagggcagtacactgaccgagaagtaagtcccaaatggcaattgttccagaagtcaagattgctgctgcacagtgatctttcacgtcaccttccaggaacctgatagcatacaaagaagatataattcagattacatatccaaaaaacaattaaaaaaaaaaaaaaggtcaaaaccatgttcccaaaaccagcaacaggaacaaaaatccctgtaactatgaatgcctacatttgtagccttagaggtctgttggctattgtgttgcagttttggacagaatcacatgtccagttcctgccaatctctctgatgcatcttgtagcaattgaaggctggcgcacagtggccttccttccactctccatcactctggccaaactcagtcccaactcagtgtcactgctcttgccattctttctccctgacaggctctcaccccagctcttagcatggctgagttcttgtcatcattcaggcctgttatgtccatagaaaggtcacccctaatcctctatctcaggcagtgtgcacacacatacgggatctgttccatctttatgacatatatgtttttatcttcattgcacttttcactatttgagattaccctgtttccatattcagtgggaatttcccccacaaaagatgccatctatgaagcagaaacctacctggttgcctttttcatttagacaagggctctgcagtcagctacctgggtttaaattctaactctacaaagtaagagctgtgcaaccctgggcaaattatttaactttatcagtacaatagggatgattttaagagcacatacttgacaggactgtggtgaggttaaatgaaacagttcctataaaaggcttagcgcagtgcctggcacacaggaggtgctcaataaaaattagctattattagccgggtgtggtggctcacgcctgtaatcccagcactttgggaggccaaggcgggtggatcacctgaggttgggagtttgagaccagcctggccaacatggagaaacccggtctctactaaaaatacaaaattagccaggcgtggtggcacatgcctgtaatcccagctactcgggaggctgaagcacaagaattgcttgaacatgggaggtggaggttgcagtgagccaagatcgtgccactgcactccaacctgggcgataaagtgagaccctgtctccaaaaaaaaaaattagctgttattgtggccaggcctggtggctcacgccggtaatcccagaactttgggaggccaaggcaggcagatcacctgaggtaaggagttcacgactagcctggccaacatggtgaaaccccgtctctactaaaaatacaaaaattagctgggcatggtggcacgtgcctgtaatcccagctactaggggggctgaggcaagaggatcgcttgaacctgggaggcagaggttgcagtgagctgagatcatgccactgcactccagcctgggcaacagagagaaactccgtctcaaaaaaaaaattagctattattattattcactgctgtatcactggtgcctgaggcatggccagctctccaaagagtattatatgaatgaactgcatgatactttttatccctggttcccacccaactttgcgtacctaactcctaacttatctttggaaactccctaaggttttctttgacagtctctccccaaccctctactgccaattaaggtgcccacctctccactcttgtgctctcaaacagtgcaagcttcatgtattgtattttgtgcactgaacaacagtcactagttttcccttctaatttccataaaattagaaataagtggtttgtttgtttgtttgtttttgagacagagccttgctctgtcacccaggctgaagtgcaatggcgagatctcagctcactgcaacctctgcctcccagtttcaagtgactctcctgtctcagcctccccaatagctgggattactggtgcacaccatcgcacccagctcatttttgtatttttagtggagacagggtttcaccatgttggccaggctggtcgcgaactcctgacctcaagtgatctgcccgcctcggcttcccaaagtgctgggattacaggcatgagccaccgcgcccggccagaaatagcagtgttttgctatggtctgaatgcttgtgtcctcccaagattaatctgttgaaacctaatcaccaatgtgatggtattaggaggtggggcttttgagaagtgattggtggttttgtaaaacaggccccagaaagctgccttctaccatgtgaggacacatctatgagccaggaaatgggctctcaccagacagtgaatccgccagcaccttgatcttggacttcccagccaaaagaatggtaagaaatacactttgttgtttaaaggctacccagtctgtggtattttgttgtagcagcctaatagaactaagatatgcttcctacaggattggtaccaaacaggctttcaaggattcctgaacagatgagtttgaaaagtgacaaaggaaatgcttgaccaagcagttatctttatctttaatctctagggccaacgactatcgttctctcttcaaatccaaggaagcaagttttatatgaaagcacatactgcagatgatagttctgaggttcttaggttcttaaaaaaaaaaaaaattagccaagcgtggtggcatgtacctgtagtcccagctacttgggaagctgagatgggaagatggtgtgaacccgggaggcagagttgcagtgagctgagatcgtgccactgcactccagcctgggcaacaaagcaagaccctgcagaagtgtcacagctagctaagtgcatagggatagagaatgtcttttagaacatgcacttatcaaataaactttgcataaggtccaaaaaaacatgtattgtaactgtgtgcattatccttgtgagttattaaagtcagaccttgttttcttgattcacttcagcccaggctgcagtgcagtggtacaatctcggctcactgcaacctctccctcccgggttcaagcgattatcctgcctcagcctcctgagtagctgggattacaggcacgcactaccatgcccagctaatttttgtatgttagtagagacggggtttcaccgtgttggtcaggctggtctcgaactcctgacctcatgatccgcctgcctcggcctcccaaagtgctgggattacaggcgtgagccactgcaccctgcttttttttttttttttttgagacggagtctcgctctgtctcccaggctagagtgcagtggcacgatctcggctcactgcaacctctgcctcccaggttcaagtgaccccagcctcccgagtagctgggattataggtgcctgccaccgtgcccagctaatttttgtatttttagtagagatggggtttcaccatcttggccaggctggtgaactcctgacctcatgatgcacctgcctcagcctcccaattgctgggattataggcgtgagccactgcctggccagataaatacttatctatagataaatataaactgcctgcatgatagaggctcagtcaaactcagtcagatttcaaagtaaagatgtcttcctaaagtaccttaaattttccttaatttaggtttagggaaagaacacaaattatgttttttaaatacagaacgttcattactctttatgtgaatttttttttttttttttttgagacagggtcttgctctgttgccaggcttgagtgaagtggtatgatttcagctcactgcagcctccacctcccaggttcaagccatcctcccacctcagcctcccgagtagctggaagtacagatgcatgccagcatgtttggctaatatatatatatattttttttggtagagactgggtcttgctctgttgtccaagttggtctcaaactcctgggctcaagctctcctcccaccttgacctcccaaagtgctgggattacaggcatgatccaccatgtgctgccaaaatatttaccttaggggaaaaaacagggcttgaataaacactattaaaaacctatataaccccatactagtagagatcaggatgcagggaatctggggtttgactcaagtccactaatcttcatcctacttctgaatattcctatcatgatatatagtatttcatgttttccattcttctaagtgacacaaaaatatctagtttttgtgtttgcacagtgcctttcagaatgtcccacccatagagtagcagttatgcacacttgcctgccagcctgccctggaggaagacagtacagcatcacacccacgctgagagtcgtcttagggttaatcacaatgagctgaaacacagggcttcgcaacgactcactctctttggcacagggatgactcaggacaataaagagaagcccctaatttcggagaaaaataaatatcccaaatagactgtcaagagtatgtcaggaaaaataaagatctggcagagacaaaaaccaaacaattaaagcaatgaccgataggctctgaagtatccaggatttaaccactggcttgatttttttccctgccgtctaggaactgttgagattattactggactggacttctggcttcttgttcttcttctttttttttttagagacaaggccttcctgtgttacccaggctgttgttgaacacctggcctcaagggatcctcccacctcagcctcccaaagtgttgggattacagacgtcagccaccgcgctcagccaacttctagctttagcttctcctgcttccggttcccagtgtttgttttagccagtcttgccaggcatgaatctgattcatccatttccttccccttagatagtactacatttcatgccattcatttggggaaatattggcaaagagagaatgaggacacacatgtgcagggagtgctcaaattagaaatattcatttgtaaattggtttttgaacattcagaacatgttttcccataaaaacaatcttgtacatggtggctggtttctcagaccagcccacaatagcctatttaaaaccctgaccctactactctctatgaataagggtgaccaaaaaaagataccatcacctatggctgtttctgtgagaaaatgtgttaaagttctctcctggctttaaaattacaggctctaataataatattactgtatgtgtgtatatatatacacacacacacacacacacacatatatacagattttttttttttgagacggagtttcgctcgttgcccaggctggagtgcaatggtgcgatctcagctcactgcaacctccgcctcccaggttcaagtgattctcctgcctcagcctcccaagtagctgggattacaggtatgcgccaccatgcctggctaatttttgtatttttagtagagacagggtttcaccacgttgaccaggatggtctcgatctcctgaccttgtgatccacccacctcagcctcccaaagggccgggattataggcgtgagccacggcgtcaggtcaaatgattgaatttattaatgaaaataaaatatttttatatttagaaaacaactgaggtaactcaggaggccgaggcagtaggatagcttgagacaagcctgggaaacacagctgaagacctcatcatctaaaaaaattaaattaaaatttagctgggtgctgtggctcatgccatgtaatcccatcaacttggcaggctgagtggggaggatcgcttgagcccaagaactcaaggctatagtgagctatgatggtgccactgatctacagcctgaatgagagagtgagaccctatctctaaaagggaaaaaaactgaggatttaaaaatgttaaatgctatacagttaagaagaggctgacaaactatggcccaccaggtaaatctaacccaacacaatttttttttttgagacagagtcttgcactgtcgcccaggctggcgtgcagtggtgcgatgtctgctcactgcaagctctgcctcctgggttcacgccattctcctgcctcagcctcccgagtagctggaactacaggcgcccgccaccacgcccggctaattttttgtacttttagtagagcggggtttcactgtgttagccaggatggtctcgatctcctgacctcatgatccgcccgccttagcctcccaaagtgctgggattacaggcgtgagccaccgcgcctggccacccaacactttttttggggggatagggtctcactgtcacctaggctggagtgcagtggcataatcagctcactgcagccttgaattcctggcctcaagcaatcctccctccttggcctcccaaagcactggaattacagctgtgagccaccatgcctggccccagtgcttatttttccatggctaataaactaagaatgtttttcagattttgaaatggctgaaaaacatcagaaaaataacattttgtgacatgccaaaattaacatatgaagttcaagtttcagtctccataaagttttattagaacacagctacatctatccatttgcatacagtctatggctgatttggggccacaatggcagagttgagtatgtaaaacagagattgtaaggccagcacagctgaaagtatttgccgtctggtcatatatggaaaaagtttatcaatccctgcactaaacagttaaataaataatacaatgttatttcttttttttttttttttttgagacagagacttgctttttcgccaggctggagtgcagtggcaggatgtcgtctcactgcaacctctgcctcctggattcaagcaattctccttcctcagcctcccaactaactgggactacaggtgcgcaccaccatgcccagctaatttttgtatttttaggagagacggagtttcaccatgttggccaggatggtctcaatctcctgacctcgtgatctgcccgcctcggcctcacaaagtgctgggattacaggtgtgagccaccacgcctggcattaaatattatttctgaagattggctttatgggggacttttacttactatcttacacatgtctgtgtgaaatgttttaatatcaagtgggtattgatgttgtaatataaaaggtataacattatttaaatgcttaataagtaaattctaggccaggcatggtggcttacgcctgtaatcccagcattttgggagcgtgaggcgggtggatcacaaagtcaggagctcaagaccagcctggccaacttggtgaaaccccgtctctactaaagatacaaaaaaattagccaggcatggcggcaggcacacctgtaatcccagctacttgggaggctgaggcacagaattgcttgaacctggcaggcggaggttgcagtgagccgacatcacaccactgtactccagcctgggtgacagagcaagaatcttgtctcaaaaaaaaagtaaattctagagatgaattcaactgtcagtctatctatctatctatctatctatctatctatctatctatctatcaatctatctattcgttgttgttgttgttcttttgttttgagacagagtcttcctctgtcgcccaggctagagtgcaatggcacgatcttggctcactgcaacctccacctccaggttgaagtgattctcctgcctcggcctcctgagtagctgggattataagcacctgccaccatgcccagctaatttttgtattttttagtagagacagggtttcatcatgttggtcaggctgggtcttgaactcctgacctcaggtgatccacctgcctcagcctcccaaagtgctgggattacaggcgtgagccaccatgcccagcctagttattattattattattatttttttttgagatggagttttgctcttgtcactcaggctggagtgcagtggcacactctcggctcactacaacctctgccccctgggttcaagcaattctcctgccttagcttccctagtagttgggactacaggcgcacacaccacacccatgtaaattttgtatttttagtagagacagggtttcaccatgttggccaggctggtcttgaattcccgacctcaggtgatccacccgccttggcctctcaaagtgttgagattacaggcgtgagccactgcacctggactattagttatttttgggacagggtctcactctatcgcccaggctggagtacagtggtgccatcatggctcactgcagcctggaacacctgggctccagtgatcctctcactggagaagctggtattacaggcatgtgccactacacctggccacaactgtcttatttaaaggaggacaaaggttaggctcaagattatgtgttggattatataacatcacacaacttttaaattcaattccacagatcctactaggctagggaaagatgcggtctttgtgttcagagcctctggatgctgatcctctcactgtaatcaccaggcaagtcagtctctacacaaatgctgagcctgctgccattgtctctgctcatggcttcaacagtgaatactcaagtagttattcattactcctagacaactactttcccactgtaactagattgtgagtcaaggctttttatttatttatttatttattttgagacagagtcttgctctgtcacccagggtgcagtggcacgatctcggctcactgcaacctccacctcctgggttcaagcaattcttcctgcctcagcctcctgagtagctgggattacaggtgcctgacatgacatctggctaatttttgtagttttagtagagacggggttttaccatgttggccaggctggtctcgaactactgacctcacatgatacacccacatcggcctcccaaagtgctgggattataggtgtgagccaccatgccaggccaagactttttttttttttttttttttgagacaggttcccactctgttgcccaggctggagtacagcagtgtgatcatggcttaccacagcctcgacctcctgggctccagggatcccctgaactcagcctcctgagtagctgggactacagctgcatgccaccatgcctggctaatttttgtctttttttatagtgatggggttttgccacattgcccaaggtaaaactttttttttttctttttgttttttgagacggagtctcgctctgtcgcccaggctggagtgcaatcgtgcaatctcggctcactgcaacctccgcctcctgggttcaagcaattctctttcctcagtctcccaagtagctgggattacaggcatgcgccaccacgcccacctaatttttgtatttttagtagaggtgggctttcaccatattggtcaggctggtctcaaactccttacctcaggtgttccacccactttggcctcccaaagcgtttttttttttttattaatacaaaatattttatatatttatggggtacatgtatttgttatgtgcacaaagtatataatgatcaaggcggggtatttggggtacccatcacctcgagaatctatcatttctatgtattgggaacatttcaagtcctttcttctagctactttgaaatatatagcacattgttgctaactacagtcattctactctgctactgaatattggagcttatttctaactgtatgtttgtacccactagccaagactattagtgcaagagctgagtaactgtatttatttctgtgtgagaagactgaagcctaagagtaaagcatgttagctgggcactgtggctcacatctgtaataccagcactttgggaggctgaggcgggtggatcacctgaggtcaggagttcgagacaagcctggccaacatggcaaaaccccatctctactaaaaatacaaaaattagccgggtgtggtggcgggcacctgtaatcccagctacttggaagactgaggcaggacaattaattgaacctagaaggcagaggttgcagtgagctgagatcgcgccattgcactccagcctgggcaacaagagcaaaactccatcccaaaaaaaaaaaaaagtatttctgggattattggatcatttaatcatccttcctaaggctacttaaacatggcaatgtggctgggagtcaagtctgataacaggcataatagttctcagttcaaatccacagctagaaataaatatttgccctcaggtcctacagccagaaaatttaccaagcaatcactgtaccaacacttattttcatcctaaatttcaagaaaggacaaacattgctatccaattttgaaaaaagatgccacggggaaggtttgttcattactgcttatgacttactgctctcacttaatgagaccaacagtaacacacaaagtggtcccagccagtcattacttaccatttcagaataggctttgtgacagactgaagcttggtaagaatcatcaatgtgcatctttttcaggagttgaccagtttttaaattccttagataacaaaaataaataagctgatcacattcttccaacaaaccagttttcagaaaatattttcttattcatcatagcatgtcttaggaggtgaccagggaaaaaactaagagctccttagttttctttagtcatagatttaggtaaaagtagaactgtgggttaattttgccaatagtttcatttgatagttcagccttagattaaatctacaatgcccctagggataaatctctccaaattccatgaggaaggttccatcatctcattcaacctggtattgaaatcaggcacatggtatagcagtatcatgattttgtgacacttcttgttatgtctaaattttccatggaagacaacggccaggaaaccaaattttgtagggcaagagactacacctaaaagagagttacaattatatctctattacatgtatttatactacaactagaccaaaataatggatagaaggaaggattgaagtggggtaggaagagaggggtgaatataaagaagaaaaaagataaagtttgttggaatcacttcccagctttttttttttttttttttttttgagacggagtctcgctctgtggcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtcttgatctcctgacctcgtgatccgcccgcctcggcctcccaaagtgctgggattacaggcgtgagccaccgcgcctggccttttttttttttttttttgagatggagtctcgctctgtcacccaggctgagtgcagtggtgccatcttggctcactgcaatctgcacctcccaggttccagcaattcttccacctcagccttccaagtagctgggattacaggcacccaccaccatgcctggctaatttctgtatttttagtagaggcagggtttcaccaggttggccaggctggtcttgaactcctgaccgtaggtgatccacctgcctcggcctcccaaagtgctgggattacaggcacgagccactgcacctgacctgctccccagctttattgaggatttgtgacattgataactgctttgtcatgatactctatttttttgtttttggagcttagggtctcgctccattgcccaagctggagtgtggtggcgtgatcatgactcaccgtagccttgacctctgaggctcaagcgatcctcccacctcactgccccaagtagttgggactacagctgcatgccaccatgcctgaataattttttaattttttgtagagacagggtttcactatattgcccaggctggtcttgaactcctgggctcaagcaatcctcccacctcagcctcccaaagtgctgggattacaggtgtgagagactgcacctggttcatgttactctgttgatgaaaaactttcagttggctcccattagccacaacataaagtccaagttctttttttttttgagatggagttttgttcttgttgcctaggctggagtgcaatggcacagcctcggctcactgcaacctctgcctcccaggttcaagcaattctcctgcctcagcctcctgagtagcagggattacaggcaggcgccaccacacccagctaatttttgtatttttagtagacacggggtacaccatgtcggccaggctggtctcaaactcctgacctcaggtgatctacccgccttggcctcccaaagtgctggaattacaggcgtgagccaccgcgcccggtggtatttataactctcatgaatccagcagtgcaatatttacattatcactcattgctccatttcctgaaatctttctgcctgaagaacatatgcatttccttgactctagactttgctcaagctatgctttccaatgacccctgctcccccaactccctgccacccattacagaagagttcccatccctgttactgacgaattcccatccatttcttagggcctagttatatcccaccccctccaagctgcatgaactcacttgagactacagcagtccacagtcatctcctctcctttaattttgtccatatacctcatttggtatgcaatatactactggcaatactgtatcatgtattcactcaacaaatacagaattctatgggccagatactgtgtataaaaaactgaagaaggaaaattaaatttttatgtgcatatgcaaagttttcctcctatcagggacaccagatgggtgtcctacagagtttcatacatggtctgtatttagtaattgttctttcctcaaatcccaaatcactttgaccttatgtgaattgtaaaaaggattgtactgaaattgtaggctttgatggtaaaggcatcttatttacctactagattataggggccctgggaccaggattcatatctgattcatctctgcatctctcacagagaatgggacataagtagagacccagatacctactgaatgtttggaagatattaaatgaaatgtctcagtgaatatggacagcaagacttccttacacactggcccctcagtgtttaagaatgttttaacgtgtttctttgatatgacttcattgtaaacattaagcttaagaaatttttttttttttttgagacggagtctcattgtcgcccaggctggagtgcagtggcgtgatctccgctcactgcaagctccacctcccgggttcatgccattctcctgcctcagcctcccgagtagctgggactacaggcacccaccaccacgcctggcgaattttttgtatttttagtagagacggggttttaccgtgttagccaggatggactccatctcctgacctcatcgtgatctgcccacctcggcctcccaaagtgctgggattacaggcgtgagccaccgtgcccggccaagcttaagaaatatttagaccttcagcatagtttccaaaaaaagccacttgacacttgagtataacatgaatcacttgagacatctaacaaatcaggagttaaataagaacaaatactacatgtaagtataaaattatacagagcccaaaagataagtaacagcttttgacagacaatatgattaatacacctttgagtaactaccctaaacatggagctaaggcaggcaccaagaatagatatgagacatggtacctgtcttcaaaaacgagagaggataaataacacaaagcagcaaatactaaattaaaaatcaaggcaggccaggtgcggcagcttatgtctacaatcccagcactttgggaggctgaggcgggaggatcacttgcattgaggagttcacgaccagtctaggcaacatgggaagaccctgtctctacaaaaaaaaattaaaaaaaaaaaaatttttttttttttaattagtcaaggctggtggcatgcatctgtagtcctgctactcaggaggctgaggtgggaggactgcttgagcctgagaggttgagacttcagtgagccatagtcatgccactgtactccagcatgggcaacagactgagaccctctctcaaaaaagcaaaaacaaaaaaacaaccaaggcagtatgaattcggagaaggaaacatcaatgaaggctggaatagtacaacagaactcaaggtaactgtgggggtgaaaatatcccctaaggggaacttagaagccaagtatagaaatccctccccaacttcccagcactctagaaggccgaggtgggagggttgcttaagtccaaaagttcaagaccagcctggaaaaaatagcaagaccctgcctctacaaagaaaaagaaaaagaaaaattagccaggcatggtggtgtacatctgtggtctcggcactttgggaggctgaagtgggaggattgcttgtgccaaggagttcaagaccagcctgagtaacataccaagttctcatctctacaaaaaatttaaaaattagcagggcatgatgctgtgtgcctgcagtcccagctactcaggaggctgaggtgggaggattccttgagcccagaagtttgaggttgcagtgagctacctcaaaatgcagtgagtcatgcccatgcactccagcctgggtactgagtgagactctgtttcagaaagaaatcccttcccaatctcaaattcctttgtgacctcttatatacgaaatgccaaaggactacttatagaaaaagggtacaactgagagatgggaaggaaaaagggaggaaaggaggacggcagagctggagaggacatttttgtactagagcaccggggaaataaaagctgaaggaaagcaaacatgggcccctgtaaaggttttcttttgagggatgagggtagagttgaagaaagagtatttacaatgtagtcgaataaaaaatgacctgcgtttgagcccaggcattcgaggttgcagtgagctatggtcatgccagtgcactctagtttgggtgacagagtaagacatagtctaaaaaaatttaaaaaaaaaatatcaagtttgaatattgattaatggcaaggagatgaactactagattattttaacagttcaggagacagataatgaaggtgtggactatggaaatagcacaaagaatagaaaagacaacttctggaagagcaccatcctcaaataacacccctcggcagaaaccctggtgaaagtgctccaagtggccaagcgctaccctagacaacaggacatctgaaagcagggtcttctggcagatcagaacatagtcaaatttcagaggctttctggtgggaagggcacaacgtttctctcaagggccatacttttctagtttattcctagaaggttagggttgtaagtcaccatagtgtttaaaaaaaagaaaacaaaaaaaggttagggttggatggtacataagagctagggtagtggtcacactaatataacttcctcttaccaagacccactctggccctaaggaaacagttaatagacaaggcttctgagaaaagaaaaaacatcaatctattttcctaatacaaattaaacttgcaagtaagtgcctgtggctgggtatggttctccctatagtcagaaaagagatggctggggactcctgtgatggtttccctatcacaaatctgttaatttggttcctgtgatcacacttttttcttttctttttttgagacagagtctcactctgtcactcaggctagagtgcagtggcgcgatctcggctcactgcaacctctgcctcctaggttccagcgattctcctgccttagcctcgcaccaccaggcctggctaatttttgtgtctttagtagagacgaggtatctttagtagagatggggtatctttagtagagacgccacacttattttttgtatactgagtaactttggactgtatcctagttacagtgatattaatatgttgcaaaaactttgtattctgttaggttcctctgacaaacactgatgttttttctttttaaaaatattttttaaaaaggaattttaacatttactgaatacctcctatgtgccagacaatatggtaagtacttttaaaatacaattctattgacttttaaaaaattattatttttttttgagacagaatcttgctctgtcgcccaggctggagtgcagtggcgcaatcttgactcactgcaacctccgcctcctgggttcaagcgattctcctacctcagcctcctgagtagctggaattacaggtgtgcaccaccacgcctggctaatttttgtatttttagtagagctggggttttgccttgttggccaggctggtctcgaacacttggcctcaagtgatctgcctgccttggcctcccaaagtgctgggattataggcatgagccacccgtgcccggccctgatttttttggttgtaagtttgtctgtcctagtaaacagttaacttggctgaacttgaactccaaatgccgaaactgaaattcgttctttcagtcttacctgagctgctttcagtcttaccagactccaagcagtctgacctatgaatatgcagtttaaagggtcaatcaaatatttaggtaaacattatagctagaatttagggttcttttttttattttttgctctctcctttttaggacttttcccctccctttctagcagctgcgatcaccctgaactctgtcctttggttctctaagccagtgggacagaagatcttctattaggcttccagtcacccagtgagcagagtgggccttgccccctagcttaaagccataataggaatgttgcctagtgccattcccttcacctaaagggagaaacccctccagtatgtttcttctttttcttgttctctggtgcctttagaaagttgttttttgtattttttccagagtgtatacttattcgaaggtagacagttggtctgacagaaactactcaaccactaaccaaaagcagaaagaagtgtacatctttgaaaacagaattccatttagttttaaatagtctactcagactgatcttttttggttatgtctcaattaatatgatgttgttggtaagtcaagtatatagtatctgacaaaaaaaccacaatcaggccgggcgcagtggctcatgcctgtaatcccagcaatttgggaggccaaggcgggcagttcacttgaggccaggagttcaagaccaacctagccaacatggcaaaatcccttctctactaaaaaatacaaaaattagccaggcacggtggctcactcctgtaatccctgcattttgggagtctgaggcaggtggatcacttgaggccaggagttcaagaccaacctggccaacatgatgaaaccctatctctactaaaaaatacaaaaattagctgggtgtggtggcacatgcctataatcccagctactcgggaggctgaggcaggagaatcacttgaatccaggaggcagaggttgcagtgagccgagatcataccactgtactcccacctgggtgataggaggagactctgtctcaaaacacaacaaaaacaacaacaacagcaacacaaaaccacaatcatgtttacacatactctcttatttaatcttcacaacaaccctgtaaaattagaggtatatcctcatactacagatgagggaactgaggacctagagggaaagcttaccaaataacaatgttgttcataatagtagtaccaagcagagcttcttgcatcccttggacctcagcaaaagttagtatagtctcctcagggggcatcaaaaattggttttctttgcctctgtaattaaaacagtatgaaaagtcagtactttgcactaaagcagtctctaggtagcccttctccgcattgttgaactgcataatataaactaacctaatatcaggaaaaaaaaatctaacccagaaaacgtgtatactaaactttctacaatgaacatatattactttcataatatctacctagatatgctgcaagcacctcgaattcattatattcaaaattaaacttgttaactttttctataaaccttttgtttctttctgcattcctatctcaatgaattgcatcaccatctaatgtccaagtttcagggttggtcaccactcaagtgaccacctagactggggggaaggagacaaggataatacccacatttcgagcttggtcaccactcaagtgaccaaccctaccatgttgatattctctccttcctctcaatctagtcaatcaccaagtcccagtaattttatcttctcatctctcagaaatctgtctgcttcttcccatctccactaacatacccctaatttaagcaaacaattatcatctcttgcctagattactgcaacagatcatgaataaataagccaaagttccctgccctccatttttagaagatacatgaataataacaatgaaatgtaattgaaaaataaaaataaagtgtaatgagtatataatagagaagatgctgtaagttcagtttgcaacattttgaatttaaggtgtccccaatacgtctaataaataggcctgcaggtctagagctcaagaaagagctcagaggtagaaatgtatgtttgcaagtagtcagcaccaagatggtcagtgaagcaatggacacaagtgtgtggaacgaggaaagggtctaggaccttaaggtatttctatatttttaaaaatatttgtgtgtgtgtgtgtgtgtgtgtttaagattaggtctcgctctgctgcccaagatggagtgtggtggcgtgatcacagctcactgcacccttgaactcctgagctcaagtgatccttccacctcagactccctagtagctgggaccacaaggcatgctctgccacacccagctaatttttaaattttttgtaaagatggggccctgctatgtggccccaactggtcttgaactcctgggctcaaacttctgccttggcctcccaaagggctgggattatgggcatgagccactgtgcccagcagaggtatttctaacatttaagggacacacagatttcaagaagactgaagaacaaactacatttgctgagcctctcaccttctttgacttcatccctgacatgtctggcttccacctcactaacctgcttctatgtcataacctagtgttgatgcggtacatgcttatattacacccccagcacagaaaaacgagatcctagttacccaactttctctgaaacctgtgataaaatcattcttcatctaatagttaaaaatcaatcaatgcttttcttaccctccatcttctgcaaacgtcatgacttctacttgttgatcagaaagggtcccactgctactaactagcctcctctttgtcaggccaagcacagcttttatatttccagacttcagtagtacttgcttttcactttcatcatcagaggaacaaaacaatgccctaagccaaatataaggaaaaatggggtgatgtgaggagtaaccttttaatattaaaggactaggttcactttttttttttttttttttttgagacagagtcttgctctgtcgcctaggctggagtgcagtggcacaatcttggctcactgcaactctgcctcccaggttcaagcgactgtcctgcctcagcctcctgagtagctgggattataggtgcgcaccaccacacctggctaatttttctgtatttttgtagagacggggtttcaccatgttggtcaggctggtctcgaactcctgacctcgtgatccacctgcctcggcctcccaaagtgctgggattacaggtgtgagccaccatacccggccttttttttttttttttttttttttttttgagacaaagtctcactctgtcatccagaaggaatgcagtggtggcacgatcttagctcactgcaacctctgtttcccgggttcaggcaattctcctgcctcagcctcctgagtagctgggattataggcacccgcaggtgctatacaccaggctaatttttgtattttcagtagagacacagtttcaccatgttggccaggctggtctcaaactcctgacctcagttgatccaccttccttggcctcccaaagtgctgggattacaggcgtgagccactgcgcccagcctaggttcacattttaaatagaaacttcagtcagggatgtcattctattgatttttttttaaacaaatctctctctctttagatctttcagattctttcaagactcaagcctaggttattacctgcacttaaaaccagctgacagagacaaagatgaaggaaaaacaaatcactccttgggaattacatacctgatctctctgatttccaaatttcccaaagctacacacacgagattatacacatcaggcactggaactatctgtaatactggaacctaaataaaacaaagcagccaaaaattatgcttggttgtttcatttttgtttaatccagattttccaaaatttatcacattcttttgtattctcactgtacaaggataattttcatcatttgaaggctcagaaaactctttttattagctgtaaatctaaataaactatatgcataatagcataatagtgcttactgagcatttacctaatgcaaggtataattctaacaataggggaataattgggtatattttggcatgtgaatgtaaagaatatttatgcagccatttaaaagtatatctatgttcactgaacaaatatttattgggcacctctgtgtaaagcacagtgttagatgttgtatatatttggagagcaagaatgaggtatattcaagtatgaagactctacaggaacaaggaaatttttttttttgagtcggagtttcactcttgttgcccagccttgagtgcaatggcacaatctcagctcattgcaacttccacctcctgggttcaagcgattctcctgcctcagcctcctgagtagctgggattacaggcattcgccaccacacctggctaattttatttttaggagagacggggtttcaccatgttggtcaggctggtcttgaactcctgacctcaggtgatccacccacctcagcctctcaaagtgttgggattacaggcgtgagccacctcgcctggccagaaaaatgtttatatgtatggtgagaaaagacagatctaaaaattttaagcacactaagattgcaagcttgtaagatgtatatgatggtgggaaaagaccagaaggaaatacatgtagaaaagaagcaaaataatgccttggtgaagggcaaggagtacaaatatcagcaagtgtcaaagtcagaatagacataaaattctaagctcctccaacaggtctagtgtaaaaacccgtctctaggctgggtgtagagctcatgcctgtaaccccagcactttgggaagccgaggcgagtggatcacttgaggtcaggagttagagaccatcctggccaacatggtaaaaccccatctctactgaaaatacaaaaattagctgggcgtggtggtgggcgcctgtagtcccagctactcgggaggctgaggcaggagaattgcttgaacccgggaagcggagattgcagtaagccaagatcgccccactgcactccagcctgggcaacagagtatgactctctctccaaaaacaaacaaacaaacaaaaaacccatatctagataaacctgtgatgggctgggcatggtggttcacacctgtaatccccagcactctgggaggctgaggcaggcggatggcttaagcccaggagttcaagaccagcccaggcgacatggcaaaaccctgtctgcataaaaaatataggccaggtgtggtagctcacacctgtaatcccagcactttgcgaggctgaggcaggcggattgcctgaggtcaggagttcaagaacagcctgggcaacatggcaaaatcccgtctctactaaaaatacaaaaaaattagccaggcatggtggtgggcacctgtaatcccagctactcaggaggctgaggcacaagaatcccttgaacctgggcggcagaggttgacagtgagccgagatcatgccactgcactccagcctgggtgacagagcaggactccatctcaataaaaagaagaagaaaaaaatacaataaaaaattagccagacatggtggtgcatgcctgtggtcccagctacttgggagggtgaggtgagaggattactgagcctggggaggttgaaactgcagtgagccgtgatcatgccactgcactccagcctgcatgacagagtgagaccctgtctcaaacaaacaaacaaaaatttgtgataaagcgaacaaagcaggatgttaatggtagagtctagaatggtgggtatatgggtgctcactatacaacttttctggatgtttgaaacttttcataataaaatgttgggaaaaaaacctcatctctgttctgccttgcatggtcatagctcccaattttggtaagctgcccatctacattatcaggcaaatggctgcaaagatctctttcagctcgagattcccacttacctctgcgaagtgccaggtataaagtttttcccactgccaagcatccagagctttccaaagagaaactacatcttcgcaagcagttatgatacatggctctttacaaccggctctttcccaaaacatggcactcacatctacggaacaggaacctgaaggattctgacacaatggcaacagttctgttaaagtggcactcgagtgctgttttatgcaaagcataagtatgcaaagtgatgaattataattcaatgaaacagtaggtatgtaaaatttaagtcttatgcaggtgaaaagaaagagctttgtggttcttatgtacctaaaaaaatgcctatcaaacttacatcatgaaagattttattttttatttattttattaattttaatttttgggtgtttttgggactgagtctcactttatcacccaggctggagtgcagtggtgcaatctcggcttactgcaaccttcgcctcccgggttcaagcgattctcctgcctcagccttccgagtagctaggattacaggcgcccgccaccacacccagctaatttttgtatttttagtagagacaaggtttcaccatttggccaggctggtcttgaactcctgacctcaagtgatccacccacctcggcctcccaaagtgctggggttacaggcatgagccaccgtgcccggcccatgaaagattttaaaatgtatagtccagatggaataaattcagatataaccacaaaaaaaatcctgtagaacttatccatttgaaaattaaacatcctgatgaaccactcatgggctgaaaccacaggtttcaatgttattcctcggagggagtaacattgaaacaacatacattatactatctactattatgaccatgggagcactatgtatcaaaccacagagcgtggccaaagcagtatttccaagaaaatttggaaatttccaagaaaaatcataatcacggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagctgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcaagactccgtctcaaaaaaaaaaaaaaaaaagaaaaatcataatcacaaaggcatttttaagaaaacaagaaagattaaaatcaagtaagcatgcagctcaggaagtcagtacaagaacaaaataagaacaataaaaaaaagtaggaaggaatgatttacagttatcctgtttattataaaaacagaaataaatgaactagaaaaccaaacaacaacaacaaaaaaacacaacccaattaataatcaatacaaccaaaaactagtttgtttggaagacccacgtaatggccaactctcgagtctaatgtagaaaaacaataatttagaaatgggagaatggggaagagaggcttaattacatatacacagattttaataatctataagaagtaactttttacctacacatttgaaaatatgaatgaaatagttgattctttaagagactaagttattaggacactgggcatggtggctcatgcctgtgatcccagcactttgggaggccaaggcaggcggatcccctgaggtcaggagttcaagaccagcctggccaacatggcaaaaccccatttctactaaaaatacaaaaattagcaaggcgtggtggcgcacacttgtaatcccagctactatggaggttgaggcacgagaattgcttgaacctgtaggcggaggttgcagtgagtggagattggagattggagattgccccactgcactccagcctaggcaacagactctgtctcaaaaaataaaataagttattaaaattgactcaagaataaattccgaaacagagcataggtattactatgcatcctttatagaaaaggaatctggggctcagaggttacacaatttgtccaaggtgacatagccagtaactgggaaaaactttatgtggatttgaagtgttttccttcacaccagtgattctctgggagagcttctgcacccccatcttcaaccctacacctaggacatttagtaatgcaacattttcagttaccacactgcacagaaaagattaaccactagaactgctccccattttcttataaatcaccataagtgattcttccagaaacattacaccatttgagtaggagaggcatgaataactctcatttcactccgtcaaaatgcctgttagatttattttattttatttttgagacagagtctcactcgcccaggctggagtgcagtggtaagatcttggctcactgcaacgtctgtctcccagttcaagtattctcttccctcagcctccctagcagctgggattataggcgcccaccaccacgcccggctaatttttgtatttttagtagagatggggtttcatcatgttggccaggctggcctcaaacatctgacctcaagtgatcagcccgcttcagcctcccaaagtgctgagattataggggtgagccaccgtgcccagctccctaacttagatttagacatgaagttcagttacttagcctaagttgttcttgccaataggttggcatagaaactttaagaggagagctcaaaacataaacagaggtaaatattgggaaaaataaccaatccaaatctgtttttctgaatctgtttaccaatatctttaatagtattaaagaacaagaagctatatgactgaattcttttcagttcattaaagttttcatatgtaagacacgagacactggaagagaatattcttctgacctttaactctgaaaccaattgtaggttgcctgggtttatgctatcagaagcaggaagctctgctgtttcagtctgtgaaaacaaaagtcacatcattagtctacactttatgtataatgtctgcctgcattacccactcatcaaaatgtctacttcgtattgtctttatttcctcttataacagcagcaaagctccaaatgcaaactgtttcactgataacaaagagaataggacctcccatatttaaaagaaacattttaatgaaccttaatttccccagaatgaacttaatgattacaatgaaatcatatcaaagaaacacgtcaaaccattcttaaacgtggaaggcccaatgcgcaagcaagtcatgctgtttacattcactaaggcatttcattccttcagagaaaatttcacagaggaaatggattgtacctgttcgacggaatgtttatgcagctcctggcatgtgtttctacagagctgattttctttaaaagtgaatgactcaatgggtggaggtgttcctggcgggacagagtcacagtcacaggtaggttgtccttgcctgcctgacacttgcagggtggtatgtggttttgctgggctgcctgaactgtcgaattgtttagtatcactggcaagacagactgagtctttcaaatgagcaagttggggtgtgcagcaagttcgtccagcaacttctgtagatgctttttcataggagccttgagggccaaaggctggagtagtacctaagatggggaaagcaggtgaacacatgtctgtggtaggcctgtcattatcatcaggcgcaaccgtatttaaaggagtataaagtaatatggatgaagaaaggcccgtctttgtatgctggctttgcgagtttggccttttgggatgtgattttcctggtagaacaataaggtcctcttctaagtcctccatttctgtatccatgcgtttaggactcagttcctctggaaaaatacagcttccctctttaagatgtctctctccaaacatttttgactcaaagggctccactggtttttctgagcaggacttcactttttcaagcttaagaggtccaaagtcttcatcaggtaactgaaagtctgtgatactgagaaaagacagtagttgctttaaactcagcattccatccctatgaaatggagccgtgaaagcatcatcatccaaggataaataagcactattactccaagaaagggaatcctctttttgatgacgacttttcttccctaaagaagaaaaataagtcacaaaatagtaacaaaacccaacaaaacagacaatctgtttcactgatgacaaagagaataggatctcctagatttaaaagaaacattttaatgaaccttaatttccccagaatgaacttaatgtttacaatgaagtcctatcaaagaaacatgttaaaccattcttaaatgtaatacccaacaaagagtgagcttctaaactcaaatatactaaaaaatgttcattacttttcccatccatgactcagaaacttgggcgaagggttcaaacaacggtcatgagttagttgattaattagcagctatttttctgcactacccaaaacagtgtattgctagccaggtatggtagctcacagctgtaatcctagtactttcagaggtcaaggtaagagaattgcttgagcccaggagttccagaccagcctgggcaacacagtgagactgtctttaaaaacaataaataaataaataaaaattaaaaaaaataaggccaggcatggtgcctcacacttgtagtctcagcactttcagaggctgaggcaggcggatcacttgaggtcaggagttcaagaccagcctggccaacatggtgaaaccccgtctctactaaaaatacaaaaaaaaaaaaaaaaaaaaattagccgggtgtggtggctggcgcctgtagtcccagctactccggaggctgaggtgggagaatggcgtgaacccaggaggcggagcttgcagttagcggagatggcaccactgcactccagcctgggcgacagagtgagactctgtctcaaaaaaaaaaaaaaaaaaaaaaaaaactaaactaaaaaaattagctgggcatggtggtgcgtgcctgtgatctcagctactcaggaagctgaggtaggagaatcacttgaacccgggaggcagaggttgcagtgggctgaaactgcaccactgcactccagcctgggcaacagagcgagattctgtctcaaaaaataaataaataaataaaaccaaaccaaacaaaacagtgtatggccaacagtataaataaataaatacataaataaataaaaccaaacaaaacaaaacagtgtatggtcaatagtattaactaggagaagggactgaggacaagtctcaactcaaccactgatttgcagtgaaaccttaggcaaatcgatttatttcattttcccttttctcattgtctctcataagggaaatgaactaaaaatacctacattctttcctacctctaaaactgtgatttcaacaggctgccagagtatgttctacaaaatgctggctcttctcactatggaaaacttagtccccttttgaagcaaagagtaatttactgctttttgtttgcttgtttgtttcaagacgaggtctcactctgttgcccaggctggagtgcagtggcgagatcttggctcactgcaacctctgcctcccaggctcaagcaatcctcccacatcagcctcctgagtagcaatttaccgctcttattgcaaatggtatcccacatcattcaaaatgttgctatatcctcaatgatgaatgcataaacaaactgtggtatatacatacaatggaatactagtcagccataaagaggaacaaagtactgatgcatgttacaacagaaacataccttaaaaacattatgctaagtggccaggctcagtggctcacacctataatcccatcactttgagaggctgaaggcaggtggatcacttgaggtcaggagtttgaggccagcctggacaacatggtgaaaccccgtctctactaaaaatacaaaaattacccaggcatggtggcaggcgcctgtaatctcagctactcaggaggttgaggcaggagaatcacttgaacctgggaggcagaggttgcagtgaaccaagattgtgccactgcactccagcctgggcaacagagtgacactccatctcaaaaacaaacaaacccattatgctgagcagccagacacaaaaggtcacatattgtatgattccatatatatgaaatacccagaacaggtaaatccatagagatagaatgcagattggtggttgcccagggatgaagtagggggtcaggggaggaaatgggtagcagctgcttaatgggtatggggtttaggggtgatgaaaatgttttagaatgagataaggtggtggttgcacaacactgtaaatgtattgacttgttcacttaatttaaaatggttaattttgttacgtgaatgtcaccttgagaaaaaaagtttttaaatgtagctgcagtttactacaattatagcagactatttcaaactactggctgggcctggtggctcacgcctgtaatcccagcactttgggaggccgaggtgggtagatcacctgaggtcaggagatagagaccagcctggccaacatggcaaaaacccatctctactgaaaatataaaaattagctgggtgtggtggtgggcacctgtaatctcagctactcagggggctgaggtgggagaatcgcttgaacctgggaggcagaggttgcagtgagctgagatagcgccactgcaccctatccggggcgacaagggtgaaactgtctcaacaacaataaaaaaaaactactgtgtaaaaaacagtatttctagattactggattgcctactttttgatgactttgtatccttgttcgcttaaaagatgatgaaaagtcacaattattatttttggattaattagtcacagcttatagaccaagtccatgtccaatggtacagagcagcctgctacctatttttgcacataaagttgtttttttgttttaggaacttggctgtaaagtgcatataaaggtgcgttggaacacagtcacagttacaagttgactggctgctctggcacatagctgagtagttgagacagacagaacacaaagactaaaatctgtgctatctggcccattctagaaagtatgctgatccctagtttagagccacaatgaattacccagattttgtgcttagttcatcagatatgattaaattctcagtaaatgaattgaaagtttaaattacaatgtatcgttgctgcccatcctccaaaattctgtgtcccttggaggccttagagacactgcattagatattttatccaaaaaagttgcttaggccttttcattacatgatgacttctaaaagagatagtcagtggagtcttagtcttgtttttttttgagagagggttttgctctatcacccagactggagtgcagtggtgcaatcacagctcaccgcagcctcaacctcctgagctcaagtgatcctcccacctcagcctctcaagtagctgaaaccacaggcatataccaccacacctggctaatttttctatatttttttttgtagagatggggtttcatcattttacccaagctggtctcaaactcctgggctcaagcaatcctcccaccttggcctcccgaagtgctgggattacaggggtgagccaccaagcccaacatagagtcttcctctagtacacattccattttacttcaaaaacactttctatgttagctgtgaagcttctacccaaagaattgtattgaacctgaatatgtaatattacgtaaacaaccaatacattttccttttcagtgttgaattgtttcagctctattagtgaactctggcaccataccgccaggtttgaatcctggctctgtgattttaattaaattaagtaaagttattttaatctccctgtactttagtttcctcacctgtaaagtgagaatgaaaatagattctacctcacataggactgctgtgatgattcaatgagttagtatctgtacaacatttagaaagtgccaggcaagctggacacagtggctcacgtctgtaatcccagcactttgagaggctgtggtgggaggattgtttgaggccaggagttcaagatcagcctgggcaacagggcaggacctcacctctacaaaaaattttaaaacattagccaggcatggtggtacatgccagtagtcccagctagttgggaggctgaggcaggaggaacatttgagcccaggagatagaggctgcaccacggcactccagcctggacaacagtgagcccctgtctctttatttttatttatttatttatttatttatttatttatttatttaaatttttttgagccagggtctcactctgttcctcagcctcccaaagtgctgggattacagacgtaagccaccacacttggccctgtcactttttagaaaagaaagaaaaggaagtgccaggcaaatagtaattgttaactttcatcatcatcatcatcatcatcaaacacatcttgatttacctttcacttgaataaataatttttcgtgctgatatttgtgtgaggtgacttcttccttggacctgttaacaatcgacaggctagaagttggcaaaagtggttcacaatgatctgatgctggggtgcaggctgattttctttttcctgtgtatcttctaccaggtgcttgggcaactgccttcctagacaagtcattatcttcagtgggcccagcgggagagctgactttagttaatgagagaagtttctgagaggttcttgaacttggttgtcctgtgcatgtgccagacatcctaatttcactttggtcagtttcctcattggaaaggtttaaatttttacttgcatccttatttttatttttaaacccttttttcttgacatccaaatgactctgaatgacagcctccacggctactttcctctggcaattggacatgcttcgtgttgttctaacataatattctgcaggaaacagaaggccttcaggcactgtgcaagaatgtttttctgcagaaagaggagaggttgcttccaggctaagactcttaggttgacttagaatctcactttcctgaagattttcattcctgccatcaagagtgtcactgggagattttaaagatttctctgtttgattttgttcttttaagttttggttttcatttgctggtaagttattgtaggtgagttcatttagagaacatgaaatatttgcctctaaattagaacttgtgggcagttggccacttttacttatagctttatttacaaggaggttatctgtagagacagtcatttttttgccttgtgcctccaaacttacaggtgaagtaaatctaatgttttttaggtcgtgagtagtaagttcactgctacctttaggaggaatgtgttcaaggtgctgactactaccgctatctgatagagtctgtaaaggaactgtagtcgccctggtgaaattaggtcttcttaggaatgtatcaacacctttttctggttgggcagttggtggaattaatacactgtcttcattaatttctgtaactggttctggagaatctggaagttcagatttaagacttaaaaggtgagttcttatttcagttactggtgatctagcaggatttttgctactgatttcttcctgttcctttagtcttttcccagacaatctgagtgaatcagtgccaaagacacagtctctctcctgtgaaataaatgtcctcttctgctgcttctttcttctgcttggcagcttctgcttttgctcaccactagggtcactgaccctgtggggaaaatgttcttgggtgtcatctgttctttgtataggtaatcctcctgggccatctccagggttaaaggactcaggcccaacatcaagtgtgatagatgtcttttctccagtttcttcatcaagatgggttttgatgtgtaacttgtcataaacacatattttatttttaggttctgaggaggaaaaaaatgtatataacttatatttttcttataaaataaaacaaaaaatactcatttttaacctattatatataaatactactaaacatttatttaagaaagaatcagtgacatttcattcaggcagatgaatttacaggtgaaataaacctattttttaggctgtgagtagtaaggtcactgttacctttaggaggaatgtgttcaaggtgttgactacttctactatctgatggagtatgtaaaggaactgtacatactccatactgtacatatttttaaaagttctgattttttaaattctaataatctatgaaattttaagtacatataaacaaacagcattgtgctaaaaatgttttttaaacgaacagagtattctttatcacacaatctcttctcttaacttctaaatctcaactagttttctatctcatgtatttctttctttattttcccccttggctcaagtaattttaataacactcccatttcaataacccctcagttttatgattataaattacttgaatgtaaacatcagaattgatcattgtttttagaatattttcacctagaatttttctctgttcatatatacttacatttttaaaaaaaacctttcactgggcacggtggctcacacctgtaatcccagcactttgggaggctgaggcaggcagatctcaaggtcaggagatcaagaccatcctggccaacatggtgaaaccctgtctctactaaaaatacaaaaattagctgggcgtggcggtgtgcgcctgtagtcccaggtactcgggaggctgaggcaggagaattgcttgaacccaggaggtggaggctgcagtgagctgtgattgagccactgtactccagccttgatgacagagtgagactctgtctcaaaataaaaacaaaacaaaacaaaaaacctttctaatatttaaacaataaatataatttctgaaaattgagagggaaaaagagcaagagagggaaaaagaataaacagtctaactgaaaatagagactatagattttacggcatatgaattttatgttaattagaatatattgcagccgggcacagtggctcacacctgtatcccagcactttgggaggcccaggcagacagatcatttgaagccaggggttcaagaccggcctggccaacatggcgaaaccccatctctactaaaaatataacaattagtcaggtgtggtagtgcacgtgcctgtagtcccagctactcaggaggctgaggcacgagaatcacttgagcctgggagttggaggttgtagtgagccaagattgtgccactgcactccagcctgggtaacaaagagtgagactctgtctcaaaaaaataaaattaaaattaaaattaaaattaaagcgtctattgctagtcattatcttcacactgtgggaaaaagaacaatagccaaaatatacctgggaaatgaataataaagcaggcataagtgaatggtctagatttacctgagtgttttagctgcggtgagagatcctgctgagacaaacaatcttgttcttctactgttttcttaatagaatgcttaatcttttcagctctttgggcacgctagaggagacaaaaacagccccagaaatacgttttctttaaagttttatagagtcaagaactgtttttaaattgtttgtactataacaccttaatttgagaatacgattcacttacctgaaggcgggctagtgtcttgctgtattcccttttcaagaatgctaatttctcctttaactggaagaagaaaaacaccaacaatactgggcaagtggaaaggtggagtcagagggaagggatgcagtgcttggcggggtcccttggcaagaggcagggagtagcactggtccataacaatctacttttggttctcaaaaagcaccaagctctgaccatttcaggatctttgcataacctgttcctatcatctggaacatgtccttcctttgccaattcctactgattcctcaaaccttagcttagatttttatttccctgggatagacttctaggtccttctccaaatctaggttagacactctaccagtcctctgtactttccttaccacagtattctcacactatgttctctgtttctccccatcatccagatccttgaaggtagcaggaactgccatcctcagtcactcaacaaatgaatcttctatttatccgttaatggtccaggtatctctagtacctggaataataattgatacccactatgtgtcaattagtgctccagatgctattctagatgcaatttacatacagtgagggagacagataataaataagaaaacaaacagaaatgattttacaaggtaaaaaaatacacagataaacagagtgatatgagagagttactggcctactgacagggactactttagttacagtggtcagggaggcatttttgactatcatttgagcctaagactgaatgaggaaggagctagttttgggaagatcagagggaacggtaccccaggcagagggaaccacaaatataaaagctctgcagtggaataggttacctacgtttgaggaacacgcagaaggccagtgaggttggagctatcattgctcaatctccagccaggcacacagtaggcatttaacaaatatttattaaataaataaatgaattgggctgaatcaaattactgttctctgaaagcctagattccctcgtctctctggcttctttgcttcaaaggattctctcagcagcaaagccagcctcggtttttctgctttttagcaactttttagctgtactcatctttcaaccaacaaaacatcaagatttccatcctccatacatgccttttttaaaaaaaagaaaagacctactcagctgggcgcagtggctcacgcctgtaatcccaacacttggggaagctgaggtgggtggatcatttgaggtcaagagttcgagacccgcctggccaacatggtgaaatcctgcttctactaaagatacaaaaatgagccgggtgtggtggtgggtgcctgtaggaggctgaagcaggagaattgcttgaacccggaggcggaggttgcagtgggcctagatcacgccactgcactccagcctgggcaacagagcgagactctgcttgaaaaaaaaaaaaaaaaaaaaggccgggtgcagtggctcacacctgtaatcccagcactttggaaggccaaggcgggcagattacctgaggtcaggagttcaaaaccagcctggccaacatggagaaaccctgtctctactaaaaatacaaaaattagcccggcgtggtgttgggcgtctgtaatcccaactactcgggaggctgaggcaggagaatcgcttgaacctgagaggcggaggttgcagtgagccaagatcgagccactgcactccagcctgggagatagagcggagagtctgtctcaaaaacaaacaaaacaaaacctatgtgcaaaacatgctactagacaagttgccaaccgtaaggaattttctttttttttgagagacagtctcactctgtcgtccagcctggcgtgcagtggcgcgatctcggcagctccctgcaacctcagcgtcccctggttcaagcgattctcgtgcatcagcctctgaggcctgagcctctgggactacaggctggcgtcaccacacccggctaatttttgtatttttagtagagacggggtttcactacgttgcctaggctggtctcaaactctgagctcaagcgatctgcccatctcggcctcccaaagtgcggggattacaggcgtgagccagggagactggcctcccaccaatcttatcaatgtctggggattatcttgtttacttataaatgatctttctcacctccaccagaaggtaagccaggataagaataacatcagcacaagctggaaacatcctaaaagtctatcagtaaagtacagtctaaagaagcaagggcacttccaaggccaggtgcagtggcgggttcgtgtaatcccagctactcgggaggctgaggcaggagagtcgcttgatcccaggaagcggaggttgcagtgagccgagatcgcgccactgcaccccagcatgggtggcagagtgagactctgtctcaaaaaagaagaaaaacagaaaaggaagaaaaaagaaacaaaacgagggcacttccaaactacaacatactgtctagaacttaaaaaagaaagcaaggtagataaacatgtcctgacaggaaagctaaacggaacctgcagaaccattcagatcataccatttatgaacattcccttctccaaaaaatatacataggattcctttttggtggttagggatacgcccctcctccaccacccacattaacacacgaaaggacctggaagtaccagacttaaaagatttacttgaggccgtccggggggagaagtaaagattgagggtgtgggaggggggaggagcaagggtgtcgatacagctttatctacaaactgttacacattgtattaatgcgctgctactgtaatgaaatttgttctttaaacgccaccacgtgagcaccacgctatttccacattttcattttctgtgccccctcagccctaagaggagggggtggtcagatgatactgctgccctcggactgccgaggacacaaagccaggcctaaaaccctgggaaagcggggtcagagtcctgcgtccgcccttcccgcacccccggcaccttttccttctcctcacagctgaggggcttcccgggaggctcgtccatcgggcaggcgacagaacgaaaagagcagccgtcgccgaccccaggcctgccgacaccgggacccagttggccctgggccggggaggcgccccaggaaggaatggggagcccgggatcgcaccctcagtgcgcgatcagctgacccacgcgggccaagcgcgccctaaactccggccaattaaatccaccattcggcctgc

SEQ ID NO: 125 - DNA, 41805 bp, Homo Sapiens
caggccgcagagccggccccttccgctttacgtctgacgtcacgccgcacgccccagcgagggcgtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcagtaagtggtgccaggatttacaaacccaggcaatctaattccagcattcaggctcttgataggattttcatttcctaaatgctgtcatcaccattgtcttttattagccccatatttatggctcatattcttatcagatcaagcactgatatatcaaactgataagtgatgtcatcctcaccattatttcttcaccagcttgttttgtaattgccattttcttttctcaggccacactgtcagatgggtgaaattgtgtagtcgaggaagcataaatgtattctttaaaatgcttgtgccttgaataattgttctcattagtttggagtgatacatgaattttttacatcagttatttccatgaaaagtttttattataaataatacatgcatatgtgcttcttaaagttgtaccttgttttaggcagttaaaacatctattttcattctcatctgaaaaataatttgtataccttatgagagcgagataattatggcttcataagaccaaaagggatagtaaaaatatggtaatagtgagtacatttttatttctgcttcctgagacacttgtaggtactcagaaatgctttagttgaattgtttctgaggtaataggtaattctttatgtgatgactaagaaaacgaatacctttattaagctgaatttttttttttttttttttgagacggagtctcgcactgtcatccaggctggaatgcagtggtgcgatccaggctggagtgcagtggtgcaggttcaagtgattgtcctgcctcagcctcccaagtagctggaattataacgcgtgccaccatgcccggctaatttttgtatttttagtagagacggagtttcaccatgttggccaggctggtcttcaactcctgacctcaggtgatctggctgcctcagcctcccaaagtactgggattttaggcatgagccactgtgtccggccaaactgaaaaattaaatggttgatagaatgttgcatttttatgtttctccactcctagcatcactgttgtctacaaattaataaagacaatcgattatcatgttacacttttaaatctctaaaattagggttctttttttcttattttactttcagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaattattctgatgtgaaaaagtgtttcttttgcaaattgtactgcagtcataaggttaaacaggaagtttctgcgttattcattcctgagactatatttgaaagtcagatgtttgaaagtagatttatggctaggggtagtggctcatgcctataatcccagcactttgggaggccgaggcaggaggattgcttgagcccaggagtttgaggcctgcctgggcaacatagtgagacctcgtctctactaaaaatggaaaattagctgagtgtggtggcacatgcctgtggtcctagctacttgggaggctgaggcaggaggatagcttgagccggggaggtcaaaactgcagtgagccttaatcacatcactgggcagcagagtgagaccctatctcaaaaaaaaaagaggccggggatggtggctcacacctgtaatcccagcactttgggaggctgaggcgggtggatcacctgagatcaggagttcaagaccagcctagtcaacatggcgaaaccccatctctactaaaaataaaaaaattagccaggcatggtggttcacgcctatagtctcagctcctcgggaggctgaggcaggagaatcgcttgtacttgggaggtggaggttgcagtgagccgagatcatgccactgcactccagcttgggtgacagagcaagactctgtctcaaaagaaaaaaaaaaaaggtagatttatgtataataaggggctccattttgagaggcctggaaatgattaaaatattcttaattggctgggcgcagtggctgacgcttgtaatcccagcactttgggaggccaaggcaggcagatcatgaggtcaggagatcgagaccatcctggctaacacggtgaaaccccgtttctactaaaaaatacaaagaattagccgggcgtggtggcgggtgcttgtagtcctagctactcgggcagctgaggcaggagaatggcgtaaacctgggaggcggagcttgcagtgagcctggatcacgtcactgcactccagcctgggcgacagagcgagactccgtctcaaaacataaataaaataaaataaaatatccttaatcttggttttataggcatgccctccccgaatccagttgatttacatatagtcgattggttcacattatatctggagtcatgaagagttagacatttctgttgccttggggagtatatttacatttataaaactttagtgatacctaacttgtcattatctggagttcaaaaacactaccttagatcatcatcatgatttggttgtttgtcatctttctgttgacagtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagagggtaagttagtaaatgatcttctttttttctgtattaataaaagtaatttgcatttgtgcccatctgagacctcagcaacactccatttggaatgtgaagcctaattactggacagttaactagtgttaaactcttttactactgttacaaaatgagaaatgccacagcctggactggcttttttttgttccccttttatggccctcacttcttcctgtaggagctttgggacaaaacctatgtatgtatttcagtcatcatactccatcttatcaggtgtaagttaacggtgccggacaccttaatataagcaactgttgttaaatgctttccaatgtataaggacttccatattggttttccaaaaaccaaaggtagctttgaaaaccacgtctgaggccggatgcagtgctcatgcctgtaatcccagccctttgggaggccaaggcgggtggatcacgaggtcaggagttcaagaccagcctggccaacatgatgaaaccctatctgtactaaaaataccaaaattagccaggtgtgatggcacatgcctgtaatctcagctactaaggaggctgaggcaggagaatcacttgaactcaggagttggagattgcagtgagcccagattacgccactgcactccagcctaggcaacagagtgagactactctgtctcttaaaaaaaaaaaaaaaaaccaaaaaaaaaaaccacgtctgaaatgtttggattgttaagcagattgacttgggggctttgattatatagctgatttcataactgcactaattgttaaagtgtttgggaggtgttgttttggtgcttgttatgtgaaaataaagtgactgtaaaacgatttttttttttttgagacaaagtttcgcttttgctgcccaggctggagtgcagtggcacaatcttggctcactgcaacttccacctcctgggttcaagggattctcctgcctcagcctcccgagtagctggaattacaggcatgtgccaccacgcccagttaattttgtatttttagtacagacagggtttctccatgttgatcaggctggtctcaaactcctgacctcaggtgatcctcccgcctcagcctcccaaagtgctgggattacgggcgtgagccaccgcacccggccaatttttttttcttttttgagacagagtcttgctctgtggcccaggctagagtacagtggcgcgatctcggctcactgcagcctctgcctcccaggttcaagcaattctcctgccttagcctcctgagtagctggaattataggcatgtgttaccatgcccagctaattttttttttttttttttttttgagacagggtctcactctgtcgcccaggctagagtgtaatggcacaatctcggctcactgcaagctctgcctcctgggttcatgccattctcctgcctcagcctcccaagtagctgggactacaggcacccaccaccatgcccagctaattttttttgtatttttagtagagacagggtttcactatgttagccaggatggtctcgatctcctgacctcatgatctgcctgccttggcctcccaaagtgctgggattacaggcatgagccaccgcacccggccacacccagctaatttttgtattttttgtagagagggggtttcaccatataggcaagtcaggtcttgaactcctgacctcaggtgatctgcccacctcggcctcccaaagtgctgggattataggcgtgagccaccacgcccagccttaaacagttttttgaaagataatttataggccgggtgcagtgtctcattcctgtaaacccagcactttgggaggccgaggcgggcggatcacctgaagtcaggagccatggcgaaaccccgtctgtactaaaaatacaaaaaattagccgagcatggtggcaggtacctgtaatcccagctactcaggaggatgaggcaggagaatcgcttgaacccaggaggcggaggttgcagtgagccgagatcgtgccactgcactccattctgggcgacaaaagtgaaactccttctcaaaaaaaaaaaaggaaatttatattcaagttcttattctttcaattacttataaattaaatggcttatgggttgactgttttcttatttatttatttattttaagatggagttgcgctctgtcacccaggctggagtgcagtggcatgatctcagctcactgcaacctctgcctgctgggttcaagcaattctcctgcctcagcctcctgagtagctgggactacgggcatgtgccacaatgcccggctaattttttgtttttttagcagagatggagtttcaccatgctggccaggctggtctcgaactcctgaccttgtgatcttcccgcctcggcctcccaaagtgctgggattacaggcatgagctacagcgcccggcctattgttttctttttctttgttttatttattttttggatgtgcggtctttattctttccaataaaagttttaaaaaaaatgcttttcataagatttcctttaaatgagtatatttcctttaaatgagtgtagtcagctggatttttttttttcatggaggtactaagtgtcccatttcgctgatgaccagcatggttactgaaagccctttggaccctagcagaatatgccaccctgaaatatgccactttggcataaggattattttgagctgaaggcaattgaaaagaaacagataaatctgtctgcccttcctaaaaacaggacataaatgcacagaagagttccatcttccctctcttacaggaagacaaaagttaatcaccacagacaactttagaccattatcagcgtacataacaaattttactagctatcttttatctccagttagtttcaatatttgctgcctttagagacttagggtccttttcctttgtcttgttacttctctaaaaatttactgtaccttcgggacgataagctcaaatcttttttttttgagacagaatctggctctaccgcccgggctggagtgcagtggcgcaatcttggcttactgcgaccttcacctcccaggttcaagcgattctcctgactcagcctcctgagtagctgggagctgcgaatacaggcacgtgccaccatacctggctaatttttgtatttttagtagagacagagtttcatcatgttggccagactggtctcaaacttctgacctcaagtgatcctcctacgtcggcttccctaagtgctgggattatgagtgtgaacacctgtgcccagctccaaatctaaccaaacttttgagttactaatctctggactcccctgtgttgttacatgcactatgcacaattaataaactctttctcttgttaatccatcttttgtcagtccgatttacagggctccagccaagaaacctaagagggtggcaggaaaaggagtttttcttcccttataccttaaagctacctatttcacaatgtgtgtttgtaatagtgtcttaaaaccttactgtaactagagtaggtgtagcactaggatataaagtttttatttttattttaattaattaatttattttttaagatggggtctcagtccatcatccaggctggagtgcagtggcgcgatctgggctcactgcaagctctgcctcctgggttcacgccattctcctgcctcagcctcccaagtagctgggactacaggcacccgccaccacgcctggctgactttgtatttttagtagagatggggtttcaccatgttagccaggatggtctcgatctcctgacctcatgatctgcccacctcagcctcccaaagcgctgggattacaggcgtgagccaccacacctggcctaaagtttttaaatgattgatatgagattaaattgtcattgttttggtgaaaatttgactctgctaagtgtctatttgcaataggaaatgttttctattttaaaatatagcttcttgttttttcagtgttaatatttaagtacattttatttatttttaatattttactttttgtgaaacagggtctcactttgtcatccaggccggattgcagtggcatgatcacaattcactgcagccttgacctccctgggctcaggtgatcctctcacttcagccccccaagtagctggggctacaggtgggcactaccatgcccagctaattttttttgcattttttgtagagacggagtttcaccatgttgcccaggctggtcttgaactcacgggctcaagagatctgcgtgccttggcctcctaaagtgttagaattacaggcgtgagccaccacgcctggctaagtgcattttaaaatgcagtaactggccgggtgtggtgactcactgcctgtaatcccagcacttcgggaggcagaggcaggcagatcacgaggtcaggagatcgagaccatccttgctaacatggtgaaaccccgtctctactaaaaatacaaaaaattagcctggcatggtggcgggcgcctgtagtcccggctgctggggaggctgaggcaggagaatggcatgaacccaggaggcagagcttgcagtgagctgagatcacggcactgcactccagcctggaggacagagcaagactccgtctcaaaaaaatgaaaaagaaaaaatgcagtaactgattggtttctctctgaaatatgtgcaaaatcaaacttttttttttttctgagacagagtcttgctctgtcgcccaggctggagtgcagtggcgggatctcagctcactacaacctccgtctcccgggttcaagccagtctcctgcctcagcctcccgagtacctgggattacaggcatgcaccaccacaccaagctaatctttatatttttagtcgagatgtgttttaccatgttggccaggctggtcttgaactcctgacctagtgatccacccagcttcccaaagtgctgtgattacaagtgtgagccaccacgcccagcctcaaactgtttgttttaaacatccaatctaagaaagattttatataattgttgccagttaaatatcaaattatactatagcattcaagagaaaaaatgcttcatttgaacattttttctaactgtgttttatttttttgtttttttttttgagacagagttttcattctgtcacccaggttggagtacagtgccgctatcattgcttactgcagccttgacctcccaggctcaagcaatcctctcaccttaacctcctgagtagctacgaccagagttgcacaccatcacacctgactaatttctgtattttttgcagagatggggttttccatgttgcccaggctgccgttaactcttaatttgtagtcctatagaaaaaagcaagaaagagaaacttccattatgttacttctgttcaatgaagccagtgactagaaatatgaaaaggcaggcattaaaacactagttgtatatgtttataaataattttacatagcctaatatgtaaggaaacagtggaaaaatgtgaaaataatagatcaggtcgggtgtggtggttcatgcctgtaatcccaggcgtgaatttgggaagctgaggtgagcagatcacttgaggtcaggagttcaagaccggcctggccaacaaggtgaaaccccgtctctactaaaaatacaaaaattagctgggcatggtggcgagtgactgtaatcccagctactcaagaggctgaggcaggacagtcgcttgagcccaggaggcagaggttgcagtgtgccaagatcgcatcactgcactccagcctgggtgacagagtgagactttatctaaaaaaaaaaaaaaaaaatcaagtggctgggcacagtggtttatgcctgtaatcccagtgctttgggaggctggggcaggaggatcccttgagcctaggaattcgaggttgcagcgagctatgattgtgccactgtgctccagcctgggcgtcagagtgagaccttatctctaaacagattaagagagacatcaggtggggggcggcgacggatagcattaggagatatacctaatataaatgacgagttaatgggtacagcacaccaaaatggcacatgtatacatatgtaacctgcacgttgtgcacatgtaccctagaactttaattaaaagatcaggaattatgaactgtttatagtaattttgctataatttgtcatctttcagttaaagaattttgttatccaaaggagaacattttgttattaaaaagcattgtttttctacaattgccaatacatccaaacaggtaaaactaattaagagtgttttgttgtttcagaacaccgaaaagctttggaggatttcactcttgataatattctttctcatatttattattttcgctgtcgtgactacacagagttactggcacaagtttatcttcttccagatttcctttcagaacactcaaaggtatgagtcagactactgaaatgtaactaaccaagtattttttgaggtgtttgataagcatgaaaaaataaccagtacagtagcataaaatcaaagtcaaagccaattgagaaaatctcttccttccttgacctacaatttatttatatttatatttgttttgtgtatgtatatgtatatatagtttatgctcagagtaagaaattgaaataatatagaagtttcatttccagtaatagtggaatagctcctatcaaaccacattgtatagaaaggtatgaaatgaaaaataaaaacttccttgtgctactgttttctagtgcctctccccaaaggtgatcactattggccaggtgcagtggctcatacttgtaatcccagcacttagggaggccatggtgggaggatcatttgagcccagtagttcaaaaccagcctgggcaacatagtaagacattgtccccaccaaaaaaaaaattagccgtgtgtggtgtagctgtagtctcagctaccaagggctgggtggagcaggcctgaggtgggaggattgcttgagcccagcagttcaaggctacattgagctaccgtgccatcatgtatcacctttttttttttttttttttttttttttgggtagaaatggagtcaactcctggggttaagcgattctcccacctcagcctcccagagtgctgggattataggcatgagccactgtgcctggccctttaattttggtaaacattatcagtgacaaagattctccttgactgaacttggccccatcctgtctttggcctacccagtccagtcttagcaaagaatcctgctgtcagttcagagagattctctcacatttgatagtctgagcacctttgatacctgatcacgttcctcattccccacctttgatatttaaatccttggcttgcctttatttatttattttttattttttaatttgatggagtctggctctgtcgcccaggctggagtgcattggcgtgatcttggttcactgcaacctctgcttcccgggttaaggcaattctcctgcctcagcctcccaagtagctgggactacaggcatgcgccacaacgcctggctaatttttttttttttttatatttttggtagaaacagggttttgcatgttggccaggctgctcacctggctggcctgccattagtaagaatcctgttcggtcagtttagcaagaatttccctacccttgatgtctcactgttagtaattgttcatccactgaccccttcaccttgctcttggttgtgaatccccagttgtccttgtattctgatttgaacccagtctctctcccctattgtgatacccctattagaatagtcttgaatacagtctccttactgttttaagaagtgttagaataattttttcttgaacacatatcgcccttcagaaagactgcaccaatttctactcttactgacaatatatgagaatgcctattacccatcatcctgaccttttgaatatttttgccaagattctgcatggaaaatgccatctctttgttattttatttattttaattaattaattaattttttttttgagtcgcccagtctgactaacatggcaaaaccccgtctctacctaaaaatacaaaaattagcctggtgtgttggcatgcacctgtgatcccagctacttgggaggctgagacaggagaatcgcttgaacctgggaagcagaggttgcagtgtgctgagatcgtgacactgcactccagcctgggagacagagagactctgtctcaaaattaataaataaaaattaaataaataaatacaatagaaattaattttcttagagttctggagcctaaaagttcaagatcaaagttctagctgattcagtttctggcaagggctttcttcctggcttgcagacagccatcttttctctgtgtcctcatatgatagggaggaaaagaaggagagagtgaattccctggtgttttttcttttttttggggggggggtggagtttcgcttttgtcacccaggctggagtgcaatggcgtgatctcagctcactacaacctccacctcccggattcaagcgattctcctgcctcagcctccagagtagctgggactacaggcgcatgccaccacgcctggctaatttttgtatttttagtagagacagggtttccccatgttggccaagatgttctcgatctcctgatcttgtgatccgcccacctcggcctcccaaagtgctgggattacaggcgtgagccaccgtgcctgacccctaatatttcttcttacaaggacgctaatcatcttagattagggtcccatctttatgaacttatttgattacttccttagaagtcctttctccacatacattcacattggggtttagggattcaacatacgaattttaaggggacataattgagttcccagaagtttgcccctggccccttgcccccctaccccctacctgcccgccaaattcatgtttttcttgtatccattccatccacacagccccaaacgtcttaaccggttccatcatcaactctaaaagtcccaggcttcatctaaatattatctaaatcagagattggtgagactcaagttataattcatcctgaagtgaaattcccttccagctgtgaacgtttgaaatcaggcaagttatatgctttcaaaatacaatagtaggaaatgcataggatgaacattcccaaaaggattatgggtgcctagcaaggcaaatttcattggaccataaggctcaagaataatcctttgctggccaggcacggtggctcatgcctgtaatcccagcactttgggaggctgaggcaggcagatcacgaagtcaggagtttgagaccaccctggccaatatggtgaaaccctgtctctactaaaaatacaaaaattagccgggcatggtggtgcgtgcctgtagtcccagctactagggaggctgaggcagaagaatcacttcaacgcaggaggcagaggagattgcagtgacatgagatcatgccactgcactccagcctgagtgacagagtgagactccatctcaaaaaaataataataattaaaaaaagaatgatcctttgctttgatgctctgccttccaggcccactgcagtagcagaatcaccctactgctctgtggggtggccctgccccttcctctctctgcaagggccccaccctctgaaaccaaggacgacatagcattgccccctgggcttatggtaagagtgacagctctgaggatctgtgatcccctttggcaccattctttccttttcttgaggaatagggcacattcacagtcaagtagctcatggttttctcttgtggaatcaaggaagtccaacagccttcgttcattctttcccacttactctgtcctctttacttcaaactagcagtgtttctgctgttataatcccttatctatcactggcttctgctgagatggctgattaacatcatggataatctatttatagagtcattgttcaaccgtacctttggtcttctctctagagcaagctttcttatttttagcaatatggataggctgagaattttctacatctctaagttctggttccttcttgctgaacaattccttcttcaattcatctgtctcctctttcatttttactataagtggtctaggagaaaccaagccacttcctctacactttgcttagaaatctcctgagataaatagccaatttcatttctcacaagttttaccttccataaaatactagaacacagccaagttctttgccactttatactaagcaccagctttccttcagtttccagtaacttgttcctcatttctgtataaatcctcaccagaatagccgggcatggtggctcacacctgtaatcccagcactttgggaggctgaggtgggcggattgcctgaggtcaggagttcaagaccagtctggccaacatggtgaaaccccgtctctactaaaaatacaaaaaaattagctgggtgtggtggcgtgtgcctgttaatcccagctactagggagtctgaggcgggagaattgcttgaaccagggaggtggaggttgcagtgagccaagaacgcaccactgcactccagcctgggcaacagagcgagactccatctgaaaaaaaaaaaaagcctcaccagaattgcccttaatgtccatattttcagtatgtgcctcaaaactgttccagcctttgcttattacccaatttgaaaatcacttccacattttaggtatttgttatagtagtaccttgcttctctcactacctaacccaccatacctcatttcttgatactaaaatttgttgtggtcacctcaggctgccataacaaaaatactatagtctgagtggcttgaacaacagaaattttattttcttacagttctggagactagaagctcaagataaggttctggctgattggtctctggtgagagctctctccctggcatgtagatggccaccttcttgctgtgtcctcatggggaggaaggaggaagagtgagctctttggtgtcttttcttcaaggacactaatcctctcaaatcaggatgtcattctcatgacctaattttacgttaattactaccttagaggccctctctccaaatacagtcacactgggagatagggcttcaatttacgaatattggggggacacagcagtggtcatgtgtggagtcatgaaaaatcgaatcaacctgtgcacatattcccagctgacgttgaacaaggtcatgttctgcctttttatttcagctctctactgtaaacaagtgtccttttcacagtctttataatgccacttttttttgcatttttgtgctttttattagtgttcacctgttcttcatcacttcaaccagtttcattttcttataattatcggaaattaccttatttgtgtgtttgtttgcatattaatggtcccttactccactaaaacataacctccaagagagcagggaccttctctcttatttactatattcttctctcttatttactatatcatccccaatgcctggaacagtaaatagcatataggaaaggaggtgtcaattaatacttgctaaatgaagaaacaaatactctaaataaaacaacttacttaggcattgcttcataaaagcctcttgtttaatccaacccttactagatagaaaaaaacatagcattggagtcttttgtttgtttacatttgggttagtttccagattctttttgatttggggatcttaaggtttatatattggtttatttttctaacttcactgtttattttttgctttggggggggctttcttttgaaagggttttgctctgtcccccaggctggagtgcatggcagggtttcaccacgttggccaggctggtctcaaactcctgacctcgtgatccacctgcttcggcctcccaaagtgctgggattacagatgtgagccaccgcgcccagcctgaaggtttttttgttttttgttttttgttttaggaaacataaaaagaacccggaaggtaaaattggtatatttaattgacaaatgtgttgttttaccaagactttttctttaagccttttcagaatgttttacaaagactttaaatgtgctttttatcagtaaagactgtgtacagtggcaagttaaagaaaattataattattcctttttctttttgaattacttttttttttttttttttttgagacaaagtctcactctgtcgcccaggctggagtacagtggcgcaacctctgccaccagggttcaagagattctcctgcctcagcctcctgagtacctgggattacaggtgcctgccactgtgcctggctaatttttgtagttttagcagagatggggtttcaccatcttggccaggctggtcttgaactcctgacctcgtgatccacctgcctcggcctcccaaagtgctgggattacaggtgtgagccaccgcgcccagcctttgaattacttttttaaagttgagaaattatcaaagcagagtccgttttaacttttagtgattattgcagaaagcactggctgaacagctttgtaactttccaaaagaaagccatactttagacagttggaaataaagccctgggttttaaggttttttcctgtaatggactatggtttttccaatgctatgtttttttctatctagtaagggttggattaaagaagaggcttttatgaagcaatgtctaagtaagttgttttatttagagtatttgtttcttcatttagcaagtattaattgacacctcctttcctatatgctatttactgttccaggcattggggatgatatagtaaataagacagaagaatatagtaaataagagagaaggtccctgctctcttggagagagagagcatttttattattattattttatttttcgtaacaaatctaatattatctcttctgtatttaggttcgactagtgatagtggatggtattgcttttccatttcgtcatgacctagatgacctgtctcttcgtactcggttattaaatggcctagcccagcaaatgatcagccttgcaaataatcacagattagctgtaagtattaactagtgaagagagttttataacaaagtcaagactgtataaaatgttaatgtctagaaatgtcaaaatagcgtttgcctgacaaataatatagacatgcagttttgagtaaagttacgtttggttggtttccattaaaaaattctggtcataagtgtcagttttcctggaaaataacaagcataattaatggactttgtggttgagcgcggtagctcgtgcctgtaatcccagcactttgggaggccgaggcaggtggatcatgaggtcaggagtttgagaccaccctcgccaacatggtgaaaccctgtctctactaaaaaaaaaaaaaaaaaaaaaaaaccaaaaattagcccggtgtggtggcatgcccctgtaatcccacctactcgggaggctgaggtaggagaatcacttgaacccaggaggcggaggttacagtgggtggagaacgcgccatcacactccagcctgggcagcagcaagactccgtctcaaggcaaaaaaaaaaaaaaaggactttgtttgataaagaaatgccacctttgttaattgcagtgtcttctttgtttaaatatactttggatgtttttcaggttaactcttccaacatccctggttttcttctcctttgagtctttgattattatgtggtatgtaatcacagattcagatggattgaaacataaccggtgtaaacaacctagatgctttgaggtagagctaaataactcttgaagatttgaaatgtgaggagagaagtaaatatcggctcagaagggaagagatttttttttttaaagttttacctcactcctctttaactgcttgtttgccattacttcccaccctgaatccacatcccaccactgacacaaatacacacatttgtctgggagtaagatgtaaggtcaaactgcttaacttgatttctttgtctttaccttaattagagagaccttagcacatacctgtaatacatcataagtaaataaagaacttcctcagtaaagtcattttaaagcatacttttttctttgaatttccaattttttttgccatatgctgaaaagcatagtgccctgtgtttgaattactttttgcttaaattaattgtaatttagccttttgttaatatcagtgaagagcctccagtagggggcactcaagactaataggttgcatagttccttatgtttttaacagaaatagcttcaccttttccgactaaaaaagcaatccaaacaataacatcaaatagtaggtagtgtttaagaagagtgatgtaaatataaacgtcctaacatggaagaagatatatacatatatgttattgagtgaagaaatttaagttgtatataaaatatatttaatgttacctcagtttagagaaaacttataattatatgtatgcatttatatttgtatatatgaagagaaagatctgaaaggaccaaaacattaacagtggctacttcttttttatttttttggagacagaatcttactgaagtgcagtggtacaatcagggctcgccacagcctcgacatctcgggctcaagtgatcctgccacctcagcctccctagtagctgagactagaggcacatgccaccatgcccggctaatttttgtatttttttttttgtagagatggggtttcaccatgttgcccagctggtcagaaggcggaggttgggctcaagcgatcatctgccggcctcagcctcctaaagtactaggattacatgcataagccactgtgcccagacttggcttcttcaaaggatgggattttgtagggttagggacacactttccctctcttactttataatttctttgcttgaaggttttttttcccaattaacatatatataacatgtatggcttttgataatgtattttataattttaaggccagatgtggtaactcacacctgtaatcccagcacttttggaaggccaaagtgggaggaccgcctgaagccaggagtttgagaccagcctgaacaacaaagcttgaccccatctctaaaaaaaaaaatacataaaataagaataattggccgggcacggcggctcacatctgtaatgccagcactttgggagactgaggtgggcggatcatgaggtcaggagttcgagaccagcctgaccaacatggtgaaaccccatctctactaaaaatacaaaaaatagtcaggcgtggtggcatgcctgtaatcccagctactcaggaggctgaggcaggggaatcatttgaacccagaaggcggaggttgcagtgagccaagattgcgccactgcactccatcctgggcgagagagcaacactccatctcaaaaaaaaaaaaaaaaaaaaagaaattttaagttatgtatgctttttgtaaaagaaaaaaaaagttctaaacaataaaaaatgtaggaagcgattattcattactcagagattgtgtaaatattgttgtctggtgtaaatatttttgcagacttcatgcatatacaaacttacgttttagaaaatgaggtcataggccaggtgtggtggctcacgcctgtaatcccagcactttgggaggccaaggcgggcagatcacgaggtcaggagatcgagaccatcctggctaacacggtgaaaccccatctctactaaaaatacaaaaaagtagctaggcttgatggcgggcgcctgtaatttcagctactcgggaggctgaggcaggagaatggcatgaacccgggaggcggagcttgcagtgagctgagatacgccactgcactccagcctgggcgacagagcaagactccgtctcaaaaaaaaaagaaaatgaggtcatgccaccgcagtggctcacgcctgtaatcccagcactttgggaggccaaggtgggaggatcacttgagcccatgagtttgagaccagcctgggaaatatagtgagacttcatcgctacaaatttttaaaaaaatcttagccaagcatagtggcatgcacctatagttctagctacttaagcggctgaggtgggagtattgcttgaggctgggaggcaaaggttgcagtgagctgagatcgcaccactgcactccagcctaggcagcagagcaagaccctgtcttcaaaaacacaaaaagaaatgaaaatgaggtcatattatacatgctattatgcaaagcagttttctgtttttcacttaatatattgtgaacatctttccatgtatactactttttttttccatgtacactacttataagtctgctttacactaacagctgcatagtattttgctgtatgactgtagcataggttttttttgtatttgtatttgtttttgggttttcttttttatgagacagggtctcgctctgtcatccaggctagagtgcagtggcatgatcttggttcactgtagcctcaatctcctgggcttaagcaatcctttcacctcagcctcttgagtaactgagaccacaggcacacaccaccacacccagccaatttttaaattttttgtagaggctgggcacggtggctcacacctataacccaccactgtgggaggccagggcaagcagatcacttgaggtcaggagttcaagaccagccttgccaacatggtgaaaccttgtctctactaataatacaaaaattagccaggtgtgttggtgctcacctgtagtcctagctacttgggaggctgaggcaggagaatcacttgaactcgggaggtggaggttgcagtgagccaagatcacactgttgcactccagcctgggagacacagtgagactctagctccaaaataaataaataaataagttttttgtagagatgaggtctcactatgttgcctaggctgttcttgaactcctgggcttaagggatccatctgcttcagccttccataggcatgagccactgtgcccaccctgtagcgtagtttttttaaccacctccttattgatggtctctctcttttttttttttctgttttagatagagtcttcctctctcacccaggttggagtacagtgtcacactcttggctcactgcagcctccacctcccaggttccagagcttctcattccacagtctcccgaatagctgggattacaggcgtgcaccaccacacctggctaatttttgtatttttagtagagatggggtttcaccatgttggccaggctggtctcaaactcctgacctcaagtgatcgaccctcctcggcctcccaaagtgctgggattacaggtgtgagccaccacagctagtctagaataaatttcttaaagtgaaaatattaagccaaaggaatcgatttttgaacattttgttttatgttataaaattaccctcagaaactatgctccaaagtatgtctctacagcaatgaatgggaactcttgttttcccatatctttaccaactttgggtaccagtcttttatttatttatttatatctttgagacggagtctcgctctgtcgcccaggttggagtgccatggcgcgatcttggctcactgcaacctgtgcctcctgggttcaagagattctcctgcctcagcctcccgagtagctggaactacaggcgcgtgccaccatgcccggctaattttttatatttttagtagagatgggtttcactgtgttagccaggatggtctcgatctcctgacctcgtgatccacccgcctcagcctcccaaagtgctgggattatacgcgtgagccaccacgcccagctaggtaccagtcttttaaatctttgccaaattgatatggagaaagtcctttaaaaatatgttttttggattattggcataattttttaaacagccttaatgacatatatgattcatccttgcagtgtgcacaattcagtgattttcagtgtatccacagagttttgcaaacatcaccactgtataattttagaatatttccgtcatcctaaaaaagaaaccccaacctcacagtgaatttcagaatatttaaaatgtctgctccttcagtgtcacgtttcaaatctcatgcaaatttttcttgcggtcaactataactttgtaccctatggagaaagtaattctggttctgggaaacacacagttccagattattaaaaaaaaaaaaacaaaaaaaaacaaaaaacctcttttcagctgggtgcaatagctcacccctgtaattccagcactttgggaggccaaggtgggtggatcacctgaggtcaggagttcacaaccagcctggccaacatggtgaaaccccatctctactaaaaatacaaaaaaattagccagttgtggtggcaggtgcctgtaatcccagctactcaggaggctgaggcaggagaattgcttgaacccaggaggcggaggttgcagcaagccaggaccgcgccattgcactccagcctgggcaacaagagcgaaactctgtctcaaaaaaaaaaaaaaaaaaaaacccttttcattagctgtcattctctattctaccctcccccagtccctcacaaccactagtatgctttctgtttctgtgaatttgtcttttctggacattttatataagcagatcatacagtatatggccttttatgtctgacttctttcacttagcgtgatgttttcaaggtttatctgtattttagcacccatcagtatctttttaatgactaattttgcattttatggatatatcacattttgtttatctgttcattggttgaaggacattgcatggcagaaatatttttaaagctctgaagttcataatttcaagtgattgttactttactgttttaaacttttgacctggcatggtggctcacgcctgtaatcccagcactttgggaggccaagctgggtggatcacctgaggtcaggagttcgagaccagcctggccaacatggtgaaactctgtctttactaaaaatacaaaatttagccaagcgtggtgggggacacctgtaatcctagctacttgggaggctgaggcaggaaactctcttgaacccaggaggcagaggttgcagtgagccgaggtcatgccactgcactccagcctgagcaacagagcaagactctgtctcgaaaaaaaaaaaaaaaagcacttattctttagaagcttggcataatcacatactaattttcagttgtatcatggaggccaatcgttttgcaaaagtaatataattgctatataaatatttgctaataatggaaattctaattttggcatgttgaatacctggtaaatcagtagtttgatttatattttcctaaagatacgtagtgcgtaaactaagtactctctctaaaccagcactgtccagtagatctgatggaaagatgaaaatgtacagtctagtacagtagctgcatgactgttcagcacttgaaatatagctaatactactgagctactgaatttatgattttaatttaacttttttatttattttttttgagatggagtctcactctgtcgcccaggctggagtgcagtggcgcgatcttggctcactgcaacctcctcctcccgggttcacgccattctcctccctcagcctccctagtagctgggactacaggcgcatgccaccatgcccagctatttttttgtatttttagtcgagacagggtttcaccatgttagccaggatggctttgatatcctgaccttgtgatcctcccacctctgcctcccaaagtactgggattaccggcacaagccaccacgcctggcttctaatgtaacttttttttttttttttaagacggagtctcgctctgtcacccaggctggagtgcagtggcgcgatcttggctcactgcaagctctgcctcccgggttcaccattctcctgcctctgcctcctgggttcacaccattctcctgcctcagcctcctgagtagctgggactacaggcacacaccaccacgcccggctaattttttgtgtatttttagtagagacggggtttcaccgtgttacccaggatggtctcgctctgacctcgtgatccgcccgcctcggcctcccaaagtgctgggattacagtcgtgagccaccgcacctggctaatttaacttttaaaagctacacctgggccaggcacagtggctcatgcctataatcccagcactttgggaggccaaggtgggaggatcacttgaggccaggagttcgaagttaatctgggcaacatagcaaaaccctgtttctacaaataatttaaaaattagttaggcatgcctatagttctagctagtagaacttgtgcttgaactatagttctagctactggggaagctaaggcaggaagattgtttgagtccacaacttcaaggctgcagtaagctatgattgtgtcattgccccccagcctgggtgacagagtgagaccccatttctaaaaactattcttaagaaaagctgccggccgggtgtggtggctcatgcctgtaatcctagcactttgggaggccgaggtggagatcacctgaggtcaggagttcgagaccagcctgaccaacatggagaaaccccgtctttaccaaaaatacaagcttaaccaggcatggtagctcacacctgtaatcccagctactcatgaggctgaggcaggggaatcgcttgaactcaggaggcggaggttgcagtgagccaagatcatgccattgcactccagcctgagcaacagagtgagaccttgtctcaaagaaaaaaagaaaaagaaagaaaagctgccaatttaaattcctgcttagctttttctaaggtgcccgatgagaggtaacaaatggagaatgccctgtggcatgtaaggggaggggagctagaagaaaatcatgtcatccacttggtatctaattgagatctagatggatcacagatttctcctttgcggtgaaacagaaattttagggtgttaccactgcagtgggaacagccaaacaaccttttttctttcgcagttttctttttctttttttttgagttggagtcttgctcctgttgcccaggctggagcgcaatggtgcaatattggctcactgcaacctctgcctcctggatttcagtgattctcctgtctcagcctcccgagtagctggggttacaggtgcccgccccaacgttcggctaattttttgtaattttggtagagatggggtatcgccatgttggcctggctggtctcgaactcctgacctcaggtgatctacctgcctcggcctcccaaagtgctgggattataggcatgagccaccgcgcctgggctgtttctcggttttcttacataaaaaactcattttcagagtagacacctttttcttactgcttttcatggaatttcattatcagttttagtttgcaatattaactctttttttctggagggaagatatgtattagaagagtatataaagtaaccatttctggagatttggggatggaaagataacagatctgacttctgtgttaagtcagccttaaacgcttttgttttccctgctttatttaaaattactgtctttcaaaacctggaaccttttttgtaggtcagtatttatacaaagagaattagcaatatgaaaccttgagggccatctgtgagttgcaaagcaacacctgtggctgttaatagctgagtagcataatcataatttggagtcatttgacctgactactaggattttttttttcctagttcatctacttatattgtaccttctttatgagttttaagtctcttctcataatttgttgcctcagtttctttttttcctataaaattataaacagtaatactatatttgcttccttcttaaaagtataaacattgaggtatttgttaaggatttcatattcctttcaataaaaatattctagggaggcaatagtgataaagaacatggactcaggccaggcacagtgacacatgcttataatcccggccctttgggaggccgaggtgggtggatcacttgaggtcaggagttcgagaccaggccggccaacatggtaaaaccccatctttactaaaaatgcaaaaaattagccaggcatggtggcaggcacctgtaatcctagctacttgggaggctgaggcaggagaatagcttgaacccgggaggcggagattgcagtgagccgagatcgcgccattgcactccagcctgggcaacagagcgagactcagtctttcttttttgagacaaggtcttgcttggtcatcaggctggggtacggtgacagaatcatggctcactgctgcttcaacctcctgggctcaaccaattctcctgcctcagcctcctgagtagctgggactacagttgtgcaccaccatgcccagctaattttttaaaaagttttttgtaggtcaggtacagtggcttatgcctgtaatcccagcattttgggaggctgaggcaggaggattgtgtgagcccaggagttcaagatcagcctgggcaacatagcaagaccctgtctcttaaaaaaaaagttttatgagctagatgtggcaaacacctctagtcccagctgttcaagaggctgaggtgggaggatcatgtgagtctaggacttcaaggaccacctgggcaacatagcaagaccccatctctaaagtatgaaaataaaatactttatgatcagtagaatcatattttcaggtaactacatctttttatgggtggatttttaatttttttttttttttttgagatggagtctcactctgttgcccaggctggagtgcagtagcgctatctcagctcactgcaggctctgctccccgggttcacgccattctcctgtctcagcctcctgagcaactgggactacaggcgcccgccaccacgcccagctgattttttatatttttagtagagacagggtttcaccgtgttagccaggatggtctcgatctcctgacctcgtgatccgctcaccctgttagccaggatggtctcgatctcctgacctcgtgattcgcccgtcttggcctcccaaagtgctgggatttaaaattttttatcagaaaaatttgtattacttaaatggctggctataataggtagattaatttcatattactaaaatcacaggctgggcgcggtggctcacacctgtaataccagcactttgggaggccaaggcaggcagatcacgaggtcaggagatcgcgaccatcctgactaacacggtgaaaccccgtctctactgaaaaaatacaaaaaaattagctgggtgtggtggtgggcgcctgtagtcccagctacttgggaggctgaggcaggagaatggtgtgaacccaggaggcagagcttgctgtgggcagagattgtgccactgcactccagcctgggtgactgagcgagactctgtctcaaaaaaaaaaataaaataaaaaataaaatcacaagactgtttacttgattatttatttatttatttatttagtgagacagagttttgctcttttgtccaggctggagtgaagtggcacgctcttggctcactgcaacctctgcctgccccaggttcaaatgattctcctgcctcagcctccggagtagctgggattacaggtgcatgccaccatgtctggttaatttttgtatttttagtagagatggggtttcacaatcttggccagactggtctacttgataattttcaaagagactcacctaattttcttacattttgtttttgtaggtaattttaaccaatcagatgacaacaaagattgatagaaatcaggccttgcttgttcctgcattaggtgggtaattaatcagataaacattttagtttatcacagtttttcttatctctttcatttgattctcattgagtactatacgcttcatgaaagcagactgtatttgtcttgttcactggttaatcttagcactaagcacagtaccgttagatactgattgttccttttagttatttaacatttattgagtggccagacacagtgtcccacacctgtaatcccaacaccttgggaggccgaggcggatcacttgaggccaggagttcaagaccagcctggccaatatggtgaaaccccatctctactaaaaatacaaaaaattagccaggcatggtggcacacacttgtaatcccacctacttgggaggctgaggagtgagaattgcttgaacttgggaggcgcaggctgcagtgagctgggatcgtgcatctgcactccagcctgggggacagagtaagactctctcaaaaaattgcgtatctactgtctggcaactgttgtgtcaaagattcttgcccccagggagttcacagtgttagggagaaggaaaggtgaatccacttaaatacaaatcacactacagtgaatatcgtggttttgttagaatgtagtgcttcaagatttatttccactaaaatcttaaagaatattctaccagagtcttggccaggtacagtggcttatgcctgtaatctcagcactttgggaggctgaggcgggtggatcacctgaggtcgggagtttgagagcagcctgaccaacatggagaaaccccatctctattaaaaatacaaaattagatgagcatggtggcacattcctgtaatcccagctacttgggaggctgaggcaggagaatcgcttgaacctggggggcagaggttgcagtaagccacggtcgcgccattgcactccagcctgggcaacaagagtgaaactctgtctcaaaaaaaaaaaaaatgtatctgcccttgactagttttcaactaatggcatagatcattctataaacagataatgtagtaaaggttacaatagaaagtacagggtactgtacaaaggacggattctaacctggcccaggtgagcaggatgaaaaggaggaaggttagggaagggagtgtaatagtctgtcatgtttcttccagctgtttttgtcattttctatcacccacttaagcaagagcttcctaatgtttggatccactcaggggtaatcaaactcagcctttctcaaactcatgccctcagcacactatgataaatcagaaagcaaatttataaatttagtgagaattacagttgtcaagcagaatgaagtttatgttttctagtcagtttattttcttcccagataccaggaagttgggaaagcaggggttcagagttggtaagcagagaagcaaataaatggaaatggatgccctcaggaatattatgcttaagttgtgataattctgatgccctccttggtttactagcagaacgccctttaccttggatattgctaggatattgttcaatagaatggtcagttatgatagaagtgttctatgtctgtgctcttcagtacagtagcccttgctacatgtggctattgaggcatttaaaatgtggctaatgcagctgtggaatggaatgtttaattgaattttacttaaatttaaattgcacatgtggcaagtgactgccctgttgtgtagtgcagcactggataaacataactcctgtgttctagactccaatcccaccattagctttctgtttttgacagtgtttgctagtatgataggtcactgctcattttacattactatcagtttagtttcctttatatttcagaggctccctaatcccttaaagagatttaaaaatcaacgtagaccacttctgtatgaaaataagatggctgaatttgctttgattggaattaggaactggcgctctctttgctagttctggaatttggccaggatgcacatcaaaatctcattcctaccctcctgatttgcctcatgcaaactttgttgctgtgtctgttctttggtcttctattgctgtgtctcagctttagattatatgtcttgcgtagaaatggatcatcagaatgcaacaggcagaagacttagaattgcaaatcagtagggtaatgacaaaccctttgagctgagtgggactgaaaagtaacctaacatataacctattagtaattgttaaccatgaagattttcagtgctggacacataaattgctgagttcaactgccctctttgccctccaaatctagcataaaacaaattggtgatctcaggccagtttcacacctaatatgactaataataaaagtcttgtgtttcaggaactcagtttgtccaaacctgagcccatcatctctacctcacaaattatatccaccttttcatttccttgcactgtgtctgcatgatatgataatactcccaagcactattgcttaaatcttgagttacacttaatgcttttttttttggtcttttttctttttaatgtgaaatagaatatacaaatgaaaatgtatatttagaagaacaataataaatgtccaggtgcccattgctcagactgacaaatggaacattactaccccccaggagcctcgtatgctctccccccaagaggcaaccactatcctgaattttgtgtaattgtcacctagcttttatagattttactgtctgtgtatccctaatagttgcttatttctagcctttatataaatagaattatactgtatatgactgacaacttttgctcattattattttttgattcatccatgttgatgtgtgacactgtagttcatttcgatgacatgaatatgccacaacttaattatatattctgttgatgtcaaaaaaaaaaaaagaatattctaccagagtttttacttttcttctggaggtcagaaatacgttaggcttgatgatatggaaaattgacacatatatggactcagacaataaagttttctaaaagcaaatagagaataatgatttgcagtatttccctagataggtaaaaaccttgtaatctcaggatattactcattttccaggttttttgaaagcaagtatactttcgttatgttaaattaataaagtaagattatatttgatcagaggcgttctgagaaatgtataaccaagtcagtaaggccatatacagttattatgttttttactctcaggggaaagttggggacatgctgctacaatacggctaatctttcattgggaccgaaagcaaaggtcagtacagaaacaagttaataactccgaatattgggttaattatactgaatgaacacttacaggtttcttagagctagtcctgtggatgagatatacagtgacccatgaagtgacacttttgttgccttgtctgatatcacctagagcaaacatagaaatgtgttgttattactgcatatttagctacataggaaattctctggaatatttaaatgatggggcgcatgcacctgaaatgagtaggtggccaaggaatgccattttctaaagctcttcgaaataatttattagccatgtagaaggaggtgagtactctgtgttcctggaagagattgaaaaaaaaaagaataaaatcaggacaaaaggaaaattgttgaggttacctttaaaattaatttatttggaacatacgatggtttctcttatttgcttagtatatttcttgtatgaaattgtgtctgtttttttttttattttgtattttgctgtccagcttttattatccagttacttacctgcatttcacaagtattgttctttaaaagtatggcagcatgaaatctttgtatttgtttttaaagctgctgagcaagtgaacaaaccagcttttattttcttgaaaatagaccattgaaagctgtgaagtcttttctacacttctagaaaatgtcagattcatgctagcctctccgctttgtgattaattggtataacctagaggtcttggtttggaaatgctctaataaagggagaaattaaaatggcatgtgggcaaagatggaataaaaggtcacttaaatacatattgggcctagccagtgaaaatgtctattttttaatctatatttctttgttgttctacaaactgaaaaaaatcctgcctgaccaagttaggttttacggacctgaagctcataacagaatgattacacttctgtatatatcttttgcaactgatcgtgcagtttgggtcttctttaaaaatggtatttgcaaagagctcaggtagtgttttttttcccccacaatacgtagtgctttactattgactgtcgccccctaatttaaacacattttttactctaaaccagtatgactggtaaatcctccccctaattttttttctatgatcacaatttaaggtagttcctcctagttttgtaagtaagttgctgtatactagagtcacaaaaggagttattttctcggcaccaaaccttattgtaaagatttggcaacagttctccagctgtcttttgaacatattgcttatactttcccagttttaggttattctgtaaagcacattccgtcatttattttttcataggaattacgcctgagttagtatacagtagtcttcttcagactataattaaatatttactaataaaatgcatttaagaagaaaaataataggaacagagcaagatatttcatctttttatgaactcaacaggaggaaaagtttgccttctttgtcaagttctagaagttagcattgataagttatccaagagatcagaaaatcacgcttaccatgagttaaccattgtatgaattcaccttcttacaaatccttcccaagaaattagaaactaaagtacatggccggatgcagtggctcacacctgtaatctcatcactttgggaggctgaggtaggtggatcatggggtcaagagatcaagaccatcctggccaacatggtgaaaccccatctctactaaaaataaaaaattagctgggcgtgatggcacacacctttagtcccagctactcaggaggctgaggcaggagaatcacttgaacccaggaggcggaggttgcagtgagccaagattgtgccactgccctccagcctggttacagagtgagactccatccaccccctgcaaaaaaaaaaaaaaaaaacaagaaaatgatgtacaacaccaacactgaatatagatagattgggggaaatctgctgttctataatattttttctacatctcataagatcatttttttaattcttatttttattttatttatttttcatactctcattttagtgagtgcttgcttgtgctaggtattttactaggcactttaaatataacatttcagataatcttttcaataattatttgcagaatgtatacctattattattaaaagaaaaccaaggcccagaaaggttaactgaataagtagtaaataatagctactatttattgaatatttcttaactgtcctttattgtgcaaagcactgtatgtatatatgtgtacatatatacgtgtatgtatatatgtgtatatatatagattatatgtatatatgtgtatacgtatagatgtatatacatatgtatatatgtgtatacgtatagatgtatatacatatgtatatatgtgtatacgtatagatgtatatacatatgtatatatgtgtataagtatagatgtatatacatatgtatatatgtgtatacatatagatgtatatatgtatatacgtgtatgtatatatgtgtatacgtatagatgtatatacgtatacgtatagatgtatatacatatacgtatgtatatgtgtgtgtatatatataatttcatgttattttccacgtaaatctttgaaatagtgttaccagatgagatcaggcacattcagggtggtatggctgtagactgaaaatagtattatctacattttatagctgactttataaacttttttattttttttgagacggagtctcgctctgtcgcccaggctggagtgcagtggcgcgatctcggctcactgcaagctctgcctcccaggttcacgccattctcctgcctcagcctcccgagtagctggtactacaggcgcctgccaccacgcccagctaattttttgtatttttagtagagacggggtttcaccgtgttagccaggatggtctcgatcttctgacctcgtgatccacccgcctcggcctcccaaagtgctgggattacaggcatgagccaccgcacccggccttataaacttttttttttttttgagagggagtttcgctctttttgcccaggctggggtgcaatggcgagatcttggctcacttcaacctccacttcctggggtcaagtgattctcttgtctcagcctgccgagtagctgggattgtaggcgcctgccaccacaccttgctaattttgtatttttagtagaggtgggatttcactatgttggccaggctggtcttgaactcctgatgtcaggtgacctgcccacctcagcctctcaaagtgctgggattacaggcatgagccaccgcactcggccatagctgactttatggagttcatttcttttcttctataataactgtttctagaaggtaattgtagtattgtgttgattgccagccaatctgaatatgtagcttactcctttttttaggtaaaatcttttttcttcaaacttttttttttcgggctgtggatatatgataaataatgtacatactttatgtaatcaaaataaattgacctcatttaatagcattaaagtagttttgttctttatcatttgaaacctgacatctttaagttgttaaagttgcatgaacttgagcccagaagttggagaacagcctggccgaaatggcaagacaccacctctatagataataaaaaattagccaggtgtggtggtgcacacctatagttctagctgtttgggaggccagagttgggaaaatcacttgagccctggaagtcagggtggcagtgagctatgattgagctattatacttcaggctgggccgcaaaatgggaccccatctctaagatattaaaaaaaaaaaaaaagttacatgaggccgggcgcagtggctgacacctgtaatcccagcactttgggaggccaaggcaggtggatcacctgaggttgggagttctagaccagcctggccaatatggggaaactgtgtctctactaaaaatacaaaaaaattagccaggcatggtggcgggcacctgtaatcccaactactcaggaggctgaggtaggagaatcacttgaacccaggaggcagaggttgcagtgagccaagattgcaccactgcactccagcctgggcagcagagtaagactctgtctcaaaaaaaaaaaaagttgcatgaaattttgtatgctttatgctttttaaattttaggttattttaaaaggatggaaatagaaattcatatcagggaaaaatagttataaaaatgaacatttttcatttggagaggaagactaaaaatcttttttttttttctttttttttttgagacaggatctcactctgttgcccaggctagagtgcagtggtgcaatctcagctcactgcaacctcaacctcctgggctcaagcagtcctcccacctcagcctcccaagtagctgggaccacaggcatgtaccaccacacccagctaatttttgtaatttttgtagagatggggttttgccgtgttgcccaggctggcctcgaactcctaaactcagtcagtccacctacctcggcctcctaaagtactgggattataggcgtgagccacagcacccgtccagaaactaaaaatcttgaatagccaaattatattgggcattgaacttaggtgtgctgtctcatgccccagcccctgtccttcaccagtaacacctgatttttacccttagactaatgatggaataatattccaacagttattaaaagaaatacttttgtctatgtccttatattatgtgagttttcctccaatttgcatattcatggttatatgaggccaagattattcagaattacactactctttgccaagacgatctggtggtagagtggagtaataaatcaacacccccacacagtgtttcatatgtgtgctcagttttagagcacaaattgtgcttctgtcttatttcttcctgacccaaactatgtagttcagccatatgttaagctacatctcagctggggccatgagccaagtgattctttggtttagttttcattttaaaagatctctgaagagacatgatgcataaaagtggtatttttacctagaaatttgaggatgatttttttgttttgtttggttttgtttttgagatggagtttcgcttttgttgcccaggctggagtgcagtggcgcaatctcagctcactacaacctcggcctcccgggttcaatcgattcttctgcctcagcctcccgagtagctgggattacaggcatgcaccaccacgcctggctaattttttgtatttttagttgagatggggtttctccatgttggtcaggctggcctcgaattctcgacctcaggtgatccacctcggcctcccaaagggctgggattacaggtgtgagccaccgcgcccggcctgaggatgattttcaacctgaataattaatgcccctttgactttaggattctttttttgttttgttttgttttttgagatggagtctcactctgtcacccaggctggagtgcagtggcgccatatcggctccctgcaacctccacctccctgattcaagtgattctcttgcctcagcctcccaagtagctgggattataggcatgcgccaccacacttggctaacttttgtatttttagtagagacagggtttcaccattttgaccaggctggtctcggatgcctgacctcaagtgacctgcccacctcagcctcccaaagtgctggattatagacatgagccactgtgcccggccgactttaggattcttaacaagcatgtaaatgcttcttaaaagcttttcactttttaataatttcctcaggatagatgtactaggcaccttttttggacatactgttgatatgaggtgatttagataccaatttttcagaaggctagctgattttcatcattcaaaaaatgacttcttaataaggcaggttaaaatacaccttgcctctctttttctgtgaatttttgcattaaagatagattatcaaccctagggaattataaaagtttataattccactcaacacagctgttcttttttttttttttttttgagatggagtctcgccctgtcgcccaggctggagtgcagaggcacgatctcggctcactgcaacctccacctccccagttcaagtgattctcctacctcagcctcctcagtagctgggattacaggtgcgtgccaccacgcccagctaattttttttttttttttttgtatctttagtagagatgggggtttcaccgtgttggccaggctggtcttgaactcctgacctcgtgatctgcctgcctcagcctcccaaagtgctgggattacaggcgtgagccaccgcacccagcctcaacatagctattcttgtattacatattacttagcaattatttatgtttaaagttgcaattacagagtatagaacattttggattctgctgtattttggtctgtgtttttcttttgaattgtgtctgagaagaggggcaatttcaaaattaagagagtaacagatcatagccaaaatgtcctttttgaattgtctttgaaaacaaatcattctattttgtgtaagtaaatgacccttataactctgagaatcttattttcctctaggttagaatctgtattttttagatcagtttcattacattgtgctaaaacatgtatataacataaaatttaccattttatgtttacatatagttcactggcattaggtacattcatattgtgcagccatcatcatccattttcagacctttttcatcttcccatactgaaactctgtacccattaaatgctaactcattcttttttacccccagcccctgacaatcaccattctaccttctgtctctgaattttactcctctagcaaccccatataattggaatcatataatacttgttctgatgtgactggcttatttcacttagtataatgtcttcaaggctcatttatgttgtagcatgtgtcagaattttcttccttaagtctgcatattccattgtatgtacataccacattttgtttattcatctgtggatgcacacttgggttgcttccaccttctggctattgtgaataagttacagtgtatcagttttaaagtaattcttaaaagcagtttttttttttttttttgagatggagtttcactcttttttgcccaggctggagtgcaatggcatgatctcagctcaccgcaacctctgcctcacaggttcaagcgattctcctgcctcagcctcccgagtagctgggattacaggcatgcgccaccacacccggctaattttgtatttttagtagagatggggtttctccatgttggtcaggctggtctcgaactcccgacctcaggtgatctgcctgccttggcctcccaaagtgctgggattgcaggcgtgagccaccgcgcccagccaaaaagcagtcttaaaggtttttgtttatatttgttgctgttacagtacttgaatatagttaataagagcttagaaatttatttctcagctacttttagctttcagttttatattaattgtataagacataataaaatcccacctaagcagatcttgttctgtcatgacttatttttgggacataatcattttatattattatttttgtagagatgggggtctcactatgttgcccaggatggcttcaaactcctggtctcaagtgatcctcatgccttgccctcctaaagagctgggattacagacatgagccaccatgcctaggtgcatcattttaaaacaatgtcgtcctagctatttttattgggtgtaatatgagtaagtgtttctcatttgtagtataagaaattatcataattcttcagcaataattaaaaaaacatgattactgcagacagtttggaaaatataagcaagcaacctttaccttgtgataacagcttttaacttcttgattgtagtcttctatcaattcttttagatgtgcgtatacatacttataaatatgggataatacagtataactattatttagtatattattaatactttcctatctcattgaatattttcttccacgtttagtttttagcataagtaatatctcatcatatgtaaaataatttatttgaatcagtcattggacttttaggttgctttaaaatttcatataaactctgttatatacatacgggtaatttgaagggtgtatttttaatatttctctcctttttgtgttcttagagaaaaaatagaattattaatataataaacctatacatttaaataatgagtttggtcatctgaacttttaattaattaagttcatgtgtttgtatgtatttattctttttctttaagcaggttggcaacattgtacaagtcacccagccagaaggaatgcacagtactgtttcaaatcaaagtcagtattatttgattagagtgggattttgatattgatgggcggtaattatctaaagagagaatttacaacttgcttctgtcaacttctgtaggcagcaagcatatttgaggacagcttttgatgcttagaacattgtccccaaaatagtagtatatacagaatattgtagtcacaaatggactgaaatttattcttaagagcagaggaaatacttattttggggtagtgtgttccatgccatatgtaatgtcaggatattaaaaatctttaaagtgaaagttgttgaagatttccagaaaagaaaaaatactaacattacttattttggtctgtaggtattatagatctattgtagcaccaaatatagcccactttaagatgttaattcttctgtgaatttacatcatagaacacacattttttggctgaaatatgcatatttatcaatagtgttgagccaaatatatttttggcatctctttttttttgagatggagtctctgcgtcgcccaggctggagtgcagcggtgcaatcttggctcactgcagcctccgccctactggtttaagcaattctcctgcctcagcctccctagtagctgggattataggcgtgtgctaccacgcctggctaatttttgtgtttttagtagagatggggtttcgccatgttggccagactagtctcaaactcctgacctcaagtgatccgcccttctcagccttccaaaattctgggattacaggcgtgagccaccgagcccggctttatctcatttttataacaacaaaaacagaaatagagattctgaaactgaattatccacttagtctttgcagtacccaggtgtacttgaaatatcctagttggggaaaaaaaagagagagagaaatatcatagttggaaaactttagagtatttaattatgaaaataaatctgtaaagtacctaagacttaggttatttccttttacttctaacaaagctatcgtaaagtttgttaggattgacctttagagaacatttttataatgcaatgttatttctgtgcgtgtgtatgcaagggtataaataagtatatataaaatactcttaatatagcccgggctttggcacgtatccatgaggtttattctcttcattcacagtggttgataaatttctatctcaagaactttctttttttttgagacgaagtctcactatttcgcccaggctagagtgcagtggcacaatcttgtctcactgcaacctccgcctcccaggttcaagcgattctcctgcctcagcctccagagtagctgggactagaggtgtgtgccaccatgcccagctaatttttatatttttggtagagataggggtcaccatgttggccaggctggtcttgaactcctgacctcatgatctgcccacctcagcctcccaaagtgctgggattacaggtgtgagccactgcgcctggccctagaataaagtagctttcttattagttacttaaaaatatttctaagatcagtcttcaaatgttcttaaagcatatttgtatatatattttttatctttcagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccagatcata

SEQ ID NO: 126 - DNA, 30418 bp, Homo Sapiens
ttttaataaagcctttttggtttattgcacatcatataaaactgactgcactgtatttgaaacagacgaggacattcacaaggatggagaaaccaaggtttccttctttcctggccctcatcttcctccacactgctcctgaggctggaggcagctttaacccaaagaatggaatccgctagtgaacatgtttgttttgtggtggcatcagagttgttctgggcccttgtgcactgtccagtttggagactgctggtaacaatgacaagtgtccgggtagcacggctgggtcaggagaactgcatctgggctgtggcagtgcagggagcctcaggacacctggtctcaggctggcggtggctggggttggcctgagtgctgaggaggacgggcccgggctgccggggcaggctggacctgacgtccatctcaggacagacatgtagggcagctgtgcccaggactggtgggctcagagggtggcaaatgtggcagaataggccatgccctggccagctggtgatggcccactgccccctgggacagctgagggccctcttgggttaagggagacacactgggccgggcgcagtggctggcgcctgtgatcccagcactttgggaggccgcagcaggcggattgcctgagctctggagtttgtgaccagcctgagcaacatggtgaaaccccgtttctactaaaatataaaaaatcagctgggcgtggcagcgtgtgcctgtagtcccagctatctgggaggctgaggcaggagaattgcttgaacccgggaggcggaggttgcagtgagccgagattgtgccactgcactccagcctaggtgacacagcacgactgtctcaaaaagaaaaaaaaaaagaaaaccaaaaagggagacacactgtgagcacggacagaggaaggggctggagtctgtaaatccagtgggtgacatgctccaaatgccaccctagaaagcagagcccagaggaggaagccctggattgggctgtggtcatcatcacagcgcagagctgatgtggtccccaggcccagaaatgcctgtggaggcctgacccacgctgggtgtcccaggtcctccctgcaaatggcgggggtgggggctgctgatggcaggttggggtggggtcgggatggccccatcagttccgctccaccttcttcttgccccgaggctgccgcctcctgccctggagcttctccctgcgggtggcggcagtggtgaaggtgatacagtgggtgtccaggaagtccaacagcctgcgcgaggacacacggaggccgttctgcctcagctctgcctgcagctcccgcagctcaaagggctggtacagcagcaccttctggtacagggccggcttggagcggatgtagcacctcagcgcctcgtctgtgtccgccgcctgcacggctgcctgcgaggcactgacctccccctcgccctcctcttcacctgcagactcaaatgccgctccaaactcacaggaggaagaactgaaaagagccagaccaggacgttgtgcaacccctttctctccagcccctgagaccatgagcctctttaaaggaaggaaggtgtctacgggtcccatggagcctggcctgtggcacgatccccagcaaggcaggacgggcctgagagatccctgcaggctacgccagcgggatcctgccccagccagaaatgtctagcatgtggggcaggaaccaggaggcctgcgcagggctggggtcagggaaccagccccctaaacccacctggttttcccacaggtcaaacccagaaggtgacgggggtttttgaagattggccattaggtctcactcgtgccaaccctcacgcccacgggccagaggatacatgaggccactgaccccatcgcatccatccggttacctctgtgagctcaaggagctgtcactgccatccacagaggtggccacggattcttgagaggctgggatctgggcgtcatcattgaggcctggaggtgcctccttggtgggcgacctgcttgggggtgtgatgctttcatgatgcttcctttgatgtcgggggcccttggtcttagcaggtcccttgggcctatgggccccaggtcctgtggtggcctcctgctgggcatggacccctgcccttgaaggcttgtaggtctgggaggcgagggtctggcagtgaggcgcctgcaacagcggctgtgaggactggctctcgtcctcggagtctgagtccagggtctggtgagtgtactggaatatctccttcagcttcagaaccatctggcgtttaggcagagggcggactccaaacctgacggaggaacaggtggatctcaggacccacccacacagctggtccacactccacgttccctatcttagcaaagagtgatacccaatgcattcagcgaatggcttgtgtgacaaaccatagatgcctgacttctgtgagcatcagaggttagtgtctattctaggcgccaactaagcttactctgaatattccaaaagaaacattgccagccaggcacaatggctcacgcctacaatcccagcactttgggaggctgaggcaggaggacagtttgagctcaggagttcaaggccagcctgggcaacatagcaagaccccgcctctacaaaaaatacaaaaattagccaggcgtggtggtgtcacctgtagtcccagctactagggaggatgaggtaggatcgcttaagcccgggaggctgaggctacagtgagccaagatcacatcactctactccagcctgggcaacagagtgagatcctgtctccaaaaataaaaaataaacaaaagatatgctgctcccagttctgagggatggtggcagcagcagcttccccgggtgcccgagtggaagagcagtgtcatgtggatgtgagagttaaatgttcttttaaaaaaaatcaggcctccgccgggcacagtggctcacgcctgtaatcccagcattttgggaagccgaggcgggtggatcacgtggtcaggagttcgagaccagcctggccaacatggtgaaaccccgtctctactaaaaatacaacaattagcctggtgtggtggcgtgtgcctgtagtcccagctactcgggaggctgagtcaggagaatcgcttgaacccgggaggtggaggttgcagtgagccgggactgcgccactgcactccagcctgggcgacagagcaagactctgtctttcaaaaaaaaaatcagacctcctcactcagactgctctggctagggggccatttccatctacatggaatatggggacctgctgcccaggggtgacatgcacgaatcctgtgtgttgcctccctggggaatggtacgcagagagaactgggaggctcaccccggcacccagcagtcacacatgctccctaaggagctgactgcagacctttcttcccaagcccaggccagctgcatccaccagacccagagaccacacggggggcccttccgcccccaggtgtgtgaaacccagttacttatgggagggaaaagaccactgtgggcaacaagctttgaagaccgccaacctatccagttccttcttcagcaccggcgtctccataatggaatactgtggcatcggcgttatgggcactttggggggcaagttcttcttccgattagcaccttctgggtaaaacaaaagaagcacacgttttagcatgagggacacggatttcccacatctgatcccagtagcgtgaccaagaggaataatgcacttgaagataacccaagcatcgttttgctccatgaaagcaacagtggtcaccccttccctgtctggagcaggggcttcccaatgatagcatcggtgacacgcactgaggaccacaccttgtataacacgggtgccgggtgaacagagctcctggggccactgaacccaacagcccggcacgtgactaaaacttatgcatgtaaacttaaaaatatctgacccacagtgacaacttgagacaatgggccacactgatactcttcaaacaggcttagacatcagttttgctttttaaaaataattcatcaatttaaaaaaacccagttaaaaaatgggcaaaggggccgggcgcggtggctcacgcctgtaatcccagcactttgggaggccgaggtgggcggatcacgaggtcaggagatcgagaccatcctggctaacacggtgaaaccccgtctctattaaaaatacaaaaaattagctgggcgtggtggcgggcgcctgtagtcccagctgcttgggaggctgaggcaggagaatggcgtgaacctgggaggcggagcttgcagtgagccgagatcacaccactgcactccagcctgggcgacagagcaagactctgtctcaaaaaaaaaaaaaaaaaagggcaaaggatgtgaacagacatttctccagagaagatctacaaatggccaataagcacatgaaaaggtgcccgacatcattagtcatcagggaaatgcaagtcaaaaccacagtgagataccactgcacgcccactaggatggccataacaaaaaacacagagggtttgggcaaaatggcagaaccctatctctacaaaaaaaaaaaaaaaaaaatacaaaaaaagttagcagggtgtggtggcccaagtcaccaatgtgggcagctgtttgtggctggttccagctactcgggaggctgaggtgggaggatcacctgagccaggaaggttgaggctgcagcaagccatgaacacgccactgcactccagcctgggcgacagagcaagaccttgtctcaaaacaataacaacaacaacaaaaacagaataacaagtgttggtggagatttaaaatggtgcagtcactttggaaaacagtctcgcagttcctcacaatgctaaacacagttgccatatgacccagcaattccactcctaagtacagaaccaagaagaaggaaaacatgtctacacgaaaacttgcacatcaatattcctaagtggcattattaataaccacaaattaaaaacaacccgtgtgtccactagtagatgaatggataagcaaaatgtggcataccatcagtggggtattagacatacaaaggaatgtatgcccaaagccagggcaacatagcaagacccagtctctactaaaaaaaaaaaattagctgggcatggtggcagctgcctgtagtcccagctactcaggaggttgaggtgggaggatcacttgagcctgggaggtcgaggctacaatgagctgtaattgcgccactgcacttcagcctgggtgacagagcaagacccctgactcaaaaacaggccaggcacagtggctcaggcttgtaatcccagcactgtgggagaccaaagtgggtggatcacttgaggttaggagttcgagaccagcttggccaacatggtgaaaccccatctgtactaaaaatacaaaaaaattagccgggcatggcatggcgatgggcgcttgtaatcccagctactcgggaggctgaggcgggagaatcgcttggacccaggaggtggaggttgcagtgagccgagatcgtgccactgcactctagcctgggcaacagagagaggctccgtctcaaaaaaaaaaaaaaagaataaaaaggaataaaatactgatccatgctacaacatgtatgaatcttgaaaactgtatgctaactgaaagaagccagacacagacacaaaaggccacatattagttatatatggctctgtttatatgaaatgtccaggacaggcaaatccatagagacagaaaggttcttggttgccagggctgggggaaggggaaggtgagagactgctcatgggtacaggatttttgagatgatgaaaatgttctagaattagagagtggggacaattgtacaacactgtgaatgtactgagaagcactgaactgtccattttaaaagggtggatattatggtatgtgaattatatctaaataaagctgttactttaaaaaataataggctgggcgaggtggctcacgcctgtaatcccagcactttgggaggccgaggtgggcggatcacctgaggtcagcagctcaagaccagcctgatcaacatggtgaaacccgactctactaaaaatacaaaaattagctgggcgtggtgctgggtgcctgtaatcccagctactcgggaggctgaggcaggagaatcccttgaacccgagaggtggaggttgcagtgagccgagatagccccactgcactccagcctggtgacacattggaaacagtcagactttggttcttctgccttttatgaccatggagccctttgagcccccgatgaaagcggcaggctctgtctcctgagaaaagcacgattcttcctgtggccgcagcgtcgtcctgaagcccacctcagatctgctgtgcagcctcctgcagctgttctcacagcactgcctgggaactggttagaaatgcaaattcttagtcaccctcccgaagcaaggctctggggcaggctgggccacgggcgtgctataagaagctctccaggtgtttctgaagcccctgagggccgaggacactatcagtggcctcattcatctggattttgggaggaaatgggcccccaggccgcaggcaggtgctcactcacagcctggcctttctcccagtcatgctcagcccagcccggcctgtccttgccctccccggaggtgcctggatgggagcagcagcaccgagggggccgacacctggggctctgactctccccggggactgaaatgagcagggaggtggcatccctgcacctgggaggaccaggaagaacaggcctaacagcctctcacacttgtcccacctgattctttttttaattgaggtgaaattcacataaaaaaatcgtaaagggaataattcagtggcattaagtattcacaatgttgtacaaccatcacctctatctatttgcaaaacattttcaccaccccaaaaggacaccctgtatcccataagcagtcactccccattccccctccctccaacccaggccaaccactaacctgcattttctctggatttgcctattctagacatttcatatccatgagtgcagacagtacatgaccttctatgtctggcttctctcacccggcagcatgttttctgggtcgtccacgcggtagcgtgtggcagtgcctcactcctctttgtggctgaacactattccattttctagtggtctagatggaccacgtttggtttccctgttcatctcctgacgggcatttgggttgcttccagcttttggcgattgtgaacagcgcttctatgaacatgcatgtctgagtccctgtttttaattcttttggatatacaggtaaaagtggaattgctgggtcctgcagtcaatctacggttaacattctggagaaccaccctggtccaatcttaaggcatgccgatacttgctgaatgagttgtggcctttggaggtgccggctccgtgttctggagaagggtccacagatgtggatttttaacacatgcccaggtgagcactggagccaggcaagtttgggaaacactgacttactggctgagaagtgtagcatgagaaccagcccggctctcctccactgtggaggggagtctggaaggcagcggaagtgtcatgcctcaggtcagcaggcattcagagggcagcccctgggtctcatgactgatcttcccaccctcttagtgtaaaatagtaacaaagacagtccccttccccagctctcctggctactcactgggtgtctctaacccttcgggcttctgagctccaccagcgcttggcatctgggccggaggaggggtctctggaggcctctgctcttccccgtcccaaacgtcccacagagccgaattcagaaagctcggcctgctattccccagggagcccgcgcccgaggacttctcttgcaatttcctctgggtagtgcagcttcctcggatgggggtggtgtccaggagtcccggggagcgacagtcacggctgtcggcggcctcgttcatcctgcggctggggctgctggtgctcagggggccggtccgctccaggttccagtggtcaatgggaattggcgagaggggctccatgtgccagcagcagtcgtcaattggaattggggggtcactgtccagtggggggcttctgttggcctgatgggaggccacctcctgctcatcgtcactgtctccgacttccaccacttcacccgctggggtctggttcaggaagcttggcccaggcggcgagtgtttcaggaaccgcctgctgaagtgggcgcggtcccctgagatgggatgtggagccagcggagaggagtgcgggtggcccccggggtggggacgggaagggcttctgtggccttgccttctgccgtcagaagttcctggagagacgggagtgaggcatgaggacggtgtctggggcggtggtgtctggggcctgatgacagaaaacttctgtgcgacttcgttcccttccctgtttcctactgaggccctgggcgtgtgctgagtcaccgcctgcacggccagcccgctcctgaggctgctgatttgggtctgggaagaacagtcacggcttctgctggccagcggggtggcgggcaccagccacgaggtgtctgtggtgctggcctcgctggggctgctctcacggtcacagaacagccagggagcccctctcctgcccaaagagccccgattctccggcagcgccccctcatcctcctgctgcagcacagcttcgcttcttggtgggctctgggaaggttcctgatctgcatcaacatcaatgatggaaaacagctcacaggacctagggctaatttctagagctttcttttcttccagaggatcactagaaatggacttcattttggtttgttctagctccagctcctcatccgagtccagtaagaggatgacctcatcttcttcgttcagtttggatgaagatttctgagatctggagctcgaatggtcaggatttgactgggttaggtcaatagacggagatttttctgggaacatcaggacccccttatttctgcactccagcacggaccgacgctctttgcctttctggtgccctggctctttagacagcgtgaggatgctcctgtcccttttctgctttgatggcacagctggagacagcaaggttggggagcccacctgggaagttccgccacgggaccggggtgttgacagggacgacccacttgtgtgatgagacccgcggggactcccgccctggggaggccccaataggaagcggcacgggtgcggtggagatgcctgccagggagccaggcgatgagaaacctccagccccctttccctgacagcgccactttgttcctcgggctcacttgttatttgggacggctctgagatctctccctgagttgatgagaagagctgttcgtaatccccggcatcatctgagtgcggaagagagccttcttttctctctgcctggcagtccctggaagggctggagcagctggaatggccaagcgcctcctctggcgcctcctgctcaggggcctctgctccccgtgcccctgagtgctggccctggggtggcgggagagcgcactgtcccatcttctcccaggtggtggcggcctcatctcttcctggctccaacggctccatctcctccaccttgtcccactgtttctgcacctggacacctgctaggagttgcccagaaaccggactgccaccctccagccagtcagcgtcctcgccggcacccgctgccctttcttcctggagaagctttcgctgagtagctgcaaattcataaatttcttccatttctgcttcattcacgttttcttgatcttcttcgtggtccttggatttcaacaaagtctccgcttcctcctcttcatctgcccacattgacctcaagagttcctggaaattctcggccctgctttcgcaattctctgcttccttctcctcccatggtttgccctctgagtcagtggcaataggcacctgttcgcacaggtgaacgagctcactcacgccaaacctgcaacacgaaacatcgacagtcatcgcccctctgcgtggagatgggctctgggtgccccggtggggtggcggaccagagcagagtcttcaccaggaggaatgaccatgacccaggccctgcttccctttgaagacggtgtccacactccttgccagaaacacccaggccacttagttccagaaaccggggactgacaacacttaaagcagggcttcctaactatagctgcagacataaaggggtgtgtcggactgaatgtaaggtaacagggattggcagagctacaaaactggggagtctgtgctgcctcagaggctcttaagatatggtgtcagagccaggcattgtggctcatgcctgaaattccagcactttgggaagccgaggatcactcaaggccgggagtttgagatcagcctggacaacatagaaagtctccatctctacaaaaaaatgtaaaaattagcctaggagttcaaggctacagtgagctgtgatcatgccactgccatccagcctgggcaacagcaagagactctgtctctaaaaggataaaaaaggtcatgcatggtggctcatgcccataatcccagcactttgggaggcggaggcaggaggattgcttgaggtcaggagttcaagaacagcctgggcaacacagcgacactccgtctctccaaaaaataaaaaataaatgaaaagacatggcatcagacacaatccacagcacaccaagtccttgagtcagcccaggccaacgggcaagccagccagccacctgcttgaaggctctgtggcccgtcagtatatttccaactccagaggctgagctgttcctttcctaagaaagcagcggagggaggacgcaggctcggatcagcggcccaggccctgtccagaggcacaacacttgtccctctgagctgctgcctctctcctaagatgctggctggacaagccaggagagctgtggcatctgggatgcagcctaagcattctctccatgcctgttttatgggactctggaaaggactgctgttgttcaggtctagtggtggaacaatcactgagcagcagtgttggggggcgctgtagccaagggccattctcttatcacacctagggggttaaaaaccacgggactcaatagagtcctcctgatccagtgcttggcacccctgcaagggtctgttctggcctgactttcacctaacatgccctgttccacagggtcatcactggtcatggacttgggattaaaaggtataaacaggactgttagttctcttggcctcagccccgagccctctgcagcacaaccctccagagctgttaacctgccagtcctcgtcagttaatttcaaaagctggggagcaatccagacctgtgggccagggagctcagctcagagctaaggccaggaggaaggccagtgtccgcagtgtagagatagtgcaggaacgtgcgggcggcctcggtgctcacgtcacccagcaggacacgctgggtcagaaccccgtcctctacagcggagaagccttcattgttcacctgcaggtgaaatgcaacacagagggtttactgatcagagagttgtaacttggagcaaagcagacggtctggggtgtcctgcaagtcactagtctttttatttttctttttagagacagtgtctccccttgtcacccaggctagagtacagtggtgtgatcatggcttactgcagccttgaactcctaggctaattttaaattttaattaattttattattttgagttggaatctctctctgttgcccaggctggagtgcagtggtgagatctcggctcactgcaacctccacctcctcggttccagcgtattctcctgcctcagcctcccgagtagctgggattgcagccgcccaccaccatgcccggctaattttttatagtttcagtagagataaggtttcactatgttggccaggctggtcttggaactcctgacctcaggtgatccaccctcctcggcctcccaaagtgctgggattactggcgtgagccactgcgcccagcccctaggctaatttttaaatttttttgtagagatgggctctcactgtgttgttcaggctggtcttgaactcctggcctcaagcgatcctcccaccttagtctcccaaagtacggggatctcaggcatgagccgccgtgcctggtccctagtcttaaaagcagctccatgccccaggaaaagcattagccactgtttatgcagatttttggccaataattttacaggtgaggcctaacactcctcttttgtcaaatcgtattgggactagatattccaggaccccgttaagagtcctcctgatagacacatatgggatccagaactttgacaaagactgagaatagctccctgagttcctgcccacactcaagtcaaatgctttcaagtcagaaggcaggttcatcagcaactcatccctgaggagatcaattatgagcctttgtaattatgcaaatagagaaaagagaaaacaattctgggaaacaatggattttctttttgttttgttttgtttttgagacagagtcttgctctgtcgcccaggctggagtgcagtggtgcaatctcagctcattggaagctccgcctcccaggttcatgccattctcctgcctcagcctcccgagtagctgggactacaggcgcccgccaccatgcccggctaatttttttgtatttttagtagagactggtttcactgtgttaggatggtcttgatctcctgaccttgtgatctgcccgcctcggcctcccaaagtgctggaattacaggcgtgagccaccgcgcccggccaaacaatggattttcattcaacagaacgaaaacactgatgtttcccagttgtgaggccatcccctcacacccactcctaacctcaagcgtgggtctttatctcttctccacgtgttgcagaaacggatggttgggagggagaaggtgagaacatggtggggcaggaagtgagggagagtgggggggtggaaagggcacctgagacatgggaagacctggttggagaaaggcaggaggagagagggagagagaggaaaggagggcacacggcagcccacgtacttacatactggatgaggagcgggcatcgggcataaagcacgaacttgtgggcgtaaagcacctccccgctgtccgtctgaaactggacatcactcaggtgtgggttattgaccatggcgccaaagtcagcaaccagcagcccgagggagagctgaagcaggaggagaggaagagccgtcacctccccacctctgctctgctaactgggcagtgggaagctccccgcatggaggtggcgctagggtgggccgggagccaggacctgcattctcctttcctctccaaaacgcttcccacgatggcctcaacctctgagtgaccctaaggccctgagtagcacagaagagcaaagcactagcttgttcctctggctcttgccagtgggttccctggcccccgtggagatgccagacatggggctagatgtgaactcacagtgctggcagctcccgcactgagtgggacaggctgcgggatacctgggctttgaggaggtgcacccatcccctgtgacggacaagcaccctgagtccaagcagctcggggacctggccaagaggacagccgggtccagtctgtgatgatgtccctaggctggccttggcatgaagtgcttggttgacactgacatgcaaatgggaggaggtccactctagggaaaagccagttcccaccccggttcttccccagacagcgcactgacagggaggccaggccaggctgctcagctgtgctctggagcccaggacccgcacagaggggagggagagcaagcccttggtgagctcccaactactgaggaacgagcagagcgtgcctggatggggcaaccgcgctgagaaactgtggtccctctacactcctgggacccaggacagggcaggctctggggcctcaaccccaaggtgccccatggagtcacagacagaaaaggcagaagtctcgtggcagagcccccagaggggcgctgaggtggctgtgggtccgtggctctgctcacggatgtcaggatgtggcagccttctggaaagcagaggccttgagaggccactgcacttgcgttgggggccagaggccagcggtgagccaaccccaccacacacatggcaagtgggatggccgggaccagagagcgcgggccagagccagttcttaccaaggtgcggccgcccctgtccgggtgcttgtcctgcgatggcaccacaaacccagtcagaggaaggccgccgggcaccacgtccaaccctgagtggaggattcacaggttaaaggaacgtcacagcccagccacatccaccaccaagaagacagcgttgaccacaggctgagccagcccctgcggtgcctcggaaggtgcttgctatccgaggacaccttcatgcaaagcaaacccgcacaccctgtctcaccaccactccaccagggaggtaagagaagagcaaaacagacagttcacccagaggattcactcgctgtgggcagacagctctgtctttggttaaagtggaaggaaaatcatgacagagttgtctacaccacattgacctttgagaaaaaatgaaagcgcccagaggctgcgtgttctcccaccaggtcagagctgccgtcgcggcggcacaagagccagtccatggcagcctcagccgcggggaggggaggcccgggagggcagggctggccctagagtcccacccagcatctcacctgcagtcccttccgagccagccaggcccccactgccgggccacgggctggcgctcagtccctccctcgccaggtccacgaggtcctgcagggcctggtgctccctctggctggccgaaggcgacgggcccctggagccacagcctgcagtgggggtgccgtggagagcgggtgaccttcgctcgctcagctctgagtgctcaggtggcaccagaggcggcacgggctcctgcataaggccctgaaagaagccagtaaggagagtgaccacgtggtcactgtcattgacgcacacactgcagaagccatcacatgtggtatgcacggctggacctaaaactacagagcaggatgtgggctgtggggacagactgtccccggggctccagccacagcctggagcagtcctgggatgcttttccccagcactcatgtcaacatgctcctcctctgtcacggccaaggccaggcctgtggcatctgtttgcacaaaggcttgtcagaggccaggggggcccaggcctgccgccctcctgaagtcctccaagctgcctcaggcagctgcgtactgactgtagggctacctgccgcacgactgtctggagtgtgtgctccgaatgccagtttccgggctccatctgaggcattttgccagttgccctgggactctgttttttttttttttttcaagacagagtctcactttgttgcccaggctggagtgtaatggcacggtctcggctcactgcaacttccgcctccccggttcaagcgattcttctgcctcagtctcccaagtaactgggattacaggtgtgtgccaccatgcctggctaatttttgtattcttagtagagatggggtttcaccatattagccaggctggtctcgaactcctgacctcgtgatccgcccacctcagcctcccaaagtgcagggattacgggcgtgagccactgcgcccggccgggactctgcattttcaacaaactccaggaacacactctggtggacaccaagggtcctccctgatcctacccagagtaccatgtagttgctggacagagaagaaagctgcagccaccaagtgcccctctggcctcctcccgcctctgcctttccttcctggactttccatcacctggctgtgggtacccagtgttgcagttctgggattgccaacctcccccaaaagcctatccatgtgcctgaggggagggactcacctgggcaggccgctggggcacgagaggagggaccagcctggccgtgtagaagtcctccatggcccaggccccagtcagtgcgctgccctcccacagaaagctctgcttgcgttcaggtggaggaggacactggcccgctctttcccacccttcctttaaaatcctgctggcaggaagtggtggcgtgctagacaattccacttcctcagagaggagcagggccacacggtcctctatctgtcggcctgtggtttcagagtcctggactaacaacaatgggggggataccgggggtttcttcttgcgacttttattctctagagagaaacaaaagcgacaccatcaacggtggagtcggtccactcacccgggacctgctgatggcctctcccagggtcactcttctgatcacacaaacctgcttctggtcttatcctctcagaaaaggcactttccagcctgagcgctggtacagccgcacccggctccatctccgaccgggacagagccatggccaccagcaggtcctcggacggtgcctcgtccaccttccgcctcttccgtggctccttcttgctggtgggtcctctccgtttcagacctctactgtgatcactgaagctagaaaacagccaaagagaaaagttactggggctagaggagtgcacgcttctcaggttggtcacactggtctggagagggctgggcctgagagaaaagtgacggatgtggacctgccaggcagatgcgtcccccacttccactgccttgtgtgaactcattcaattccaggccagaagttcaacatggcccaggcacaggagggtctgggttccttcacgtgctgctgtccagcaggctcatggcagatgtacggagccatctgtggtacctgcacatcctcatgtggccaagcccatccaatggagtcaacaatcgatggctctgagcaggctccctggactcccaccaccttcacccatcaatacttccgatgctccttacacggtcctggccacaccggcagaaaaggatcccttccctcctgcaagggctccacggcagtgcctctgtccatggccagaaggaagggcttcccagcttaggctgccgatggtcaacattataccagccgccccgggactctgcactttcaacgggcagcagctcgtttggtttggaggaaatgaacaggagtttccggctggagagaacctaggctgcctgggtgactcccaataagctgggcaagaaggaggagggcagaggtgacaaaggaacttagcacaaaccgggcccaccttccctgcaatgcagtcatgcctctggcttttgcaaaagctcatgctctccagggtgccagggatggctcaagttcaccttcccaggaacgtggataatcacagcctcccagagggaaaggagctgcctgggcagcctgggaccctgcttctgtgaagggaacacagactgtgttccctcctcactccccagcaggccaggtttgggctgtggggaaagaatatgaggcactctggccggggcatgcgttctgatgaccacaggcttggcctttggggagggaggggttcaaagaccccatgagggcatccagctcctgtagttttctactctgacaaccttctaaacggatccacatacatctagtttcagtacttggaggtattctaaaggcagacatactttatctgagcaggtgcttttggcgtggtcctgccaagaaagaaacaatggcttagatgacgtctattctaaggcctcaaggcttgcacccctgccatgctaaatacagatgcgctcctccaccaagagaatcccctctgccctctgccatctcagccccgagccagctcagctgcccatgacctgtgtgcaaagcagggggcgggacaaacagctatcgcctttggccttccctttgctcctgacagcggtctcaaacctggaggagtcaaaggtccaagatgcctttgttcactatgaacctggtgtcagctctagcgtcctcagcagcagggcagcgtggagcagggccagccctctggcacttgtgtggctgtggtttgcatgctgaggacttgtttcctggctgtgagcaaggcaactcattttaacttttaagcattaattcatgcaagatttttaaaaaatagggtcctacacttctgttgcaccaactttgttgttgtttttgtttgttttatgaagacaggttcttgccctgtcgcccaggctggagtgcagtggtgcaatcacagctcattgcaaccttggcctcccaggctcaagtgatccttccgcctcagcctcccacgtagctgggactacaggtgtgcagcaccacagccagctaattttttaattttttgtagtgatgggtcttgctatgtagtccaggctggccttgaactcctgggctcaagtgatccttccgccctggcctcccaaagtattgagattacaggtgtaagctaccgtgcctggccaatcaccaaatctgtgaactgtgctgagtaatcttatgttaacagtgtgaaaactggactgtgctgaggtggaaaccatgctgtccaacaacgaaatggatggagtaaagtgactaccaaattcttagatgtggtaaagcagtagtccccaacctttttggtaccaggaactggtttcatggaagacaatttttccatgggacaggagtaggggaatggtttcagcatcaaagcattccacctcagatcatcaggctttagattttcataaggagagctcaacctagattccatgcatgtgcggctcacaacagggtttgtgttcctgtgagtctaatgccaccactgatctgacaggaggcggagctcaggcagtaaagcttgcctgcccgctgctcacctcctgctgtgtggccaggttcctaacaggccacagaccggtactggtccgaggctggggggttggggacccctgcactagagggtaccgactgtgggatcatgggattggaaactcaggaaggaccttgaggaaaacagtgcgaagatcatttctgcacccccctaaaggggcaggtccagagccttccagaatgcagattctgtcccctcctcactcccttctagactgtgcccgatttccgccctaagtgtttcatttccagaatcaaagagggctctttttccctccaacactataaaaagctttttttttttttttttttttttttttttggagacaggatctcactctgtccaggctggagtgcagtggtacgatcttggctcactgcaacctctaccttctgggttcaagtgattctcctgcctcagcctcccaagtagctgggactacaggcatgtgccaccatgctaatttttgtatttttagtagagacgagattgtaccatgtcggccaggctggtatcgaactcctgatctaaggtgatctgcccaccttggcctcccaaagtgctgcgattacaggtgtgaactactgcgtccagcccataaaaagcttttttaaatagaaaaagccctgagtgcacacagcattatttggcttggttttcttccttttcgtcgacttacctgaacatgggtgggctgctgctaccctcaggctgtgctgtctgcagccgcacagcctgaagcaggagctgggggccaacctccatcttcacagcacactgcttcaagtgactggttctgctctttaaggtaagaaacggtttcccacaaatcgggcactcagggatctgaggcacagaaggtcttagtgtcttttcagcttcatccaagcacctgaaggaaaacagtcaatacaggagaaccaccctccccaggaatgtggattggagcaaatgtgggtccaggtcaacacagacgtgctgtggtcaaagcaagttccccaaagccaatcccctctacacagcctggctccgtctcccggcagtcagcccctagacactacacttaggtatctgtcagcaaagttggctaaagaaagcaaggaaagattaaatgcagttacatgatgacttagaaattccactcctaagtagagaccccaaagaactgaaagcaggtacccaaacaaatacatgaaacccatgttcacggcagctctatccacaatcccaaagggtagaaatgctccaaatgtccgccaatggacgaaaggataaaccatggtcatattcctcatctaagaatgggaaaaacacagtctagccatacaatgagatactgctcagccataaaaaggaatgaagcctgctccatgctacaacatggatgaacctcaaaaacaacatattaagtcaaagaaggcagacacaaaaggacaactgtgcaatttcagaatcggcaaatccatccagacagaatgttgattagtggttgtcaggggagagaggggcaatagggagtggctgccaatgggtgtggggattcttttgggggtgatgaaaataatccagaagtgattgtggtgacagttgcccaactgtgtgaatatcccaaaagtagtgatttgttcagtttaaatgggtgaactatatgttctgtgaattgtatctcaacgaagttatttttaaaaaggggtaggttgacaacaaagctgaggtgctgttgtcatggtaaggtgtggagatccgcactccagccctggggtgcttggggattctggtcacatacacgggagaggcgacggcccaagctgcccccacctgttcacatgctgttcccttcgggtcacgttcatggctgagaggttcttttgacaaatctggcagaagaacaaacccttttcctccaggctatcatcatgtgccgatgctcctacccgtgcaaactcctgctgcagggtcaaggccaccgcagcgtcgctctctggggcagggggcccaagcccatacactgtggagaagcaccaaagatccgtgagaataaactccaaagacaagctcaccctcagacctctgctctgtcagctcctgcagaccatggggagcaggtggaacgcaaagaaaccagaacccagctccactctgcaggctggtgacttggacactgtccagtgagactgggcactaatcagcactccgggaacagccgtctccaactttaacatggatatgcattacctgggaagcttgtcgacactcagattcaaattcaaggggtccaggtgcagcctgagactctccgcatttctagcagcctccaggcttggcgatgctggcagcacaggaccactctgagtagcaaggacctaaactttcccacttctgctgaagttggctacctcgggcattgcaagttcacaaggctcatattccaacaaagctagatgttctcttcaaaactcaccctttcctgctgaccttttactgcccatgataaaaccagggcagagtgaaatgcctttggcgtttaaaaggcagcatctcttacttagcatcagactcaagaatggactgattctggtcttgagatggctcccagggtggcccatctgatattgctggagcagacccctgtcactcacaagggatatgccctgaacgcctcataaatccccaagttcttcatggctgtggcctaccagtgcctgccactgaggccagcaaaacagcacaccttcattttggtgccctgttttgtttgtttgtttgtttttgagatggagtctcacactctgtcgccaggctggagtgcaacgacgcgatctcagctcactgcaacctctgcctcccgggtccaagcgattctcctgcctcagcctcctgagtagctgggattacaggtgcccaccacacctggctaatttttagtagagacagggcttcaccatgttggccagggtggtcctgaattcctgacctcaggtgatctgcccgccttggcctccccaaagtgctgggattacaggcgtgagccaccgcgtccagcctggtttggtttcttaacaaacaaatggtttatctctttctgagcacttgctgggtgtgatgtgaagatacagagagaactgagtcaaatgctgggcaggggcggagctcacaccagctgggtgcctcctctgcaactcacatgtgcgtccaggactgatgcctcggcaggacatcaaatcactgcctgctgtggaccctggggtggcctgagactcctccgtgctactgcagtgaaatctgcaatgcaatgccaagatcctgcatacttattagctgtaggtctgccgataatggtttcttcctatttcttttccttttgtatattttcatcagagatgagaatccatattgttttggggatggagaacaggagcacctggcattattacgcttattgggccggtgccacaccaagtacacagcagctatggggcactgtcgccaccctgtctcacctgcagccaatgagcctctaatctactcagagtggggcaacccaatggttagaggaaggagttaacgatcccataaagaaataaatccagaaagtgggaaatcttataatacaattagcctagcctcttcaaaaactcagtgtcatagggctgggtgtggtggttcacacctgtaatcctagcactttgggaggctgaggagggcagatcccctgagctcaggagttcaagaccagcctgggcaacatggtgaaaccccatttctagtaaaaatacaaaaaaattagccgggtgtggtggtgggtgcttgtaatcccagctactcaggaggccgaggcacgagaatagcttgaacctgggaggcagaggttgcagtgaaccgagattgtgccactgcactctagccaagcctctgtcaaaaaaaaaaaaaaaaaaagtcagtgtcatggaaaacaaaaggaaatgggggactattctagaatctagaccttaggatactgctgagctacagcaatatgcagtgtgtgaacttactgaatccttgttcagaaaaaaaagaaaccagctacaaaaaataaccttgagacaaccagggaaatttgagtttgaactggacgccaggcactattatggaattaagcgtgctaatggtattgtggttatgcagcagaatctaggggtaaaggatcctaatgtctataatttaccttcagataatatggaagaaaaatatgtacgcttggctaggcacggtggctcacgtctgtaatcccagcactttgggagactgaggtggacagatcacaaggtcaggagttccagaacagcctggccggcatggtgaaaccccaactctactaaaaatacaaaaattagctggacgtggtggtgcatgcctgtagtcccagcttcctggaagctgaggcaggagaatggcttgaacccaggaggtggagtttgcagtgagccgagattgcgccactgcaccccaacctgggagacagaccaagactccatctcaaaaaaaaaaaaaaatgtatatttataaagacataaacaaatggccaaatgttaacatttgttaaatctagattgaggtataggggattaggggattcattgtaatttttttttttttttttttgagacagggtctcactctgttgccctggagtgcaatgatgcaatcacagctcactgcagctcaacgtcctgggctcaagcaatcctcccacctcagcctcccgagtagctgggactacagttgtgcaccatcatgcccagctaattaaaaaaaaatttttttttgagtcagagtcttgctctgttgcccaggctggagtgcagtggtgcaatctcggctcactgcaagctctgtctcccaggttcacgccattctcctgcctcagcctcccgagtagctgggactacaggcacccaccaccataccttgctaattttttgtatttttcatagagatggggtttcactgtgttagccaggatggtctcaatctcctgaccttgtgatctgcgcacctcggcctcccaaagtgctggcattacaggcgtgagccaccacgcctggcccctaaaatttttttgtagagatgggggtctcactatgttgtccaggctggtctcgaacttgtgacctcaagtagtcctcctgccttggcctcccaaagttttgggattataggcatgagccatcatgcctggcttcattgtaattaaaacaacaacaacaaaaaaaccttttctgaaaggaagagttctttgtgaatactgagggttatctttttaaaaggaaaaaactgaaagggaaagctttcataataaaaagtcataatttttaaaaaaaggaggccaggcacagtggctcacgcctgtaatcccagcactttgggaggccaaggcgggtggatcacgaggtcaggagatcgagaccatcctggctaacaaggtgaaaccttgtctctactaaaaatacaaaaaattagccaggcgtggtggtgggagcctgtagtcccagctactcgggaggctgaggcaggagaatggcgtgaacctgggaggtggagcttgcagtgagctaatatcgtgccactgcactccagcctgggtgacggagcgagactccatctcaaaaaaaaaaaaaaaaaaaaaaaaggaagagggccaggtgcaatggttcacgcctgtaatcccagcactttggggagctgaggtaggcagatcacttgaggtcaggagttcgagaccagcctggccaacttggcgaaaccctgtctctactaaaaatacaaaaattggccaggtgtggtggcacacgtctgtaatcccactggctggggcaagataattgcttgaacctgggaggcggaggttgcagtgagctgagatcatgtcactgcactccagcctgggtgacagagcaaggctctgtctcagaaaaaaaaacaaaacggtaccttatcaaggaagctaggtgggaaatgatcccagagactcttcattctctggctggatccagtgaagtggcaaaggtaaaacatcaagcagagagcctatccacagaagaaactcaacaaatgctgattccttcccgcctcccttcctcagagttgtattaacttatctctgtgtggaagacagaaacacactcatcataccattccccgccatcatctcctcttgaggatcctttgggacattttcttcccgcgcagcctcgagggagcactcttctgaagcgtgtctcaaacgctcggggtctgctctcttgaactgctgcattcgctgtaggaccaattgtgctgtgcggggtttggagggacttggcactgctgttgtcaaacaggaaggaggaggctgggagtcgctgttgggcacattctctggcaaggaggaaaatattcacaaccatctgttgtagctggagaaataaaagacttttctaccagatacaggttagacgcaagtttcaagagtcctttatcaactagtttaggtttgactcacaaatgtgaagaggactggttgcttgttggtaacctctttgtttatggcaatatagacataaatatcaataacaggaggggaatgggatgtgactgctaatgagcatggggtttatttttaggatgataaaactgttctaacgttaggtagtggtggtggttggacaagtctgtgaatatactaaaaaccactgaaccatacccttttaaatggtgaattttatggaatatcaattataccccaataaagctattattaaagaaatattaatgacaaaggtttatgtcctagatcagttcttctttaacttgggatccacggatgatcttcagtggggatccatgaaccccatgaagttgtgtgccagttttgcagatacgcgcatggatacgtgttttgggggaaccatgcatagatttcatccgactggcaaagagcacgagagaccagtaaagttggtgaggcaacactgctgatgccttccagtagtctatgcgacctgagactctaccaccactctactgagaggttattaagatcaggaagtgagggcaaaggaaatttagaaacagaactcaggagctcagagagcccatggtgtattatatatgcaagggtagttttcagttttgcatgaagaatgtgtagtaagcatatagctcagtataccaagggcagcagggcaagaaaactgctttaaacagttaaaaaattatccaggcacggtggtgggtgcctgtggtcccagctactcgggaggctgaggcagggaggactgcttgaacctgggaggtcaaggctgcagtaagctatgatagcaccactgcactccagcctgggtgagagaccaagatcctgtctctaaaaactaagtaagtaaataaatcaataacaataacaaaggaaaagattaaaaggtcttcagagagagaaagaaagaacctgaagattctcctgggacttgagcccacacagagtcctcatgcggccctctcagcagcctatccaaattggctggcccagtccaacttacccactttggaataaattcaagaaaacaagagaagcagcattattgtgttgtttgtgtaactcatgtcaatcatataacagaatttcataggaaattctgaaagagcagaggactccaaacacaatcatgtgaaaaattcacacgggttatgtttttcttgactgttgtttaaaccaggagtcagccgggcgcagtggcttacgcctgtaatcccagcactctgagaggctgaggcacgaggattgcttgagtccaggagttcaagaccagcctgggcaacatagtgagacctccagctctaaatttttttttaagcttaaaaattaaaaaataaaaacaaaccaaaagttagcaaactacggtcatgtggctggctgcctgtttttgtaaataaagttttactggcatatggccatgcctgttcatttacatattgtccacgcctgctttctcactatgacagcagagttgagtagttgtgacagagtctgtgtggcctacaaagccaaaatatttacgatctggccctttccaggaagttttccagcccctggtttaaaagagtacaaattacctctggttttctctctggaaaggtttggcgatggttcttgctggttacccgtctgggtgttttgtgctgtttcccggagcacaggtggatctggagcagaggcaagcacacccccctccccattcacagagtgggccggttcacttgcttgccatttggttaccctttgctttttagtcctaggggcctggctgccagacggaggtttcttctctgcagggccttgaagggttttggtcttggtagcagtttgtttggtccttttcaatttgcttcttatctgagtgccgtttgaggcagccttttgtgtcttcctttctcctgacacttccttgattccatgttttttcaccctttggaaaaagctagcgcagagttctttaaagtcctcatcagactcatccatcatctgaccagttttaaggctttcaggctggtcttcagaggagcgagggtcaatcccaggacaggcagacagatgagaaagtgaacccaagtagaagcctagctgagcctcattcacactcagtttcattagggttcttctctacttctccattagatacttggagagtttgcacaattgaacaaaaagtactgttttcctctctataatgattgaagtatctttgttcaaattgggcctgtggttaaacatgtttaaagcttccctctgttaaagtccacaactgggccgggcgcggtggctcacacttgtaatcccagctcttttggaggacgaggcggggggtggatcacctgaggtcagaagttcgagaccagcctggccaatatggtgaaacctcgtttcaactgaaaatacaaaaaattggccaggcgtggtagcagatgcctgtaatcccagctactcgggaggcagaggcaagagaatcgcttgaacctgggaggcggagattgcagtgagccgagatcgtgccactgcactctaacctgggcaacaagagcaaaactctgtctcaaaaaataataataataaataaataaagttcacaactgaaagagtgttttgttgtccaatagatgcctctgagatcgaatacatatgaacctggtgctcagataattctccaagatctccatgatgatgaaacatatatggttcacttaattacacatctgtggaaaaccaaaagcatgtaagtgtaatcagacattgtcattttatgccagttcttccagggagggacaagggcatgtggggtgagggaaaagtcttcggagtaacaatactgtcaaatactcagtccagcctggttaacatggtctaaccgtcctatcagacatcacaacaaaaggacctagaaacctgtcaaagcatgttgttcttccacaggtattaaaatatgtgcatcttgggagagtgttttcttaactgaaatttagggagcaaaccccataaaaggcagtcaccacagaaacaggatgatccccaaatctaggaaaactatctcctacactgatctaagacccctggctgttaaagaggctctttctgtaaatactgcaacataagagacagaaagagacattatattctcatgaacactcaggagagaaaaggtcacttttacttatcttctcaacccagcaaggctctccaaacctggatgactggaatgtcgcctgtgtgcaaaggctgggcctcgtgagcatggttgtttactttggcacacagctaagtggggttcaaaaatcaaaactgaatgacccaatggcagaaagttattcctttcaaatacaataatgcaatctccactgtccaaggaatctaattaatcattttgttttccagagctgaaaatactcctacctagaatctactttgtatggctggcgcattctcttctgtgtcttccccttagagaagtgtcctctaatcctttatggaccgtctccatccccgttaatccctatcatcgcccactgttttcacaatggcatctgtcataggttatcatcatatgaaacaggtaatatctatcgaatgcttactgtgtgccaagcactgttccaattgctttccaagtcaaactcgtttaatccttacaagaagcctatatggtggaatctcttgtcatcctgtctttacggcaaggaaacacgcgcaagcagaatgaggaactggcctaaagccagttcaggaacagctttcacagtggcagggctgggatcaaacccaggaagtgtggttcgaaactatccgctcttgtgtttttattcatcggcttattatctgtcccccattaagctcaacacttcaggagggtagagatccatctattactttgcaacctctttggctgatctggtgcctgacttgaaataagtgctccacaactacttgttgaattcatgaattgcaaagagttcggtataatgggagtagagagaaaggtgtaggagaaaacgctgcggggagaggaaaggattggctcacaagggcctggaaggtcaggctaggcaaagtgaattttatcctgttggatgcggggagcggctggaacaaattccacctccacaactgtgttgatctccgcatctctgttgatatgaacctcacaacagtctatctcctcctataggtgcccagtcaagatttactgaatgacataacggatcctgcaagcctgcaggtttccagagggaaggggacttgtgcctccttgcttcgtacctaccgcagcccacggctcacagcaggcgagggatgaatgaatggatcggtaaggggcggaccctcccgcttcccccaacccggcgacctacggaaaggggctgaggggttccccgtctgggaaaagggctgccaaagactctaacggctctaaagtcagacggagaaccccgatccccggactggcccggacggagaccaccgtggggatccggatccgccaccctcctccctccaggcgggccccggcccctctccacccgagtgcggctcctgcctctccgtcggggctgcgggcctgccgaggccacggagccagcgagggagacgggcgagaaaggctcttctcccttaggaaagagagaacggcccgaaatgacaggacctccgcctcccgggtgccgactcccagccccacagcccggctcctcctacctccggcgccgccgcggcaccttcttaacggagactcgc

SEQ ID NO: 127 - DNA, 28261 bp, Homo Sapiens
taggcagattgaaatgctgactttctcactgtttcattttgtgattgaagtgcgtgcaaaacactcaatctggtagggatgatgcccgcgcggagctgacccttctcctattgtttttccaagctggagaagaagcaggcgctccctccattccagccacagatcacagacgactacggtctggacaactttgacacacagttcaccagcgagcccgtgcagctgaccccagacgatgagtgagtcccactgggtgcgggtccctggagcacccctcgggcagccccatggcaggccggcaccttgggcagctggtgacccagcctgcccttgagtcccacccgcctggtgtcatctctccagtgggcgttgggggaggattcttatgcgaacgtgactccgcttcccccaagggaatgaacacacggtcacccccctcccccctgccacctttgcccacagggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaagctcctctgatgccttttttccgtgagtggcgcctgccccacatctcagacgcaacccacacgtaggggggcagcttaggagccagcgggacacaggtgggggcgggagttgaagtacctgtggggacacaccgcaatcaagaattgtttcctaaaaaccccggtaagttcctgttgttcttcctgcagagtgtgtcccagccgctgtggtctagggtgaagtgacaccttaagcagatggcagctgggccagccagctcactggaccgatgggggaaattggatcatagagattctaaaacgtggcccaccaaagcacagtagaccaaaaaagagaaaaaactgaacactaaatctgcacaaatcatttctgaccacactaagcagtgcctgcacgatgcctcgtgcgacgcatttgatttttggaagatattcttatctgtcacacagcactgagagttagggaaaactaaaagatgtgcatgtgacggaccccagccttaaagttgaacgtgatgaccctacaaacacccagaaacacaggcactcttcccagcggcgcggacctcctgctcccgggaacacacccgcgctctccgtccacccacccctcaggtgaaggcacagctgtccagagctgaggcttcctagaggcagggctgccagctgccaggtgtcaggtgtggcagagccgtcttctgagctccctgggagagggggtcgcgccacctcatgcctctgagtgaggcctggtgcacaggtgtggaaattgccacgcagccctcttggccaggcgcagagaccccaggcctccatgactcaggggccgctccaccccattgtgcggctggtggcttggggaagagagacgtaaaaccccaagttaggaggtctgtgccgcgccttgccttgcctcaaggtcatccccagcaggtgagcgtggcccaccctacacactcaggtttctcagggtgccactccgtgcctggcgctcagcacgacatggtggattcacacccaagccccaggtgccaggacaagaatgccagcgctgggcatactgccggcccattccccccggcccgagaccctggacacccgcccccccccggccagctcaggcttctaggtggaatgtggagacgggtttcagccacactcccaaccttagctgttgagactcaactccaaagacggaaagttagaaaccccagggcagagtccaggagccgacctgggtctcacacaggtgtcccagaccagcgtggggatgcccaggtggccaggcccagcctgcggccgctgaagttacacctgccgggtgagtagggctgccgggaccccaccttgagtgggagacccccagtgtatcccagaagtggttaacaagcaaactgctttccatgagcctccttgatttgttaaatattgaaggcacttacctaaatactgccgtgttgccagtagcgtgccggttaccagtttggccgttcttgtacacaatatgtgagtaatgctgtgctcatcagaggggagacttttatattcagtaatttgttttataaattaaagtgaaggatgtattgaagtgtggtttgaaaaatcctgatatttgctaatggctccggtcacgacggtgtcttttggaagtggttctcgaaaactctggtgacttgggggctgcacagtgggcctgcgtgggcgtggtgcggggcaactgcccatggagcccgtggctggccggctctcctgtggatgacactcacccttgactgccagggtcattcaaagtcttgcacatccatgaaagactttaatggaaatgttcacattattattttcattaaaagcaggtgtttccaagaagcaaaggtttctgaagccattttctttttttttttctttttcttttttttttcttttttttgagacagagtattactctgtagcccaggctggagtgcagtggcgagatctcggctcactgcaacctccacctcccgggtttaagcgattctcctgcctcagcctccccagtagctgggattacaggcacctgccccacgcccggctaatttttgtatttttagtagagacggggtttcaccatgtttgccaggctggtcttgaactcctgacctcaggtgatccacctgcctcagcctcccaaagttctgggattacaggcgtgagctaccgcgcccggcctgaagccattttcttaagtaggcatatatcagggcagttttaggctcccagcaaaatgagcagaaggtgcagccaagtccccatgcccctgccctgcccgtcctgccctgcccagcctcccccaccacaggacacgctgctcacagctgctgggcctgcccttgtcgtcgccccacgcccagagttcccgcccagctcgcccagggcaccgtcagtcccgtgggtgtggacaggcacgtgacagtgtggattcaccactgtggggccatgcagaggagcccatgccccggagacctcctgtgctccgcctgtgccttcctagcccctgcactctcttgatgtttttggtcctcacggtgttgccttttccagaaccccctagggttggaatcacagtgtgtagcattttctttcccttagtgatctgcatttatggctccgtgttttttgcggcctatctgaggccatgattgaaaggaaaatacagacgtctgggtgttcacaccacgtctgcccccagatctgttccctcagccaccacaaacgggggtcagagctgagcccgcaaagcccggctctccagaacctgggggctgaacagcagtggacaggaagctccctgaagacgctgctttctgtgctccactcacactgtgagcccaggcagacggtggctgacggatctgggtgaaccagatgcccactgctgctgtccttccccagaaactccggatttcaggagaagctgcctcaaaacccctggcgaatgatgaggccctggagcccccggagagtctcagctcccgcagccctaacaaacgaccacagacctggggcttcaaccagactctctcggctccagaggacggccctcttctggcctgtgtcccccacggtagaaggagcaagggaactccccagggtctccattatggggcactaatcccatcgagaggcgccgccccgacctcctgtcctggcagagttcttgccttgtggtgaggatttcaacctagggattggggagttacaggcccgcagcacacggtggcaggagcctttccttttcataactagctgcagctgcaagttcattttggggaattaaaacaccaccgatggtggagcgcggtggctcacgcctgtaatcccagcacttcgggaggccgaggcgggcggatcacgaggtcaggagatcaagaccatcctggctaacacggtgaaaccccgtttctactgaaaacacaaaaaattagccgggcgtggtggcgggcgcctgtagtcccagctactcgggaggctgaggcaggagaatggcgtgaacccgggaggcggagcttgcagtgagccgaaatcgcgccactgcactccagcctgggcgacagagcgagactccgtctcaaaaaagaaaaaaaaaaaaaaaaacaaaaagaacgccaccagaggctggggctgctggctcacgcctgtaatcccagcacttcaggaagccaaggcgggaggatcgcttgggcctaggagttcgagaccagcctgggcaacatggcaagacccctccatctgtacaaaaaatactaaaagtcgctgggtgtggtgacgcgcgcctgtagtcccagctattcaggaggctgaggtgggaggatcatcaagcccaggagtctgaggctgcaatgagccgtgattgcaccactgcactccagcctgggcgacagagcgagaccctgtctcaaaaaaaaaaaaacaaaaaaaaaaccgtgactgcacatgagctaaccacgcctgtccacaaagttaggaaaacgagctaccctcagcccgtccgctgtccacagtgggggcgccaggggaaaggggtcagcttccccgcctggggctgtgtctggttctgattgcactgcagtgaatctgccctaaaccaaacgtcagaaagaaaagcggcagacgtttcatcacaacacagagacagacaggagcccgccctgctttaatgcgcatgcgggggagccgagaggcggggctgctggcgggggagccgagaggcggggctgctggcgggggagagcgtgtccgggcgccgcactctgcgcagggctcttggatggcgctcaccacgtcacgtcttctgtgctttcggccaagcactgggccaggtggctgtcaacatccagctgggtcagcctgcaagggaggggccacactcactcggccacctccgcggcatgctggccgcagagagcaccgtctggacctccgggccctctctgctcctgccgctggagaggatccggctggtcagaaacaagggacggggccaccccaggggctcatgcacccggcagaccacggtaaccgccagtggtgtttccacaccgtgcccgtgaggaggccacgccaggcccctgcgtccgagctgggggtggggaagctgtgtctcaacaagcctctctatgggattctggcgcctgctcagcttgagaacgcgctcatcgtggagcccggcagacaggcggcctgacccggagaaaaggcaggacggcgggtggcctgccagggagagccgccgcggctgcgtctacaggaggcagaagagtaaacatggctgggcagtggatgtgcagctcacgtcagagaattggtgtttctggcgaggagggaccaagcctcaccacggagaaggacgccgtcaccggcgtgcaggctgccaacctgccactctgggaggccccacgcggcccctgcacctctcaggagggcgctggcgctgggatggtggccggccaggcaggggtggcaggagaaaacccatccgagtcctgcaggtcagcgccctgggcatccagtggggccgggaggggtgtctgagcgcagccaccttctatccccggcctcatgtggccccatcagcccaactggagcggctggaaatgaccatcaccaggcctggccaaggtgtggccctggaagccaggacagttgacttccggccatgactcccggagagtgccggagctggcgtgctcagcagagctgccggggacgatgtcccggggctgagtgggcggcttcagcctagacttgggcctagatcttgctggaggccaagtggtcagtgtcccatcagagtgaccatccctcacacgccactgctgggggacacacccccactgagcggccaagtccacaggacacgtgtccctgtgtccacctgtcagccacaccgcccctcgctcccctacagcctctgccctcagaccagtccacggcgcgccgttttacccttgggctttgctgtgtcccttcctttggctcctgtgccccgtctgtgtggccactgcaaccctcaagtccccctctccagaccatagctggacccccactcccggggctggctccagcagccatcagctgccttctcactctggcagagcccacccagtgccttctgaagcccccgagggtcactcagtctgagactttccggcttctgcccatcctgggaaccagcccctccctccagaagctttctctaaggttgccagaaggtgctaagatctgaaccgaggtcatcttgtcccggggtttccaggcagcgtcccttgtttgggggccctctgagatgccttcagacccccgcctgtggcggaagagctttgtcctggcctgatctgccctgtccgtgacgcttctgctcagtagctgagcacgccctgtggtgtggacaggccagcccggctgcaggacagtgggggctcagtccagaagcctctggtggcttctgcgtgtgggcaggggagcagggctgcagggtgggctggcacctggcagcgtgaggggcctcagggctgttaaaatcccaacgaccggccgggcgcggtggctcacgcctgtaatcccagcactttgggaggccgagacgggcggatcacctgagatcagttcaagaccagcctgaccaacatggtgaaaccctgtctctactaaaaatacaaaaattagccaggtgtggtgacgcctgtaatcccagctactcaggagactgaggcaggagaatcgcttgaacccgggaggcagatgttgcagtgagccgagatcatgccactgcactccagcctgggcgacagagcgagacaccgtctcaaaaaaaaaaaaaaatcccagtgaccaacccagggcctcgccacatcaacagagacaaaacgcagctctggctctcaacatcctcacccctcaccaggtgcccagcttcccatccacccacgtgacccgcaggtgtctgaaaatgcacaaaatgtccaaataggaccacaagaagatcttaaagacacaaagaacattctacatagtttgtcaaatccagcatttgacggtcctctgggtgacccggagaacaccaaggctgtgagaaatgggaggcctcctggcagctccactccccagacccgcctctgccagggctccaggctcagcaggcgcctgtgcgggacagggcgacggttcaagaccaagtccggctgttagaccagaccctccaatccaggcggcctccctgctggggtcctgtgcggtcaggagtcccagggcatcccagggtggctgtgcaaacccttgttcccaaagatatggggcttgtcccccagctagcctgcccatgcggtggccacagcctcgggtgagttccggttccaaagtaccggctctcccttacgatcaagtgttcgaatgtgcttgaagcattccagacacaccaaggcctggacctgacttcattgacgcctacttaggaaaaattgaggcagtctgccaagctttcagcaactgcttaaaaagctcaaaatggcaagtttttcctcgtgaacgtccttgtcttcagaagtctttttttagactatctggaaaagcaggcgatgcaaagacaaaagcccctccccggggggcggggggcagcaccctgacagcaacaaggatctcagagcttcagccaagagcatggatttctccccagggctcccaacagtaccctctgtccgtgattcagggtcttactctgtcacccaggctggagtgcagtggtgcaatcatacttcactacagcctccaattcctggctcaagggaatcctcccacttcagcctccagagtagctaggaccacaggcacgcgccaccacgcccaggcatgtaaagatgggatcttgccatgttgcccaggctggtctcaaactcctgggctccagcaacccacctgcctcagcctctcaaagggctgggattacaggcgtgagccaccgtgcccggccttttcttttgttgttgttgttgttggctgccaactttggactccggtgccttcgcattcccgagctgtttttgcttctggaagaccaggggcatcaggcatgactgaaggacctggtctccataagctctgaaacctgccgcccattaactcaaccaaaagttacgaaccagcatcattcacaccaccccagccccaggacctgctccggaggccaagggcccagaggtcgccagacacaaggccaggcactgggcagtttgggttatcttgttagcaaaactgggttccattcccctttacttaaaaaatacataaaaatatacgttgggtttcaaaaataagaaaaagcatctccagacaaaaaagacgatcttcatttttaaaacccatgacgcactctcgggaaggtgttcctgtgctctgggcctggggacgctggtgccaccagattccaggatggccaggtggacccggggccagtgctcccagccttccttctgtgctgttctgtgggcccccagcctgccctgcccacagagcacggcaagcaggtggaccccagacccgtgacagagagccacctggacatgccaggccacagcactgggccacctttccagtgtgaaacagggctttaaaagccagcgctgagctcggccacctcttgaccttctgaacggctgtggtttccaaacacggatggataaccgggccgggcgcaggggtggcctactcacctgggggcgaactccttctggcacatggggcagctgcgcagggccgcggcaccctccacagacggctgctgctccaccctgggggccctgcagggatcaggtgccgggcgctggggcagggacctggcgggggattccaggtgccctcctgccccgtgaagcagccggtaggaacggcccgggccccacaggtccggcggaaagggtgtccaggaaaaggtcttgggtccgacagtgaagacttcagtgggctccgggccgcacctgggctcctgcaacacagagttgttgggccttgcccagcgatggctcccgccctggaaaccccttcatcgctaagatgggcccagtgggcacacctgtcctgggaaggcgggcagtgaaggcacctcgtgatccaggatcagctccgggctcaccgtgcgcagtagctcggcccagagccgctcccgctcatcaccccccaggagaaaccaggggcggccgccagaaggcctggggcagacagagagggcagacagggggtactcagtagcggaaacgctatggtggggagacccgggagggcctggggcagagagagcggggagatggggggtactagagggaaattcgatggtgcgggaggtggccggcagggttgggggaagggctgctggggcagacagtgcggagatgaggggtactgggggtgggggagcggggtgggtgggtggaaatatggggtcctcagcgggatgaggcgatggttggggagattgcggagggcctggggaaggtagagggttagatggggggtgctcaggggagacgcgatgatgggagaggcgcgggagggcctggggcggcgcgggggaagctcggcgtggggtgggggctcaaggcgggcgctgaatggcggcgcggggtggggcgacgggcgtgggggccgggcccgggggcagggagccctccccagggggagaatagagcgggaggcccgcgggggcgccgggaagcacgtgggagcgggaaaaccggccgcgcccccgcccggctcccggcctcacccgcccgccgggcgcggcctccggcggctcaaccccagccgcggcctccgcgccgcctccatccaagcccgcgccgggcggaagtgagcgcaagccccgcccccgcccctccaggccccgcccccgccccggccccgcctccagacctctgcagcgaggccgcccccctccgagacagtcggaaccccaggggccctgatcccagcctgtagggaaactgaggccagggttccttcgtcctgcaccgcacaggggggcctggcgtgagggtggggggcccaggtgggggagccccgcccgtgtcccctttcccgtccgggcagcccccgggccggagccccctccgttaccccgatggctgcccggcccgccccggcactgcctcctcccggctgcacccaacagctcccgcccccgtttccggctctgcggagccgcctctcctcccaggaccattccaggagtaaataaagcttgaaatccgccgtcgccaccaccgtttctttacaaaaggcggggaactcaagctccttaaccaagaaaccagaggcgaagtgacaaagtccaggtggctcacttgggcctcaggggcctgggccagggccctgggggcagctgaggggctttcctgcctggaccccgggctctgcgacctcaaagtcggccacgtggtggcagcagccgcccaggcaccctggtgccacacttggctgtgcccagtgccccatgggcccaggccacttgcctctcccttggccctgctgggccctggagtggctgccaccctcacggaaggagtggggtctacagagatcagggtcaggggccctcgccagacgccactcagggctctgggactccttggcagtttctgccctgcccagccccagcagctttggggctatgctgggcacccctcctgcagggctccctggctgttcctacccctcacctggcccctcccagcccccagtcgtctgtgccctccctccagaactcagctgtggagcccggccctgaacccaggccacccgagtggcccaccgtccttcaaggggccccagcctggaggccataggttggtgttcagggaaagggtcagcagcagggcctggactgggaggtccccctctccctgcatgagtggttttcttccgcacaccttcctgctctagatgctggaggcccccagcagaacaagatggaggcaccaacccccaggcccttcgacttgagtgagcagatggagatgcagcgctgagtgctgcccgggcagggggagggggcctgggggagctgctgcaggccgtgtggtctcagggggccctgtgggaggtagcctgtggctgggcctgctctcaggcgagagaagcccagccgtggggtctctgcagccccacgtccaccacatggcaggtgccagctgaccaagcgctctcagacagccagtgtccagggctccccgacagtcctggctgccctggcttcagctccgagcttctgggtctttcctggaaatgtcaccatggtctgcaggagggccttgggtacttccaggaagactggtcccagcctcccaagacaggagaaaaggccaggcccagcagcccatgcctgcaattctaggacttggggaggtccaggcaggcagattgcttgagcccaggagtttgagaccagcctgggcaacatggcaagaccttgtctctataaataaaaaattagctgggcatggtggcatgtgcctgtggtcccacctacttgggtggctaaggtgggaggatcacctgagcccaggtaggtgggggctgcagtgaggcaagatcgtgccactgcactccagaccccaactcaaaaaaaaaaaaaaataggccaggtgtggtggctcaagcctgcaatcccagcactttgggaggccaagtcgggaggatcacttgaggccaggagtttgagaccagcctggccaacatgcagaaaccccatctctactaaaaatacaaaaattagccgggcatggtggtgcacacctttaatcccaactacttgggtggctgaggcacgaaaaccacctgagcctaggaggcataggttgtggtgagccaagatcgcaccactgcacaacagcttgggcatcacagcaagactctgtctcgaaaaacaaaaaaagacagaggagaaaagcccttggtgacaagtgtttgctcagctctctgtgccgtgctgggggtggtggggggtgttcttgctccttcctctcccttccccactctggctcccaaccccagggttctgctgttggacccgggggtggctcctgcctcctcctcctctatggcccccacatggtccagtgccctcctgccatgggaccggccggcctctggatgggctccgagccccctgggacccatctccttccctgcctgggtcccttgggcagagcctgggaaactcaggcccctgccctgtcctggaggaccatgtgagggacacctgtgtgtggctgctgccccagaacaggggcctttctgggcgggaggacccagcccccacccctggaaagccaaacactagagctttgctggggtcttcagcatccttccagcccctcccggctcccccatgcaggtgccctggccactgggcccaagaggggcagagccgagcagaagcagggcggggtctcaagtgacccagacccgggacacctgcgctgcccggctggcgcaggctgcttgggaagctctcgctgcgggtgccccaagggtaggaggcacgggcctgcaggggacctcagggctggctgagcctggctccagcccgcatcactgaagctggggggcccccatccccttgagtcttagccaccccagtgggcctcatttacccttggccaccagggaagaggagccagggccccaggccagtgccatggggcagaaggcagggcctctgggcctggtgctttggggacgcagaggcagcacaacgtgtcacagttgtcctcctgggggctcttcccctccagtttatctgctgctctggattaatctcccctcctcccatgtcaccactggggagggggcagtggggcaggcccctgtgacctacagccagagataagtccacagagaaaggcactggggtgacctctgctctgggcacgtggcgggtgcctccacttgtcaggaagcctgacccccaatcccctcccgcctgacagcttcccgacagctgcctgccagccgagggcctggaaggggaccggccactcaagactctcaagacaaggaagcatgttcacctccaacaaacataccttgtcctgcctgtcctcaagttatcagcatgacacagcggtgctggtgatggtgatggtggaggtttcaaagttgaacctgatgaaaacgctccacttcttcggagccatctgctgctgtggtgacggagttttgctttattggaaaataatttctggttgggactgacacgtgcacagtggaaatgagttttttctaagccaaaattcatgtttacaaaagaacgtttcagctgtgggagtttgcatcccaggcagagcagaaggtgatcgagtgggtgggggcatcagagccacccatctcctactcccgcacctgcagaccggtgggctaggaggccccttaccctctgtggcaaaaaaggacacatttatggatgatgaatcaggccccagcccactgagctggtttcagaagccaggctggccgtaggtcagggagccaggcctctccaactccttccaccgcggaagaacaagtgtcccagccactggcatcctcagagtcacccaaatgttcatctctgcccagcgctgacaccctgcaaatcaggctaagacagcggtgacgggccctgaggctggcaggcctaagcagcccggtggccgtgcaccctcccaatttccaaatgagacctgtggccgacaggcaccctgggcacatgctgaaggcactgggctgcctccaccccttcccatgtggctaaatggcccagcacccacacacggtgccctggcagtgctcacctgctggcaaggacagccaaaaggcccgggcagccttctgacgcagccaggaactgggctgtgctccaccacacctgctggcccgtggatgccaggcaggcacgcccacccatagccagatgtggtggcatttatgggatacgggagtgccaggcagacaggctgtgagagacagttgcctgggaaacatcgccagatctttggggcagcagagcaggtgctcgggcccacacatggggtgcaagagtaggggtgtgccttggtgcccttgggcaccgacagcctcctcacagcctcagtggcggggtcatggcacaggcctgcccctgaccccaagaaccagaaagccaggagcagctggggagggccctggcccgggagagacagcggtcctgtttctgaaccccatcccagccatggcctgtgtctgggccagcatccccgaccagacagggccagccgccctctctcaaagtccccagcaccccttcaagcagtatccggttcacaccctcccacagcctgtcctccatccccacgtgtcgggctcagcttccgcaccactcagcccccacccaggggcgggcttttatcagccccagatcctgctctgacgtccccccgcccggagaagcttccccagcccagcccagcccagcccagcccaggcttctctctccaccccactgccctgctgggaaattgtgagctcagatgctgattggtctacccaggagggcggtcctgtgtgctctgttccctgggaagcctctcagagtgcgcggcaccaaggagccggtcagggagtggagacctctcagggcacccctcctctggggaaggcaagtcacagaaaccaagctggaggagcactgtgggttgagcagcgtctccgaagactcatgtccaccagtacctgagaaagtggcctcgctcggaagcaaggtctgtgccgatataatcaaaccaggatgaggcgatactgggttagggttggccctgaatgcagtgtgagcagtgttcttgtaagaaaaggaaaattgtccgggtgcagtgtctcacgcctgcaatcccagcactttgggaggccgaggcgggcagatcacttgaggtcaggagttctagaccagcctggccaacatagtgaaaccccgtctctactaaaaaacacaaaaattagctgggtgtggtggtgggcgcctgtagtctcagctactcgggaggctgaggcaggagaatcgcttgaacccagaaggcagaggttgcagtgagccaagattgtgccattttactccagcctgggcaacagagcaagactccgtctcaaaaaaaaaagagagagagaaagaaaaggaaaattggccaggtgctgtggctcatgcctgtaatttcagcactttgggaggccgaggcaggtggatcatgtgaggtcaggagttcgagaccagcctgaaagacatcgtgaaaccccatctctactaaagatacaaaattagctgggtgtggtggtgggcacctgtaatcccagctacttaggaggctgaggcaggagaatcgcttgaacccaggaggcggaggttgcgataggccgagatcgtgctgttgcactccagcctgggcgacaagagcaaaactctatctcaaaaaaaaaaaaaaaaaggtaaggaaaatttggacacagagacacaggaaggaggctttggggttgggggtggagcagctgcacgccagggaatgccgggggcccggggctggaaggggcaggcagcagccacccagagcctttaggcggagctccaccctcccaaccactgattttggacaccagctgcctgaactgtgagaatatacatgtcactcgttttaggctcccagtgtgtggtcattttttcacagcagccccaggagacacgcagcaggctcccggctttccaagccgccacgcaccaagttcagcttgaaaacgctgagcccagctgggtgcggggagccctcggtctcctgtccaccacacccggagctgaggaagaggctcccccatgggccaagagctggaagggggcccttggaggatcccccaaggtcctccaagtgggccaggaaacctctgcaggtggagagggtggctgggaccccctcgggagtccccagggaaggtctggcttctcggctctgtagaatcagctttgtccccagttcagcacgtttttatgggaaatctgctggctggggacagcccttgatgtcctgagatgagatgctgcctggtccctgcaccttccaggacccagctcacctgtggcgcacaggtttccacttgtcataggaaactgtgcttggtgcatcccctgtgcagccggctgtgaactgtgggctccaaccctgcttggtttgcttcaactttctgagtgacgtgcagaccttcacagaggagccgtggggtggctccatccaacgcctccctcgctgcccctgtgttggaaaataaggacagtgggtggcctgggccctgcgcatcctccagagggtcagggacacgcacggtgagcgacctctgtaggctcgaaggcacagcctggaaggactgggacacccgtgggcagggagcaagaaggcaccgccgggggcttaggtcttctttgttcatctggtagaattgctgacttttagagaaagggacctgaggctgggcacggtggctcacacctgtcaaatctcagcactttggaaggccaaggcgggtgtatcacctgaggccagaagttcaagaccagcctgaccaatatggtaaaaccccatctctactaaaaatacaaaatttagccgggcgtggtgccgtgcgcccatagtcccagttatgtgggaggctgagacaggagaattgcttgaacctgggaggcggaggttgcagtgagccaagattgtgccactgcactccagcctgggtgacagagcaaaactccaactcaaaaaaaacaaaaagtctgggcgcggtggctcatgcctgtaataccagcactttgggaggccaaggcaggcggatcacgaagtcaggagcttgagaccatcttggctaacacggtgaaaccctgtttctactaaaaatacaaaaaattagctgggcgtgctggtgggcacctgtagtcccagctacttgggaggctgaggcaggagaaaggcgtgaacccgggaggcggagcttgcagtgagccgagatagtgccactgccctccagcctgggcgacagagcgagactctgtctcaaaaaaaaaaaaaaaagaagaagaagaagaaaaagaaaaagtggcctgaaagttatggcccaaaaatgggcctgattttctgtttctcttttcccctgggtgctccctcagggactgtttggagaaccaggctccaggaggcccctgtgcagactccgggctgtcctgcaaaccccagcaccgtgtggccttggcccagggctgctctcccctaccaggtacccgaggaggaggtggcctctgttccttccagctatgccctccatatgtgccaccggaccccatcaccacgagccccagctaagtgacagccaacaaccctacttctgtttttgttttagagacagggtcttgcactgttgcccaggctggagtgcagtggcgaaatctcgattcactgcaacctccacctcctcggttcaagcaatcctcaacacctctttatttttattttatttatttattgagacagagtctccctctgttacccaagctggagtctagtggcatgatctcggctcactgcaactgatgcttccctggctcaagaaatcctcccacttcagcctcccaagtagctgggactacaggcacaagccaccacacctggttaattttttgttttgttttgttttgtagagacgggatgggattttgccatgttgcccaggctggtcttgaactcctgagctcaagcgatcctcttccctcggcctcccaaagtgctaggattacaagcatgagccactgcaccaggccctggctaattttattttttgtaaagatagggtctcataatattgtccaggctggtctcgtcaaactcctggcctcaagcaatcctcctgccttggcctcccaaagtgccatatacccccacttctgggtgagcaatttccgactttgtggtgtgagggatgatgtctgacatgaagctccatcctcctccctggggtccatcctgcagtgggagccgtcctcccagccagctggtgactggacaacagtgctgtccatccgagtgggacactggctgagactctcctcaccctcccatcccccttctgcttttctccctgcccatggcctggcaaccttccccggggccagagggcagcccagggtcccgaggccccaggaagctatctggccgctggaagtagtggcctgatgcccagcagaatctcagaacaggcccttcgcctgcagcccaggtggggccaaggcacagctaggatcccgacaggccagagagtggccgctgagacaagccccgccctcccttctgccgccttcttccccccaggcttctccatagtggggcaggctctctggacacccctccgcagtcagggcccacccatggctgccctgcccaggcctgggcacagctgcactgactgttcctggcagcctcaccggtgcaggccaccctgctgctccagctcagtccagcacaggtgttctcgctctggggttggcctggcgctgacctgtgcacctgacagggaaggtaggcagctctggagctggctggtgcccctcacctggggtggagctggggcaggtcccacatttctcagaaggactccaggatgcagctgcgtctggggcctgagcggagggaagatatcaggctggggccggctgctgggcctgtcctctctgagttgcctcaaatcccctgttccttgagcggtcctggagcctggcctcaggcctcagggcaccacactacttgcctccagggaccagcctgttcaccccacacccagccctgtgacagaggtgctgtcgcgtggccccacttacagatgggtcaactgaggcccggggcatctgtccacttgtcatgacagtgagcggccaagctggatgtgaacccaggtttttgtatgctgccgcccggtggggttggggaggacttagtggcacccactgacctcccactggggatcggggtcagggagtgaagtaagtgcctggctctccgagcaccctggggcagcccctccagcctgggagagccagctcacatctgggcagttggtgaggccagctcctgccatctcgggtccccatgcgcttctcagatgtgaaagccccttgctggcctccacagaccctcacagacggcctcacaggccaacacccagcggctgcactgcccatggtcactatctctgcagcccgcgtgtgcggccagtgtccctccggtgaccccaggcccaggtgcccggctgttggtcctgccagcatcgtgagccgtggtctgccgtcctggcacatcctgaatggaggtgcacgcatagaggctgcctgtgaatctcctgcgcttcctcagagggatttgcccccttctgggacgtgccctggggacggtcagttctcccaaatagtgacttcctttctccacataatgagagcctttggctgagggattgggaggaccaggaaaaagccgccaggccacgtggggcgtgacttggcgatcccggtggctccgggcgtcagcttggacctcagacgcccctcacagctcacagccctgtggcctgctctgagggccccgcccgccgccgagcccccgggagccggagaacccgcaggacgtcagccgggtggattccctcccactgcccctgaccccactgcccagcgccttcaggactagcggatgatggacttgtgctaaactggctacgacccctccggagcagggtcctgggtaaatcagcagtgagctgcaggctcagccagccgccgcctttggtttcctcccgccgccggctcaccccacctcagacccgagctagctctccagcctggttcctctgccggaccctcctcccgggcacctcccacgccccgccctcaagccccgcccctcaagcccccctccctcccttcgggccccccataccccgcccctcaagccccgccccgccccccgggcgccacgcgccccgcccctcaagccccgcccctccctccgggctccccacgccccgcccctcccacgaggctccctcacgccccgtccccaagccccgcccttcccccgggctcccccacgccccgcccctcaagccccgccccccaggcgccccacgccccacccctcaatccccgcccctcccccgggctccccccacgccccgcccctctttccggccccctacgccccgcccccgctcctccttctggcccttcccttgccccgcccctcccagtgccaccgtccttccaggcagcgcccacaccccgcccctcatgggcaccacccacacaagcaagccccgccccgcagggtcccgcccacgttccgccccaccccgccccagctgtgtcctcggcgcccagcctggggcagccgtccccgtgagccccgcgaggggagcctgtcccagccacctcgccgcttcaatttcctccaggtccacaggcccagcccggcgcgcgccgctcgttctgcgacctccagggcgagcgcgcttccggggcggccgtgcaagaggcgtgggaagcgcgcggggggttctgagcgtgcagtcgccgcctgcggacggcgaaggggcgggtgaaacgagtttccagcgtcgagcctgcttcgtttcaaggtggacgccacatgcaagccacgagcgcgtcgccgcacggtgtacgcccacggtccgggccgggcgttctgcgggtgcccccgctgcgccgcaggcctcagtggcgcgcccggggactggaaggctgagccgccctcctcccatgtgcgcgggagtccctccgccactgtgcccagatcgccggcgaagcgcagggggaggctgggaagggcatcgggagacacgggcctgcgccccctacccgggccccggcccacctgtccgcacacctgtccgaagccttaaaaggtcttcattccttttcggtctgatctgagagccgagctctcggcagggatggggacccagggctcggcctgcaggtgccgtgccaattagggcccaggcaggagaggggcgtccctgcactggggctccatcattacgttcgcatggccactctagcatgggaggggggcagggcctttccctgttagttcacttccctgttggtactcacccacctgtctgtggaaaggcagcaatggtcgatttcccccttaagaaacaaagcgtgaaggaggaagagaggctacaggaatctgccatccgggagaccctgtctctaacgggccatacggggtccccctgtgtctcctgcagccctgcacagccccggtctgaggtaccttttggagggagtggcccagctctcccggcctttgccacccggcgtcctgtcccagtttatctgtgtccagtccgattgatgggctcatggattggaaagctgtgacagacgccctgggctgggaggtataaaacgaaactgtttaactccagtgaaaaaacagttgcagggatcccagaagtgggaaaaggtcgctctgagcacctaccgtggggtgggtgtgattctgagactaaggctctgggggccgggcgtggtggctcacgcctgtaatcccagcactttgggaggccgaggcgggcggatcacgaggtcaggagatcgagaccatcctggctaacacggtgaaaccctgtctctactaaaaatacaaaaaattagctaggcgtggtggcaggtgcctgtagtcctagctactcgggaggttgaggcaggagaatggtgtgaaccagggaggtggagcttgcagtgagctgagatggcgccactgcactccagcctgggcaacggagcgagactgtctcaaaaaaaaaaaaaaaaaaggctctgggacccctggcccacgagccccaggccacggcctcctgcctgggaggtgtggctccccatgcagccagcttcttccctgcctcagatcggtgacctgcactctgtccaggaggaggggagacttgcccagggacaaacccgaaaacacggcaaggtcaggggaggagggcactgtttcctgtcgaagtccacatttgtgaaaaaacattgattgggcagagagaggtgttgtattctggaatggaggtgagtggggggccagtgagggctgggccggtgaggggtggatgtgatgttttgcctggcccaagggagctggtgccccaggttcccagtctgctggcagagctgggtcctggtgggggcagagctgggcaggcccacatggcctgtgcatccagggtgtcttgtccccttaatccttcagaggatgaacccccacccttcgccggccttcttgggcgtggtctggtagataactggagctgggagaggctgaagacagtcaaagctgctctcctcttttctaggtgagaacagtgagcccgcaaggtcagggagctgcccccaggtcatctgggctgtcggagatggaggcgggagaggagccgtgtgctcctgatccctggcccaacgctctccttccccgtcgcccactcggcatcggccctacccggggcccggactcccactcacgcactggaaactccctgtcttggggccgcgcacaccatgcctggcaggagctggagatgcagcagagcagacgcggctgcaggagcagccgtgtttcctacagtggagaaggggaccctggcaggagcactgcccagccaggcacgtggtgctcaaccctgtgggcactgaccccacaaaaggccggggtttgtgctgcaggaggcctctgtttggggagagctctgtcccggctccagtgcggcggccctcccccagcctgctggaatgggacctcatccctgctccagcgtcatggacttttccggccttgggtcgaggcctcagcgattcaggcggggccgttttggtaacacccgtgtgtgtgtgtgtgtgtgtgtgtgtgtgtgtgtgtgtgtgtgtgtccgtgcgcgcgcgcatgcgtgcaggcatgtgagcctgtgtgtgcccgcgtgcctgcacgtgtgtggacatgcgtgcggtgtttccgccccagggctggacaccaaggcccgtcttggatgcagggtgttttctgcaggggaaactgaggcgtgggaggctcagcccctgcctgggggggtgactgccagggagtcagcctcagagctcccacccctgggcacaacgggcacctggccctagggcctgggcttcttgggagcccggggccttggctgcacacagaccatggccctgggtcccaggccaggggtgtcctctcagccctgcctccctgcagtgcacgtcctccagcccgccttctggtctcttttcttcctctcaactttaccctgtctccctcccttcctctctctgcccccctcctggcaagcggattgcaatccaaacttgttgttaacttctcccctgcagttgtccacgggcccttccaagttaaacattactcatggcgacaagagcccgcagggcagtgcctggcctggaggtggacccgcgtgcggaaggtgctgggagggggtgagtaccaggcccctccctgcagcatctgtggggcagctgctggtacaggtggccccagcaccctgagcccatacctgggtccctgcagcctcttgcctcgccctttggagtcacgaatgtgcctgtttatgtaacccccatgctcggccagagcgggtaagcctgtgggcagcagctccctgggcaggcttgggaggggccagccaggggccccagaggggtttgggccgggccaggcgagagccctcccctcagccagtcactccagctctgtgccaggctaggggtgggactggaaacaaagtgttcagaaaaaaaatagcctcatctgttttgaatcgattccgcttattgggccctcagttttcccagcagggaagtggagggatggggagtcatgggctcaagcacctcagggagccctcacagctgcaggaggcacaaagcccggaccccactcactgcacccagcagctgctccaccctggcctgtcaagagcctcccaggttaggagcagagccccccaggccgggttccccaggggagcaaagctggaggtcaacagcaaacaggcacggtgtcctctacccaccatctgccaccccctccctcgcgtcctctcttaccactccgtcccccacctgctgcatgcatcctgcagggaccaagcaccgtcctgcccccaggcctttgcgctgctggcccccgccccgaaagcttatcccacacccattttagggctgctgagatggacctcataggaagccctcctccaactcagcacctctcgacttaccctcgtctattccttttaagaacatggacccccatccaacatagaacatttggagacttaattttttatgctctcccaaggaagctgccagctctctagaacaggaactctccgctgtgtccgtgtgcttgctgtagggaggcatgtagtcaactccacagaagaaaccatttccacactcacccacccagcgccctcagggcccagccccctggcctgcacccggaccctgtcgggcaggacacatctggctgaccagagctcaggccaggggcctcccgtggggctcagcggggacagctggatcctgagccaacagggggagggcagcaggccgaggcacacgaagttcaggggggctgcttggtgctggtggcgttcggccaccccactttgtgcaggactatgggccactcgtccaggaactccacaccctccacgtgaagcctccctcctgccctgctcacacccccaggacccttcaggctcccagccttccagcctccctcctgccttctgtccagacagagcttgtcggaggaggcgcttcagtggacgcacatccctgctgcagccaggttccatccagggagcacagaacctgtcctgggcactgaaacgctcacggggcctctgtcccactgggccccctcttgagaggcctcttcccagcacctcaccctggaatgcagcctcagggtggggggtcctgaggggagctgggggaaaaggccctgcctagtgccctgtggctgtgctctccaggcaccttgtctgtgacagggtctttgggggctctggagatgggcggctcacctgcctgcctcgtgcccagacctgcgagtgtgcctgcccgtgtcagacagaggcgagttgggacttcacacctgaaatcaagcgggagggtaggaatgtgagcctcgaaaccaccttctttctgtatcgtttctgggagtggcgatgtcggccagtgggacacctgctgagggtcctcttttcccatccgggtgctggcgggacagggggtggctgtgaccttcacccagcctgtgctgagagctccagccccccacggcgcccacagccctgcctgccgcctcccccaccccagaccctgccctcctaccctccacgcctgctttggggaggaggccaggtgggggtggggctgatctagtcacaggctctgcttcggcaatgagaccccagcaaccccccaggtaagggggccttgggggctgggtgggggtggctcctcggggctcctcctgccctccgggggctgtgaagctttctgggcagcactagtcccttttgcaagacactgccaagacttgtggcatttctgtgggtctctgcatgcacagcagagcacacacatgcaccagggctggggctcttctcctggagggtgaccctgggaatgggtagccttgcccacccaaccttggtcaccagtggccatccagccccaggtgtccccatcctcaatttgggctgagggcagactgcaggctggcgttgcagaggcagctgggtaaagtgtggtcccagacagggacgcaagctggcgattgctgcgggggacctgggcctgggcttagcgactgctgcccctatccagatgcctgattgggaccagggtgtggggccgggccctgcagcgcctgtcttgcccgggctggagccctagagctgtgcgacctggggccagggtgttctgacagactcactctcaggggctggatgcccttgggcaccacggcgggtgcctagcagaccgtgctgtacaccatacccctactctggccatctgtgggctccttgggcccctgccgccatgccactgcctctcttgggagcaagtttcttttcttttctttttctttctttcttttttttttttttttttttgagacggagtttcgctcttgttgccctggttggagtgcagtcgcgcgatctcggctcactgcaacctccgccgctcaggttcaagtgattctcctgcctcagcctcccaagtagctgggattacaggtacctgccaccacgcctggctaattttatatatatatatatatatatatatatatatatatatttttttttttttttttttttttttttttgagacagagtcttgctctgttgcctaggctgaagtgcagtggcgcaatctgggctcactacaagttccgcctcccaggttcacgccattctcctgcctcagcctccccagtagcttgggactacaggcacccgccaccacgcccggctaatttttgttatatttttagtagtgacggggtttcactgtgttagccaggatggtctccatctcctggccttgtgatccgcctgcctcggcctcccaaagtgctgggattacaggcatgagccaccgtgcccggccagttttttatatttttattagagacggggtttcatcatgttggccaggctggtctcaaactcctgacctcaggtgatccacctgcctcggcctcccaaagtgcagggattacaggcgtgagccaccgtgcctggccgagagcaagctgctgcttttttttttttttttttttgagacggagtcttgctttgtcgcccaggctggagtgcagtagtgtgatctcggctcactgcaagctccacctcccaggttcacaccattctcctgcctcagcctcccgagtagctgggactacaggcgcccgccaccacgcccagctaatttgtttttttgtatttttaggagcgacagggtttcaccgtgttagccaggttggtctcgatctcctgacctcgtgatccgcccgcctcagcctcccaaagtgctgggattacaggcgtgagccactgcgccaagagcaagcttctgatgtaggggctgcggggggcttcccaggccaggcaggttgctgtctcagcgccagcgtgtagcctcctcccaggatccggagcaggagggtggctgtcttttgcgttcaatccgctgggctgctgtggggttcccgcagagctgctccaaggggccgagagaaggaaggacgctgcccccaaggacagacgggcaagctggagtcaggagaggcgcagccgtggcccacaggccttggatctctggttgggggagcaccaggtgggtatgggagggggccagggaagccctgcagcccccccacccccacccccggccccaggcagcagtacctccaaggcctgggcggcaggaaagggagagatgacgtcattgccgcctggaatctgctgtttggaggcgtcgccatggagaccggaaggctcagggtgggtaaaaatagcaaacccaaaagggtgtaagttccaagaacgcgagtctctgaaaagcgaggcatccatgttc

SEQ ID NO: 128 - DNA, 5284 bp, Homo Sapiens
tggatgaaggactgggcgagcaccgagggcgtgaacccggaaggtggcgcggccaccagtaacatgatctctagactgggacggtggggttcctgccggctgtattcgggccttggactggactgagaagctacggtgcggatccagctggggtatcaggggctaggcacgtgatgaaaatgaaggacgcggacaccaggacaggaatctcctggttcttagagaatttatttcgccacaaataattggcaaacgggatctcgctgtattgctcaggctggtctcgaactcctgggcacaagcgatcctcacgcctcagccttgcccaatgttgggattacagacgtgagctaccatgcccagcccaggattcttttaaaacttaaatctgatcgtgcctctggccttattggaatccaatgccattaccacctccaccaccacacatcccgtctccagccaccctggccttcattcaggcctttgtgttttctttttcttttcttttttttttttttttttgagacgagtcttgctctgtcgcccaggctggagtgcagtggcgcgatctcggctcactgcaacctccgccttccggattcaagcaattctctgcctcagcctcccaagtggctgggattacaggtgcccaccaccaagcccggctaatttttttgtatttttagtagagacgcggtttcactatcttggccaggctggtcttgaactcctgaccttgtgatccacccgcctcgctcggcctcccaaagtgctgggattacaggtgtgagccaccgcgcccagcctgtgttttcttattagtaattataaagggaatcttatttgacagttctttgacaaataattcagtttgcagaggggatcctgccccagaggccctggcttggagtggaatgcagggccgtgtgcaggagagcctgctcaagtgccgcctggcttttccctccttaggtggagaccatccatggaaaagaacccccctgatgatacgggccccgtgcacgtgcctttggggcatattgtggccaatgagaaatggcgcgggtcacagctggcgcaggagatgcaaggtcggtggcctgccctctgccagccctttcctcccctgacatattaaaaaaaaaaaatctgcctattattgccatcttttcatccaaagcttatggaactcattttcttctctgtattttaagggaaaattaagctcattttcgaggatggcttgacaccagacttttatctgtcgaacagatgctgcattctttatgtcaccgaagctgatttggtggcaggaaatggctacagaaagaggcttgttcgggttagaaatgtaagtattaggctgggtgctgtggctcacgccagtaatcccagcactttgggaggccaaggcgggtggatcacctgaggtcagtagttggagaccagcctggccaacatggtgaaaccctgtctctgctaaaaatacaaaaattagctgagtatggtggcgcacgcctgtaatcccagctactagggaggctgagacgggagaattgcttgagcctgggaggcagaggctgtagtgagccgagatcacgccactgcactccagcctgggcgacagagtgagattccaactcaaaaaacaaaaaacaaaaacaaaaaagaaatgtaagcattggattaaagaaactcgaacattgatttgtctcaccccacccttccctccatcccttggtatcatttatttaaaatcattggccaggtcaggcacgaagtgatagcattcttaacctgaaaagcaatttggttgcaaaatgacttactgtcttttttcctttcaagtccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggtgagtaccgattcctacaccttcgtggtagtcctgtcctcatggacactcagctgctctccagaagcaaccatcaatccaatctatgtcattctctgacttggtttataaaatctcttcgaggaatttaaatgcggaagctgcctctgcagccagctcagcttgtcacacactccaggcaagtgtatcacaaagtatacaagttggagacctgattttagattctcagggtgtgatggctccatcagtcattatcctgccctttcgctggtgaaaacgtcaacctagaggccaggcgtgatggctcatgcttgtaatcccagcactttgggaggcggaggcgggaggatcacttgaggccagcagttcgagaccagcctggccaacatggcaaaaccctgtctctactaaaaatacaaaaattagctgggcgtggtggtgggtgcatgtaatcccagctactccggaggctgaggcaggagaatcacctgaactgaggaggtggaggttgcagtgagtggagatgctccattgcactccagcctgagcaacaggagcgaaactttgtctcaaaaaaagaaagaaagaaagaaaatgttaactagaagctgctttgtctcatcccgtatttttgttaagcatcagcaccttgtgcaagttttttttttttcccttttttttgaggcggagtctcgctctgtcctacaggccagagtgcagtggtacaatcttggctcactgccatctccacctcccgggttcaagccattcttctgcctcagcctcccgagtagctgggactacaggcacgcaccaccacacccggctaatttttgtatttttagtagacagggtttcaccatattggccaggctggtctcaaactcctgacctcatgatccgcccaccttggcctcccaaagtgctgggattacaggtgtgagccaccatgcctgggcagtttttttttttttttagatagggtcttgctctgtcattccagctggagtgcagtggtgcaatcttggcttactgcaacctttgcctcctgggttcaagcgattctcctgcctcagcctccctagtacctgggattacaggcacccaccaccatgcccggctaatttttgtatttttagtagagataagagtttcaccatgttggccaggctagtctcaaactcctgacctcaggtgatctgcctgcctcagcctcccaaagttctgggccaccgcaccaaccaacacttttttttttttttttgagatggagtttcgctcttgttgctcaggttggagtgcaatgatgcagtctcggctcactgcaacctcctcctcctgagttcaagtgattctcctgcctcagcctcccgagtagctggaattacaggtgcccgccaccacgcccagctaatttgtattcttagtaaagacggggtttctccatgttggtcaggctggtctcgaactcccgacctcaggtgttgtgcccgcctcagcctcccaaagtgctgggattacagtcgtgagccatcgcgcccggccgccaacacttatttttaaaatcagtttagtagcttacgcctctgatcccagcatggggaacatcaattgtgtgtgtgtgttgtttgtttttttcacttttgttttctttgttatgtgtgtgttgtttttaaatcaccccctctgatgtggagctagagttgagagccacattgaagatgcaagcagccatgaatggttcacagatccctctctactatatcccttgcgtcaccgttcctaactttccttgatataacactgttgtctgccttagtataaccaccactaactagaccaggtttctcctttgaggcaggcttcctgcagctcctgcgtgaagtaggcctagtttaggtgtagccatcatttaatcctgcacaactgaaatgtttcttaatggaccaacagaaagtgtttgaattcatctgtgtgtttttctaaacattctgaaaacgcacatttttgtaaattaatgtcttaactcctttgtgtggttcacctttcaataattttactgatgtctgagaaattatattcatgatacatgaaaacatttgttcccttaagtcaagctgagccaaatggaaaaacgcaatttctacaaaacatattttaagaaaacggccagtcctccagagggcgctcacgtgctgttgctttcattgtggttcaggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaaca

SEQ ID NO: 129 - DNA, 42886 bp, Homo Sapiens
gatgggttggctttcgtcagggacataggtagaagctggttggggagtgtgcgtgccagcctgacgcgatatagtgcgcacatgcgtgatgacgtagagggcgttgattgggaccgagtacagggcccgcgcatgcgtggattgtcgtcttctgtccaagttggtcgcttccctgcgccaaaggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggtaagtgacttcagcatgtagtgccattcggtgtgtggaagaaagaccttccctgcctatctctgctggatggactttgctgtttgatggcctgcccttctcctcccagataattctgaaattcttttcttcctttgaacttcgcagagctaccctaggctcttatatgcagatcttactctagtgtgccctaagttttttttggacactggtagtttgacatcttttggtccctgataaatggccatgaccataggtattttttgtcatcttaagtggttcaggtgagacccttctcatccaggaaagtagtgttaccattccaggacctcagtgtaaaaatgcccccaccctgcaataactacaccaaccaaagaataaacgcaagcaacacagttacaggaaagtgattgattccctcactatagcctccacgtttgggagtgtatgtgcaggcaacacagtaacacataaaacaaaggaagagaaataggggtacatgtaatcttcatactggttaatttaactcctgagcagaaaaattttgaatatttttattaaaaatgagaaacggccaggcgcggtgtctcaagcctgtaatcccagcactttgggaggccgaggcgggcggatcacgatgtcaggagatcaagaccatcctggttaacacggtgaaaccccgtctgtactaaaaaaaaaatacaaaaaattagccgggcgtggtggcggtcgcctgtagtcccagctgctcgggaggctgaggcaggagaatggtgcgaacctgggaggtggagcttgcagtgagccgagatggcgccactgcattccagcctgggtgacagaatgagactctctcaggaaaaaaaaaaaagtgagaaacataggaaatacaaaaaagaaaaaaatttgctataatctaccactctaacacaaccactaccagcattttgacatttttgtatttttctttcaagtatctttcaatatttatttcctaatgaaatatatatattttttaattttttaatagagacaggctggagtgcagtggtgagatcatcgtagctcactgtaacctcaaactcccgggctcaagtgatcctcctgcttcagctacctcagtagctgggactacaagtgccgccaactcccaataatttcttaattttttgtagagacaggatcttgctatgttgatcaggctggtctcaaactcttggcctcaagcgatacccccaagccttggcctcccaaagttctaggtttatagtcatgagcctccatgcccagactgtatctgatttctttttctttttttttggagacagtcttgctctgtcgcccaggctggagtgcagtggcgcgatcttggctcactgcaagctccgcctcccgggttcatgccattctcctgcctcagcctcccgagtagctgggaccataggcgcccaccaccacgcccggccagttttttgtatttttagtagagacggggtttcactgtgttagccaggatggtcttgatctcctgaccttgtgatccgccctactcagcatcccaaagtgctgggattacaagtgtgagccactgcgcctggcctatctgatttcttgtattgtaacgatagtgcatatacatttatttatttattgagacagagtcttgctctgtcgcccaggctggagtgcactgactcaatctcggttcactgcaacctccgccaccccagttcaggctattctcccatctcagcctcccaagcagctgggatgacaggcgtgtgcgccaccacactcggctaatttttgtatttttagtagaggcagtgtttcaccatgttggccaggctggtcttgaactcctggccttaggtgattcacccacctcggcctcccaaagtgctggaattacaggtgtgagccactgtgcgtggcctatagctcattttaaatataccataatttggccgggtgtggtggctcacacttgtaatctcaataaatatactgtaatttgtctgggtgtggtggctcacgcctgtaatcccaacactttgggaggctgaggcgggcagatcacttgaggtcaggagttcgagaccaccctggccaacatggcaaaaccccatctctactaaaaaatacaaaagttagctgagtctgtggtggcatgcacttgtagtctcagctgcttgggaggctgaggcacgagaattgcttgaaccggggaggcagaggctacagtgagctgagattgcaacactgcactccagtctgggcaacagagtgaaactctatctcaaaaaaaataaaataggggccgggcgcggtggctcacctctataatcccagtactttgggaggccgaggcaggtggatcacaaggtcgggagatagagaccatcctgactaacatggtgaaaccccgtctctactaaaaaaatacaaaaaattagccaggcgtggtggcaggcgcctgtagtcccagctactctggaggctgaggcaggagaatggcgtgaacccgggaggcagagcttgcagtgagctgagattgcatcactgcactccagcctgggcgacagagtgagactctgtctcaaaaaaataataataaaataaaaaataaggccgggcgcggtggctcacacctgtaatcccagcactttgagaggccgaggcgggtggctcacgaggtcaggacatcgagaccatcctggcaaacacggtgaaaccctgtgtctactaaaaatacaaaaaaatagccaggcgtggtggcaggcgcttgtagtcccagctactcgggaggctgaggcaggagaatggcgtgaacccgggaggcggagcttgtagtgagccgagattgcgccactgctctccagcctgggcgacagagcgagactccgtctcaaaaataaaataaaataaaataaaataggtcaggcacggtggctcatgcctgtaatcccagcatttttggaggccaaggtgggcagatcacctgaggtcaggagttcaagaccagcctggccaacatggtgagatcctgtctctactaaaaatacaaaataagccaggcgtggtagcgcatgcctgtaatcctgctactcaggaggctgaggcgggagaatcgcttgaacacgggaggtggaggttgcggtgagccaagatcgcgtcatcgcatgtttaaggttcttgacacacattgccattttgttctccaggagacagctaattaaacttattaagaagcagcaggccatgcacagtggctcacggctgtaatctcagcactttgggagtaggaggctgaggcaggctatcacctgaggtcgggagtttgagaccagcctgaccaacatgatgaaaccccatgtctactaaatacagaaaatttgctgggcatagtggcacatgcccgtaatcccagctacttggagatgaccagacattatatacctttttaggaaaaaatatgttacttatgataaagtcatgctgaagaaagaaaacctgaatcagattaagcctctctaggtccttagtaggaaggacagaggactctgttaatctacaccaaaagaggtcaatcggcaggccaggcaaggtggctcatgcctgtaatcccaatactttgggaggccacggcagaggatcgctcaagcccagaagttcaaggctgcagtgagctatgattgcgccactgcattccagcctgtgtgagagaacaagactgtttctaaaataattaattcaataattttatttttttatttgagatggaatctctgtcgccaggctggagtgcagtgactaatctcggctcgctgcaatctctgcctcccaagttcaagtgattctcctgcctcagcctccctagtagctggaattataggcatgcgccaccacacacagctaattttttgtatttttagtagagatggcgtttcaccatgttgtccaggatggtctcaatctcttgaccttgtgatccacatgtctcggcctctgaaggtgctgggattacaggcatgagccaccgtgcttggccatttatttatttttattttttttgagacgggttctcgctctgtcacgcaggctggagtgcagtggcgcgatcttggctcactgcagcctctgcgtcccagattcaagcgattctcccacctcagcctccatagtagctgggattacaggcatgcgccactacacgcagctaatttttgtatttttagtagagatggggtttcaccatgttgtccaggatggtctcaatctcttgtcctcgtgatccacatgcctcggcctcccaaagtgctgggattacaggcgtgagccactgtgcccagccaaaataattttttattttttatttatttttttgagacagagtcttgctctgtggcccaggctggagagtagtggtgtgatctctgctccctgcaacctctgcctcccaggttcaagtgattctcctgcctcagcctcctgattagctgggattacaggtgggcaccaccacacctggctaatgtttgtttgtttttttttttgttttttttttttgagaccgagtctcactctgtcacctaggctggagtgcagtggcgtgatctcggctcactggaagctccccctcccgggttcatgccattcccctgcctcagcctcccgagtagctgggactgcaggtgtccaccaccacgcccagctaatttttttttgtatttttagcagagacagggtttcaccgtattagctaggatggtctcgacctcctgacctcgtgatccgcgcgcctcggcctcccaaagtgctgggattacaggtgtgagccactgcgcccagcctaatgtttgtattttcagtagacacagggtttaaccatgttggctaggctggtctcgaactcctgatctcaagtgatcctcccgccttggtctcccaaagtgttgggattacaggcatgagccactgtgccccgcctaattaatttttttaaaaaggcaatcagcaaaattcagaatgtggaaaagtgtataacacaaagcatcttggctcttcagaagataaattacaagggaaaaaagagagggtatctgtagatgaagaggctttagaaaattaagtcaaagctaatgtttagaaatgtaggtttgggtgataaaattataaagaaacgtaaggggtgggtgtgtggtagatcatgcctataatcccagctcttaggccagggcggggtggggtgcggtggctcacgtctataatcctagcactttgggagtctgaggtgggtggatcacctgaggccgggagttcaagaccaacctgggccaacatggtaaaactgcgtctctactaaaaatacaaaattagctgggagtggtggcgggcgtctataatcccagctagttgggaggctgaggcaggagaatcgcttgaacctgggagacggaggtcgtagtaagccgagattgtgccactgtactccaccctggcaacagagcgagactccgtctcaaaaaaaaaaaaaaaaaaaaatagaggcctggtggggaggattgcctgagctcagaagttttagatcagcctgggcagtgtagcacaataccatctctacagtaaacttaaaaaattagctggtcatggtggcacacacctgtagtcccagttgctcaggaggctgagtcaggatgatggcttgagcccaggagttcgaggttgcagtgagctatcatcgcgtcactgcactccagcctgggtgatgggagtgtgaccctatctcagaaaaaaaagtcaggatattgacttttttggggaggtgggtgttgtaattgggagggaatgtaagagggatttctggggtgtctggcaagactcaatttcctgacataggtggagattttatggttgttcaccttataataatttattaggttatactttcctttatggcctttatttatcttatatggtaaacaaatacgaaaacaaggacaaacattttcttccatttttttccccataggagactataaatattcaggaagagatagtttgatttttttggttgatgcctccaaggctatgtttgaatctcagagtgaagatgagttgacaccttttgacatgagcatccaggtaagactaccttttaatttaagacaaatttaaaaacagtattggctgggcatggtggcggctcatgcctgtaatctcaggacattgggaggccgagacgggcagatcacttgagcctaggagtttgagaccaacctggtaacatggagaaaccccgtctctacaaaaaatacacaaatcatccaggtgtggtggtgcaaacctgtagtcctagctactcaggaggccgaggcgagaggcttgcttgagcccaggaggtcaaacagaaaaaagaagtaggctcctcctcttgcagagatggaagtataaaggaagaagggaagttcccacagttatagtgtggaaaagagtgagtgatacttgggagttgactactgcctgtggttggggaagatggctacaataaaaaggcaacttcaattttaaaacaggcacaggacttgaaaagacatttctccagctgggcgtggtggctcatgtctataatcccagcactttgggaggctgaggcaggcggatcatgaggtcaggagaccagcttggccaacatggtgaaaccctgtctctactaacaatgcaaaaataattagccaggcatggtggtgcgcttctgtagtcccaggtactcgggaggctgagtcaggagaatctcttaaacccaggaggcggaggttacagtgagccgagattgtgccactgcactccagcttgggcaacagagtgagactctgtctcaaaaaaaaaaaaaaaaaaaaaaaacaattctccaaagatatgcagatgtccaacaagcacaggaaaagatactcagcatgtttagtcattagagaaaggcaaatgaaaaccataatgagctaccactcacacccactatataaacaaactaaaatttaaaaaacaccagcagaaaataagtgttggcaaggctgtggagaaattggcgtgattgactgtacctgacctgttcttgtttctttaaattgaggttgtgtttcatgtaacataaaattaactatttgaaagtatacaattcagtgacacttaacacattcacaatgttatgcagccaccacctctatcttattccaaaacattttgaatggctaaacagtggcatatagatatacattccatgaaaaggaatgaataattgatacatactacaaagtagatgaatcttgaaagtattatgctaagtgaaagaagccagatacaaaaagtcaaatattgtatgatttcatttacatgaaatatccagaataggtaagttcttaacgcagaggggtggttggttacctgaggcacagggaagagaggaacagggagcaactgctcaatgggtatggggtttgcttttggggtgatgaaaattttttggaactagagttggtagttgcacaacattgtgaatgtttgtgtgtgtatttatttatttatttatttttattattatttttgagacggagtctcgctctgtcacccgggctgtagtgcagtggcgtgatcttggctcactgcaagctccgcctcccgggttcatgccattctcctaccttagcctccagagtagctgggactacaggcacctgccaccatgcctggctaattttttgtgtttttagtagagacggggtttcaccgtgttagccaggatggtctcaatctcctgaagtgatccgcctgcctcggcctcccaaagtgctgggattacaggtgtgagccactgcgcccagccttgtgtgtgcatttatgctttttttttttttttttttgagttggagtctcgctctgtcaccaggctggagtgcagtggcacaatcttggctcactacaacctctgactccctggttcaagcgattctcctgcctcagcctcccgagtaggtgagattacaggcacgtgtcaccatgcccagctaatttttgtatttttagtagagatggggtttcaccatattggccaggatggtcttggacccctgacctcgtgatctgctcgcctcggccttccaaagtgctgggattgcaggcgtgagccatggcacccggccttgctttttttttttgagatggtgtctcactattgctcaggctggtttggaactcctgggctcaagcaatccacccacctcagcctcctgtgtggctggggttaaggcatgtgccactatgcctggcacattgtgaatgtattaaatacctcttaattgttcacttagaaaatctaaatttcagcttaattaaaaagattagtgtttctttttttttttttttaatttattttttttattgatcattcttgggtgtttctcacagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgatgactcttaacgagcatgctgccttcaatccatttaaccctgagtggacacagcacatgtttcagagagcacagggttgtggggtaaggtcacagatcaacaggatcccaaggcagaagaatttttcttagtacagaacaaaatgaaaagtctcccatgtctacttttttccacacagacacggcaaccatccgatttctcaatcttttccccacctttccccgctttctattccacaaaaccaccattgtcatcatggcccgttctcaatgagctgttgggcacacctcccagacggggtggtggctgggcagaggggctcctcacttcccagtaggggcggccgggcagaggcgcccctcacctcccggacagggctgctggccgggtggggggatgacccccccacctccctcctggacggggcggctggcagggcggggggctgacccccccacctccctcccggacggggcggctggccaggcagaggggctcctcacttcccagtaggggcggctgggcagaggcgcccctcacctcccggatggggcggctggcctggctggggctgaccccccacctccctcccggacgggtcggctgctgggcggagaggctcctcacttcccagatggggtggctgccgggcggaggggctcctcacttctcagacggggcggctcccggacagaggggctcctcacttctccgacggggcggttgccgggtggagggtctcctcccttctcagatggggcggctgggcagagacgctcctcacctcccagacggggtcacggctgggcagaggcgctcctcacatcccagacggggcggcggggcaaaggcgctccccacatctcagacgatgggcggccgggcagagacgctcctcacttcctagatgggatggcggctgggcagagacgctcctcactttccagactgggcagccaggcagaggggctcctcacatcccagacgatgggcggccaggcagagacactcctcacttcccagacggggtggcggccgggcagaggctgcactctgggcactttgggaggccaaggcaggcggctgggaggtggaggttgtagcaagccgagatcacaccactgtactccagcctgggcaccattgagcactgagtgaaccagacaccgtctgcaatcccggcacctccggaggccgaggctggcggatcactcgcggttaggagctggagaccagcctggccaacacagcgaaaccccgtctccaccaaaaaaatacgaaaaccagtcaggcgtggcggcacgcgcctgcaatcgcaggtgctcggcaggctgaggcaggagaatcaggcagggaggttgcagtgagccgagatggcagcagtacagtccagcttcggctcggcatcagagggagaccgtggaaagagagggagagggagaccgtggggagagggagaccgtggggagagggatagggagagggagagggagagggattactgtttcttttgtgtacttcgtagagaagaattttcacagatttattatatatctcatgtctcataattttagaatttggaactgaacagaaacttttcatgttctaatttgtgtacaaatagttcttggtaggcagggtgtggtggctcacgcctgtaatcccagcactttgggaggctgaggtgagtgaatcacttgaggtcaggagttcgagaccagcctggccaacatggtgaaattctgtctctactcaaaatacaaaaattagccgggcatggtagtgcaggcctgtagttgcagctattcaggaggctgaggcaggagaattgcttgaactggggaggtggacgttgcagtgagccaggatcacgccactgcactccatcctgggtgacagagagagactccatctcaagaaaacaagaaatagttcttgtagttggcacaccagaatatcttgcaccaaaaaaaaagaataagctgggtgtggtggtgtgcacttgtagtcccagctactcaggaggccggggtgagaggattgcttgagcccaggagtttgaggctgcactgagctatgattgtgccagtgaactctagcctgggcaacagagtaagaccctgtctcttggaaaaaaaaaaaaaaagaaaaggctgggcgcggtggctcatgcctgtaatcccagcactttgggaggccgaggtgggcggatcacgaggtcaagagatcaaaaccatcctggccaaaatggtgaaacctcgtctctactaaaaatacaaaaattagctgggtgtggtggcgtgcgcctgtagtctcagctactccagaggctgaggcaggagaatcgcttgcacctgggaggcagaggttgcagtgagccgagatggcactattgcagtccagcctgggcaatagagccagactctgtctcaaaaaaaaaaagtgtatgtaaaataaaataatagaactatgaataaaaacaatcgttaatttaaagtggttctcaaacagaattacttgcaggacattaaaacacagactacagaaccttgccccacaatcaaaatttctgattctctatgtctagaatggggaccaagaatttgcatttctagtaaattgtcaggtgatgctgatgttactgatttggagaccattactttgaagagcagtgctttaaccttttttagaccgtggacctatttttttttttttttgagacggagtctcgctttgctgccctggctcttggctcactgcaagctctgcctcctgggttcacaccattctcctgcctcagcctcctgagtagctgggactacaggcacccaccaccacacccggctaattttttgttcttgttttttagtagagatggggtttcaccatgttagccaggatggtctccatctcctgacctcgtgatctgcccacttcggcctcccaaagtgctgggattacaggcatgagccaccgcacctggccaaccgtggacctctttgaggatatgatgacagctacataccttcccctcaaaaaagatagtactcacaattctacctgtaatttcagagagttaatggaacccttgatgcctaaagacctcagaagaaaatgtagtgttaggtaggaaggaaatgagacattcatagatgagcacaatttgataaccgataataagtattcagtagttgataagcaatagaaaacattttctaaaattctgttttagtttttgtttttaatttttagaacctaaaaggagcccttaccagattcttttaaaagtttgtagactcctcagagtagattaaaatatttatggaaatgactacttgccatgtggattgttgtcagtgactagctatagtacatgttctgcatttaaggagagaatagctgtggacgaaggccagctagagctcaggcaggacatggaggggatcaccatggttggtttattcctcagctttgcaggttccaaaacttaatttttttttttttttttgagacagggtctcgctctgtcatctaggctggagtgcagtggcatgatctctgcccactgcagccttgacctcctgtgctcaggtgatcctcctgcctcagcacccctgagtagctgagtagtggggactacaagcatgtgcatgcccagctaatttttttgttttttgtagagacattgttttgccatgttgcccaggctagtttcaaacttctgtagcaatcctcctgtgttggcctcccaaagtgctgggattataggcatgagccactgtacctggcccgaagacttaattttgttagtgctccagaattaggtaggcccctagaactgatgaactctcttttttttttttttttgagatggagtctcgctctgttgcccaggctggagtgcagtggcgcaatctcagcccactgcaacctccacctcttgggttcaagcgattctcctgcctcaacctcctgagtagctaggattacaggcacgtgctaccacatccaactaatttttgtatttttagtagagttggggtttcaccatgttggtcagaatggtctcgaactcctgacctcgtcatctgctcgccttggcctcccaaagtgctgggattataggcatgagccaccgcgcctgggtgaactgatgagctcttacaagacctgatgtaccagatgctgacattagtttatatagaggggtagacctttcctgttactggaatactgatgtctttaactgggtagttaaacagttttatttcaaggatgcgcttactggtagttattgacttattttcaggtcacatgtacttaagcattgtaattattttatatagtcatcccttgttattgagggaattggttgcaggactccccgtggattccaaaatccgaggatgcccaagtcccttaaataaaatggcatagtatttgcatataacctacacacatcctcccctatactttaagtcatctataggttactcatagtacctaatacaatgcctatgcatcacttcattcacatggcttcaatgtagtacttggcacatggcaaattcaggttttgctttttgaaacgggaatttctttgtttttcctgaatatttgagatttgaggttggttgaatacatagatgcagaaccagcagatatggagggccaactgtgtatataaactctgtttcctgataccaaggtacttgaaagatcacatgacctgtccaaattcagccagttaagtaagtgacatcagtaggactcaactccaggttttctgattccaatgctttgcttcgccccaactcccatagcacaatttcctccctctgatacttcttttccttttttcttgagataaggtctcactctgttgcccaggctggactgtagtggtgcagtctctgctcactgcagccttcacctcctggggtcaagcgatctttcacctctgcttcccaagtaactgggaccctgtgctgccatgcccagctaatttttttgtttttttttgtttggtagagatggagtctcactatgttgcccaggctggtctcgatctcctagggtcaagtgattctcccacctcagcctcccaaagtgctgggattgctacagatgtgagccactgtgcctggcctgaatatacgtattgttaattctctgatttcaatggcagggactgcttatacttctaatgtatacttactgcattctggtttttgttaaaatttgatatttatgcccattactttcactgattcattacccctgaaggtagggatcttgccttattttagtgccatatacaaattcagtgcacatattttgagcaactaataggtactgagcacttatggagcttccatttagtggtaagtaaatattaattgaattttttttttcagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtcagtaatattttaagatcagcttttcccttatatatgagaatatcagtactctgatcaaagaggactgtggagaaggaagcaagttacatcttgtctaggagtatgctttcctccataaggggaccttgctcgatgtggactttgttaaatgggttaaacagctctggggtgaaaaagggtccttctgttagtcttgtggtaaaggcagccactgacattcttctgatttttctttccatttgactccctgcctctgatcaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggtgggcatatttccccgttctcttaaattggcacttaattattgtttttttattttttatttttttaggagttcaggagtcttggctcagcctcagcctcccaagtagctgggactataagcatgtgctgttgtgcccagtgcagttttattgctttctgtgtacctgacttcaggcatgtgctttttaccatttagaataaaataaaaaaataaagtgaagccagaagatgcctgtgtaacattaacactgcagatggccatgccattagctgtctaaaggactctgtcagaacaagattgtcttgatttttttttttttttttttttttgagacggagtctcactctgtcccccaggctagagtgcagtggcacaatcttggctcactgcaacctccgccttccagattcaagcgattcacctgcctcagcctcccaaatagctggaattacaggcatgaaccactgtgcctagctaatttttgtatttttagtagagatgggggtttcaccacgttgaccaggctggtctcgaactctggacctcagatgatccaccacctcgccctcccaaagtgctggggatgacagatgtgagccactgtgcctggccagttgtcttgactttaatattaccacgaatggtgattatttgaaaagttgtctgaagtcattatagcagttggtttccttagtcactttttctaagtcctgaaaatgttaatagtctagttttcagggagcttttaaaagcatgtttcagttttaactgaaagaacttctcacttgctgaaaattgttttttcctccctcacttttgtttacccttgcaacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggtgtgcactcagcccgggtcagctgcctacactgcccttaaatcagaagcaggctgggcgcggtggctcacacctgtaatcccaacagtttgggaggccaaggcaggcggattgcttgagcctaggagttgagaccagcttgggcaacatggcaagaccctctctctacctaaaaaaaaaaaaaaaaaaatcagaagcaatgcactgctacacattgcttaacaaaccagaagcaatacattgctctgacctgactggctacttaactcgactatgccactgcctcactgtcttcctctaaaatagtttatttcaggatagcagaagctatttgctgctttatctctggcaagagctggcatgatatttctctaaagtaacacagccctccatttcgtgggggtagacagttatggtctaagagtatccttagctgtactcactagtacagtcatgtgttaattaatgatagggataccttcttagaattgcgtcattaggcgattttgtcattgtgcaaacatagagggtacttcacacacccagagagtacagcttgactacacacctgggctgtgtggttagcctgttgctcttaggctacaaacctgtatagcatattaccatactgtttactgtaggcaatggtaagtatttgtgtatctaaatgtatctaaaggtatagaaaaggtacaataaaaatatgatataggccagacacggtggctcacgccttgtaatcccaccactttgggatgccgaggcgggtggatcacaagttcaagagattgagaccatcctggcctacatggtgaaaccttgttctctactaaagatacaaaaattagctggacgtgatggcgcgcgcctgtagtcccagctactcaggaggctgagaatcgcttgaacccaggagtcagaggtggcagtgagccaagatcatgccactgcactccagcctggtgacaaagtgagactccgcctcaaaaaaaaaaaaaaaaaaaaaagaaatatggtataaagataaatggtatacctgcatagggcacttaccacgaatggaacttacaagactagaagtggctctgagtgagtagtgagtgaaagtgaaggcctaggacatgactgcatacttttatataactggcagcacagtaggtttgtttacacagcatcactacagatgcatgagtgatgccttgtgcgacaaacttacgacagctatgatgtcagtaggtgacaggaaattttgagcttcattatcatcttaacagaccatcattgtatgtgcgccctattgttgaccaaaatgttagtggtgcatgagtgtgcattatttgctttattcttctctgtaaattggtgacaacaatacctgcctcattaggttactgtgaagagttagtgaagagcacaaaacagagcctgttagggagcaaaaactcataaatgttagttatgatcattgttaaaattgtgtcattctgatttcttataaacctgagaccaatgggaaccagattgctagattctttttctttttttttttttttttttttttttgagacaaagtctcaccctgttgcccaggccagagtgcagtatgatcacagctcaccttagcctcgacctcctgagctccagtgatcgccccatatcagtgttctgagtaactgggaccacaggcgtgtgccaccatgctctgctgattattttttatttttatttttattttttgtgagatggggtctcactgctttgcacaggctggttgcaaactcctgggctcaagaaatcctcccatttaggcctcccaatgtgctgggattacaggcgtgagctaccatgtgtccatgtgtagcctagattctctctctttttttttttttgagatggagtcttgctcttttggccgggctggagtgcagtggtgcggtctcaggtcactgcaagctccgcctcccgggttcatgccattctcctgcctcagcctcctgagtagctgggactacaggcgcctgccaccacacccggctaattttgtatttttagtagagacggtttcaccgtgttagccaggatggtctcgatctcctgacctcgtgatccgcccgcctcggcctcccaaagtgctgggattacaggcttgagcctctgcgtccggcctagattctgttttttttagagagccttgatattagaatcctaaaggttactcattgtttcttcctaaagacctacagccttttatttattaagagacggtgtctcactcttgcccaggctggagtacaatggcaccacagcctacaactcctgggctcaggcagtcttctgtggtcttcctgtctcagcctcccaagtagcttttttttgagacagagtcttgctctgtcgcccaggctggagtgcagtggcgtgatctcagctcactacaagctccgcctcccgggttcatgccattctcctgcctcagcctcccgagtagctgggactacaggcacccgccaccacgccgagctgatttttttgtatttttagtagagacggggtttcaccgtgttagctaggatggtcttgatctcctgaccttgtgatccacccgcctcagcctcccaaagtgctgggattaagggcgtgagccaccacaccctgccccaagtagctttttttgtagacttggggctcttggtatgttaaccaggctggtctgagactcctggcctcaaacgttcctcctcaagctttcattctggagtggtttcctcagtataggggtccatgacctttggtaacttttaagcagtttttaagagtttactgacaattctaccagaaaacccaagaaatttttttgaggagaccttgaatcactcattgccacagttgtagttttgtcattgttctccttttcctcttggaaactatttttctttcctcagacaagtatcttgtcacctcttcacctgtcttgaaatgatgcgatgttgtttatactacagtttggaagtctactacacattttggtggagatggatggggaggatagaatagtgggtaaatgtaggccttgttgtcagattgtttggattctagtcctggtccctttgctatgcgacctgacttctctgagccttagtaaaatgggagcaaaaaatggtacctccttgggtaggtgcagtggctcacgtctgtaatcccagcatgttagtaggccgaggcaggaggattgcttgagtccagaagcaagaccagcctgggcaacccagggagaccctgtctctctttattaaaaaaattaaaaaactgtactttcacataggattgccgtgagcattaaatgagataacctaggcatagtgcttggcccgtggtaattatttataaatgttagctgttcttattttgtggaacagtcattgtaggatggatacttgatataaataataataaattggagatattgagaactaacaatgccttagggctaaggcctagaaaaatattaaacttacgctttttaaaaaatttttaatttttgtgggtacatggtaggtgtatatacttataggatccatgagatattttggtataggcatgcaatgcgtaataattacatcagcatagatgggttatctatcaccttaagcactaatcctttgtattataagcaatctgattatactcctttagttattttaaaatgtactgttattattgactatagtcaccctgatctgctctaaagtattagatcttattcattctttctattttttgtactcattaaccatccccactgccccatcactacccccttacccttcacagcctctggtaaccatccttttctgtgtccatgagttcaattgctttactttttatctcccagaaataagaacattcaaagtttgtctttctgtgcctggcttatttcacttaacatagtgaaacaacattgcatagtgaatgcaacaacatttatgttgttaccaatgacaggatctcctttttttttgagcctgagtcttgctcttgttgcccaggttagactgcaatggcgcgatctcggctcactgcaacctctgccttctggattcaagcagttctcctgcagcctcccaagtagctaggattacaggcatgcaccaccacgcccgactaattttgtatttttagtagcgacacagtttcaccatgttgaccaggctagtctcgaactctggacctcaggtgatccacctgcctcaggatctcattttttatggctgaatagtactccattgtactacactttctttatccattcttcttttgatggacacttaggtcgcttccaaatcttggctgttgtgaatagggctgcaataaacatgggagtgcagatatctctgatatacagatttcctttctttggggtgtatacctagcagtgggattgctggatcatacagtagttttctttttagtattttcaggaacctccaaccattttaactgaggtgagatgatatctcagattatgttagagttttttcctgtagagttgtttgggttccttatatattctggttcttaatcccttgtcagatggatagtttccagatattttctcttctctttgtcgatcatttcctttgttgtgcagaagctttttaacttgatgtgatcctatttgtccgtttttgctttggttgcctatgcttctggagtattacttaagaaatctttgccaagctcaatgtgctggagaatttcccggtatgattttgtggttccacatacattttaggattgttttgtctatttctgtgaagaatgtcattggtattttgatagggattacattgaatctgtagattgctttgggtagtctgggcattttaacaatatttaaacttactgtagcaatctatagagtgagaccctgtctacaaaaaaaaatagttacttttgaagattgtgcagttttgtaattggttgcatttatcgtcaactctccttcaagcagcctttagacactgattttcacatctaagaagccaccaaatggttgatgttgttagtaatgcatctgttaccaacactcatctgtgagtcacatcatgcatttccaagttgatctgaaggtatattaggtgcttgccccaggaaccaaaatttctatttgtggctctgctcaaaaccagtgttgtctccacggtgtgaacctgtatatcttcgaactatacagacacttgtctaaacatgttcttttctttaaatactgctaggtgttccacaacagtgaagatttggttattggagactgttcttttctgataaaagtgttatagctggccgggtgcggtggctcacgcctgtaatcccagcactttgggaggccaagggggcggatcatgaggtcaggagttcgagaccagccacaccaacatggtgaaaccccgtctctactaaaaatacaaaaattagccaggcttggtggtgggcgcctgtagtcccagctactcaggtgactgaggcaggagaatcacttgaacccggttggcggaggttgcagtgagccgagatcacaccactgcactccagcttaggcgacagagcgagactccatctcaaaaacaaaagaaaacaaaaaagtgttaaagctgtaaatttgtctctgagcatggctttagctgcatcgtatacattttgatatattgtgtttttactttcatgcagttcaaaataattttaaattttctggccgggcgcgctggctcatgcctgtaatcccagcactttgggaggccgagacgggtggatcacctgaggtcagtagtgccagaccagcctggccaacatggcgaagcaccgtctctactaaaaatacaaaaattagctgggcgtggtggtgggcacctgtaatcccagctactcaggaggctgaggcaggagaatcacttgaactcgggaggcggaggttgcagtgagctgagattgcgccactgcactccaccctaggcgacagagtgagactccatctcaaaaaaaaaaaaaaattagctgggcgcagtggcatgtgcttgtagtcccagctacttgggaggctgaggcaggagaatctcttgaacccgggaggcggaggttgcagtgagctgagattgcgccactgcactccaccctaggcgacagagtgagactccatctcaaaaaaaaaaaaattagctgggcgcagtggcatgtgcttgtagtcccagctacttgggaggctgaggcaggagaatctcttgaacccgggaggcggaggttgcagtgagccgagatggcgccactgcactccagcctgggtgacagagcaagaccctgtctccaaaaaaaaaaagaaaaatgttttcctcgtgatttcttcttgggttttttataagtgtattgtttaattttcaaaaatttcaggttttcccacatttctttctgttgtggacctctaacttagctccattgtggttaaggaacatactttatgggatttcaacctttttccatgtactgagacttgttttgtggcccaacatatgatctctcctagagaatgttctatgtgcttgagaagaatgtgtatcatgggttattttacgttctttttttcccccataatataagaattttttgcatattgtaaatatatgtgtacattgttattattgcagaacacattttctttttttggagatggagtcttggtctgtcgtcccaggctggagtgcagtggcacgatcttgcctcactgcaacctctgcctcctgggttcaagcaattctcctgcctcagcctccatagtaactgggactgcagatgcacaccgccacgcctggctaatatttttttgtattttagtagagatggggtttcaccgtgttgcccaggctggtctcaaactcctgagctcaggcaatccgcccgcctcagcctcccaaagtgctaggattacaggcatgagccactgcacccggcctgcagaacacattttcaagaggtcctgttgctgcttaagctgttggtataagtgctctggagtaatatgtcatgatggaaaagtacatgagctttgaaacagggatacttgagtttgaatatggatttttattgtgtgtccttgggcaagtcatgtaacttctctgagccctcacttatagaaggtcaataataaggttcttgagtggcaagcaataaaaactgaccttgagctgggggctgtggctcacacctgtaatcccagcactttgggaggccgaggcgggcggatcacctgaggtcaggagtttgagaccagcctgaccaatatggagaaagcctgtctctactaaaaaatacaaaattagcctggtgtggtggtgggtgcctgtaatcccagctactcgggaggctgaggcaggagaatcacttgaacccgggaggtggaggttgcagtgtggagatcgtgccattgcactccagcctgggcaacaagagcgaaactccatctttaaaaaaaaaaaacaaaaaacaaaaaaaaacaaacaaaaaaggctgaccttgactaatttcagcgtatgagtcaaataattagttctaggaatctacgtagcaggaactaatgacagtgtctttagggtgccattatgagaagaaagtatcctctggaatcacatcctttcatggccactgctcagagaccccgactctcagatgagaacgtcctatggccttctccagggtcagatatgcccaccacttggccagaagaaggcacagcaacttgagtttgactaacattctcccaaaactgtagtcggggaagggtaattcccaaagaaaaattggggtgtttttttgttttgttttgttaagtaacccttattttgatggggctttattctttcttcttttttttttttttttgagatagagtctcgctctgtcgctaggctggagtgcggtggcacgatcttggctcactgcaacctccaactccctggttcaagcgattctcctgcctcagcctcccgagtagctgggattatagactgtgcgtgcgccaccatgcctggctaatttttgtatttttagtagggatggggtttcaccatgttggccaagctggtctcgagctcctgacctaggattacaggcctaagccaccgcacccggcatgatgggtctttattcttcaaagcaggaggaagggatcctagaaaaacagagacaaggccaaacatggtagctcacacctgtaatcccagcactttgggaggccagtgcgggtgaatcacgaggtcaggagttcaagaccagcctggccaacatggtgaaacaccgtctctactaaaataaaaagaaattagctgggtgtcgtggcaggtgcctgtaatcccagccacttgggaagctgaggcaggagaatcgcttgaacccgggaggtggaggttgcagtgagccgagatcacgcgactgcactccagcccaaccaatagtgtgagactctgtctcgaaaaaaaaaaagcagagacaagacaactagtacagtacttacagggttattatgatgattaaatgagagaatagctgtgaggtgattgatatagtgctgtgcttaatacaaactatcattttattatacgggttgagtgtttctaatctgaaaatccaaaattagaaatgctctacagtctgaaacttttttgagcaccgacctaatgttcaaaggaagtgcttattggagcattatgggttgttagatttttgggttgggaatattcaaccagtaagtactataaaatgcaaatattccaaaaaaaatctgaaatctgaaacatttctggtcctaagcaagcattttgcaaagggatacgcaacctgtagtacgttctttatcattgttttaagtagttaatatattgtggtacagattctgaggtggtatagcaaattcgattgtattattaaaaagcatatttatattttgagagcttgcttaggattattggagagaataaaacagtgaagctttggtgttatgagggaattttagatagaaaagtgcagtttttcagttcatgctctttcattttttactccctcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcaggtaggtagagatgccttttgttgttgttgtttttgagacagggtctcattgtgtcgcccaggctggagtgcagtggggcgaacatgactcgctacagccttgacctcctggactcaagcgatccttctgtctcagcctcccaagtagctgggatcacaggcatgtgacatcacacccagctaatttatttatttatttattttttaagagactggatcgactgggcacagtggctcatgcctgtaatcccagcactttgggaggccgaggcaggtggattaccgaggtcaggagttcaagaccagcctgaccaacatggagaaaccccatctctactaaaaatacaaaatgagctgggcatggtggtgcatgcctgtaatcccagctactcaggaggctgaggcaggagaatcacttgaacccgggaggcagaggttgcggtgagccgagatcacgccattgcgctccagcctgggcaacaaaagcgtaactccgtctcaaaaaaaaaaaaaaaagagacggtgtctcgctatgttgcctgggctggtgtcaaactcctggtcttaagtaatcctcctgctttggcttcccgaagtgctggggtgctgggattacagacattggccactgtgcccagcgtttttttgtttcgttttgttttgttttgtttaatagagatgaggtctcactatgttgctcaggctggcctcgaactcctaggctcaagcagtactcctgcttcagcctcctaaagtgctgggattataggtgtgaaccaccacacctaacccaagatgctttcttactgaattttctccaactgaagagttaactaggaggagagacattgatcaggctgaccagttaaataactttcatatgtgcatctttcctttccttctccttccctttccttttcttttttctctctccgactccctcccctcccctcccctcccctcccctcccctcccctcctctcccctcctctcttctgtttcttttctttccgctagtcaagtgaagcagtgggaatggaaaaggaacaaagaaatctgtaactggttgtgatcaattagttgtaaacaccaccgcacttggacgagccatgtgcacctttcttgctaacctgttaaaccacaaagacttaactctttgggactgtggtatctggatcagtgatattttgatagctagaaagttaaactgggccagtgtctgaaagagatgtcagtgaaaacctcaccccttcatcactcagtacatgctgctgtcagtctaacagtcttgctcaggtacaatagcagaaaatactttatagttaattagggagataaggagttaggaaaagtatgaagtgtgaagtgaactcattttttttagggagagaatttatttttgctagtgatatttttcctgtgccttgggatgacatacatctccctttctgcatctgaaagacagatgcaggacgcagaacattgtcttttctcatcctcttacctttgctcagtctatagagggatttaacatcaaaaattaaaattgaatgagtcatgcttcctgtatgcaaaatgtggaagaatctgagattttacataagtttagggcctataaggatgactaaaatattattttgattcaagccagagagttttgccctactctttgaaggagaaaaagataaggaattttcttttccattttggaagtaactaattttttatattgatttattcataggcagtaagctctctggtcactgagtttctttcttggtccagtatgtttgaaaaaaccttgagagttcttttgttcataaaacccaaatttgaatctgctactaagctgttattagtcacatatccaggataaaatacaaacatcattgggtatggtggctcatgcacttttggaggctgaaggaggatcacttgaacccaggagtttgagatcagcctgggcatcatagcgagaccctgtctctactaaaaaactaaaaattagccaggcgtggtggtgcacagcctggggaagagagtacaaaaaaaaaaaaaatatatatatatatatatatatatgtatgtatgtgtgtgtgtatatatatatctctctccaaacaatacaaataatctttgcagtagcgccatcatggttgactgtagcttcaacctcttgggttcagttgatcctcccacctcagccacctgggtagctgggactacaggctcatgccaccacgcctggctaattttttgtatttttttttttttcatagagacaggatctcactatgttacccaggctggtctcgaattcctgggctcaaacgatccagctgccttggcctcacaaagtattgggattacaggcatgagtcaacgtgccctgccttggaagtagtacttatatgtgtgtgtctctgccttccacattgagacctagcacagtacctgacataggtcctctcatttaataaatagatgtggtggccgggtgcggtggctcacgcctgtaatcccagcactttgggaggctgaggcgggcggatcacgaggtcaggagatcgagaccatcccggctaacacagtgaaaccccatctctactaaaaatacaaaaaaattagccaggtgtggtggcgggcacctatagtcccagctactcgtggggctgaggcaggagaatggcgtgaaccccggtgggtggagcctgcagtgagccgagatcgctgcctgggtgacagcgagactgtctcaaaaaaaaaaataataataaataaataaataaatagatatggtttgggctgggcacagtggctcacacctgtaatcccagctagtcaggaggctgatgcaggagaatcacttgaacctgggaggttgccgtgagtcgagattgcgccactgcacgccagtgacagtgtgacagactgcatctcaaataataaataataataaatagatatggtttaagcatgctttgtgtgtcagggatggtgctgacaggtcagtacatttttttttttctttttttgtgttggggggatagagttgctctggtacccaggttgcagtgcagtggcgccatcttggcacactgcatcctcgaactcctgggctcaagcgatcctccagtctcagcctcccaagtagctgggaccacaggtgtgtaccactataccgagctaatttttaatttttttatacagatagggtcttgccatgttgtccaggctggtcttgaactcctgggctcaagcagtcttgcctcagctctcaaagtgctgggattacaggcatgaggcactgcacctagcctattttattgtttttgcaaagaggatctcactgtgttgcccaggttggagtgcagtggctattcataagcacagtcccactctaaaacagtttgaacatctacctcttgggattgttacagaagataaagtagttggtgtaaagtacctgcagtcactcaataaatgttaattccctgttggagaaggaggatgccccaggtgagccatcttcctgctccttagaagagagctgattttaacttgctagtgtcatcatcttcgagttattttgcatctcctcgtagccttcccatttgatccttgtcgttcttctccttcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattggtaagtagcgtggaccatggatgagtgactctaacacacagtgcagtttacggagcagcgctttgtaaatgggcactgcttggacactgtacaggaaatgttaatggagtatgttgaaagtgtttcaagctctgcctggtgcagtggctcacacctgtaatcctagcactttgggaggctgaggcggatgggtcacctgaggtcaggacgagcctggccaacatggtgaaacctcgtctctactaaaaatacaaaatttagccaggcctggtggcttgcgcctgtgatcccagctacctgggaggctgacgcatgaaaatcgcttgaacctgggagacagaggttgcagtgagctgagatcacaccactgcactccagcctgggccatagagtgagactctgtctcaaaaaaaccaaaagtgtttcaagctcaaattttggaaatgtgggaatgaagaaagttaaacagattttttttttttttttttttttttttttttttttttttttttttttggagatggagttttactcttgtcacccaggctggagtgcagtggtgcagtttcagctcactgcaacatctgcctcccgggtgaggactgtggaatttagctttatatatatatatttttttaatttaattttttttttgagacagtgtctcaccctgtcacccaggctggagtgtaatggtgcaatctcggctcactgcaacctccacctccctggttcaaacgattctccttcctcagcctctggagtagctgggattacaggcacctgctaccacgtctagctaatttttgtatttttagtagagacgaggtttcaccattttggccagtctggtctcgaactcctgacctcgtgagccactgcacctggccttatttatatttatatttttattcatttttttgttgttgtcgcctaggctggagtgaagtggcgcaatctcggctcactgcaatctccgtcccctgggttcaagcgagtctcctgcctgagcctcccaagtagctgggattacaggtgcacgccaccacgcccggctaaattctgtatttttagtagagatggggtttcaccatgttggccaggcttgtctcgaactcctgaccttaggtgattcacccgcctcggcctcccaaagtgctgagattacaggcgtgagccaccacgtccagcctggaatttagctttttaaaaacaatttcccatgtaattctttgaagcatcagatagcaaaaagcaaacaaaaccaaaataagtccacagctttttctccagtgttggaaattaaagaggatgtgaaccttgccgttgtgtttatttgtgcagtctagaccctatcttcttttgtgctatggctcatgaacaccccagatttgactcgattggttttcattagtaactggggtcatgtcattaacctagtgtcagtaaaagtgaactgacattaataatttgctttttttttttttttctggagacagtgtctcactctgtcacccaggctagagtccagtggcaccatcttggctcactgcagtctcaagctcccaggctcaggtgatttcccacctcaccctctcgagcaactgggactacaggtccacaccaccacgtccagctaatcttttgtaatgttagtagagacagggttttgctatgttgggcaggctggtctcaaactcctgggcttaagcaatctacctgtcttggcctcccagagtgctaggactgtaagcgtgagccacctcacctggccaataattcactttctgtttgtttgttttgaaacagtctcactctgtcgcccaggctggaatgcagtggcaatgtctctgctctctgcaagctccgcctcctgaattcaagcgattcttctgcctcagcctcccaagtagctgggactacaggcgtgcactaccatgcccagctaatttttgtatttttagtagagatggggttttaccatactggccaggttggtctcgaactcctgaccttgtgatccacccgcctgtgcctcccaaagtgctgggattacaggcgtgagccaccatgcccggccataattcactttcttaagtggaatgtttggggcttctaaacctcttattcctttttaaattttcctttctgtgtctctgctgtccccattttcccctcagctgtggggtcctccaacccttacctgttgagatattataagccctttaaaggcttggtgtggtggctcatgcctgtaatcccaacactttgggaggctgaggctggaggatcacttgagcctaggagttggagaccagcgtgggtgacttagagatactttgtctctacaaaaaatcttaaaactagctgggtgtggtggtgtgtgactgtagtcccagctattcaggaagcagaagtgggaagattgcttgagcttgggaggtcaaggctgcagtgagttctgattgcagcactgcactctatcctgggtgacagagcgagaccccgtctcaaataaataaataataaaattaaaataagccctttaaagaaaatggaagagaaactttagggctaaaagagaagaaaggaggaaacctttttaggaggctagtcactgggctttttgttttctagggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggtatgtggcagagatatttccagggcttctgaaccttgcccatactttggaatcatccatggactcctaatgcagacctactgaatcatagtctctgggaatggggcttaaaaatgtctatttttaagctttcttgggtgaatttagtgcacagccaggtaaggccactaaatatggtgatggggtgcacagcatgcgcagccgtacaaggctgatctgcagctaggatagagaaatgtctgcctaggggactgtttgcagattactgacacaagttcttgggacctcactgccgacacctttctttccaaagccattgtttggcacccttgtaatgtctaatgtttggtttagttcctatacaaaccaaccatggggtttgccaagatagtgaggtatagcggaaagaccatggattttaaagtcagatttgactttatcttgtgcttatgtgtctggaagcttgcttgcttttgttttgggcccatctctgctgcttgttagctggtcaacgtgggcaagtaatttaacctttctgtttaatattccttagctacaaagatgggcgttctggagcacctttccctcggggtggttttacatttgagatgagttactgtagttttaactttgatcctcagcatgctcaggagtgctcagttactaagctattgtatctcagctccaaattcacccttttatgctctgcactactgaggctgaaatgatccaaacctaatttcatctttcacagctggctctcaggctgtgtctatagtgggtgctagagggagaccaaagggcagaggagaggtgagggatttgcttcttcctgtttgctcagtgtggtcagcattgtcagcaaaggctttcacctggtagcagcagttagttacagggcgtagattttttagtccttccagaaccagccagtaactgaactaaaatcagcctgataactcttacctgtttccttttatttatcacgtggtagagggtaaggaaaaaaggggcgagggtgaagctcagagaaggcccccatggagctgggacttagccctccagggaggaggcactgtccggctagctctggatgtatcaaaaaagctggagactggaaccaactgccgccaggtaaagggtctttgctggggcaatacaggtaggaacagtaaatacaggagggccgcaaccacagttttgctttctgcagtttcagttacccatagtcaaccatggtccaaaaattttaagtggaaaattctagaaataacttaaaagcacaatcccacctggggcaggaatcatctgtttgttcagcatctccacactgtaaatgctacccaccagttagtcacttagtagctgtcttggttatcagattgactgtcaaggtaatcagtattgcggtgcttgtgttcaggtcacccttatttaataacggccccaaagcacaagtgtagtggtgctggcagtttggatatactaaagagaaagtcataaagtgcttcctttaaatgaaaaggtgagagttcttgactttaaggaggaaaaaaatatatgctaaggttgctaagatatatggtaagaaggaatcttcgaaccacaaaattgttaagggaaaaaattcattttagtttttttttttttttatgctgaggttgctaagatacatggtaagaaggaatcttctatccacaaaattgttaagaaggaaaaagaaattcatcttagtggccaggcgtggtggctcacgcctgtaatcccagcactttgggatgccaaggtggcggatcacgatgtcaggagattgagaccatcctggctaacacggtgaaaccgtctctactaaaaatacaaaattagccaggtgtggtggcaggctcctgtagtcccagctacttgggaggctgaggcaggagaatggtgtgaacccgggaggtggagttagtgagctgagattgcgccactgcactccagcctgggtgacagagcgagactctgtctcaaaaaaaaaaaaaatagttttttcccccccttctttttttacataaattgagacaaggtctcactatgttgcccaggctggtctcgaactcctgagctcaagtgatcctcctgcttcagcctcccaaagtgctgtgcttaccgacgtgagccaccatgtccggcccaagctagttttcctgttgcacctcaaactgtaaaagttactgccacagtacatgagaagtgcttagttaaaatagaaaaggaggccaggcactgtggctaatgcctgtaatcttagcactttgggaggctgtggcaggtggatcgcctgagcccaggagttttgagaccagcctgagcaacatggtgaaactctgtctctgcaaaaaaataaaaaaaagtagccaagtgtggtggcattcacttgtagtcccagctacttgataggctacttgagccggagaggtagaggctacagtaagctgtgatcacaccactgcattccagcctgggtgatagcaagatcctgtctcaaaaaaaaaaaaaaaaagatgaaggctgggcgcggtacctcacgtctgtaatcccagcactttgggaagccgaggtgggcagatcccctgaggtcaggagtttgagaccagcctggccaacatggcgaaaccccatctttaccgaaagtacaaaaattagccgggcgtggtggcgcctgtaatcccagctattcaggaggctgaggcaggagaaccgcttgaacctgggaggcggaggttgcagcgagccgagattgcccactgtactccagcctgggcgacaagagtgaaactccatctcaaaaaaaaaaaaagatggaaaaaaacattaaatattaaatttatgaacgtatgacatggacaaacatgtttcaattgacggcagtcaggtttggtgctgtccgaggtttcaggtatcctcccgggttcttcaaacatattccccagggataagggatctactgtatacaggaaggggcacccctcctcccttgcagtcttctggaaactgcagagggagtctgttaggcagatgataacaaaaaccagctggtggagttcaagaaatggggcctacggggccccagccccagcaccacaggacataaaaggaagaatttggagctgagaaacaagtgactgcaacacttgaagtcaaatcaaagaaaatttatctcctttcttcaggcttccagctggtctttttaccctttgctgatgataaaaggaagatgccctttactgaaaaaatcatggcaactccagagcaggtgggcaagatgaaggctatcgttgagaagcttcgcttcacatacaggtgagtcaatctcaggctttctggaactgcctcctgagttgaaaatcttattagaaacagcttgggcataggccaagagaatggcactactcttttcagcaaactgacagattactacttgttattaatagttttttgaaagccatatagagaatggaaccttttattatgttggagactctgggattttgtggtttctctgttgtgctgtacttagccagattagttggttgaacaaatttgaaaaaatagcaggattcttattcgcccttctccttgattgtgtttgttattccacaatgagcaaaagtaaataaatctagtgtaaattgttaaaggcttaaaagaatgattaagtaattcaagtcattccctctcacatatataatagaccaactctcagagcctgcataatgggacactaaacgtaatttttttcacatgtcatttttaaaaatttattattattattattattattattattattattattattattattttgagacagggtctcttgtcacccaggtttgattgcagtggtgttactgtagttcactgcagccttgacctccctgggctcaggtgattctcccacctcagactcctgagtagctgggaccatacccttgcaccaccacacctggctaatttttgtattttttgtagggacggagtttcaccatgttgcccaggctggtctggaactcctgagctcaagccatccgcctgcctcagcttctcaaagtgctggattacaggcatgagccagggtgcccaggctggtttgctttctaagttgacttgagacaaagtcttgctctgccatccaggctggagtaccgtggcacgatcatggctcactgcagcctcgatctcctggactcaagcagtcttcctgcctatgcctcctgagtagctgggaccacaggcgtgcaccaacatgcctggctgatttttaaattttttgtagagacagggtctcaccatgttgtccaagctggtcttgaactgctagactcaagcattccgcctaccttggcctaccaaagtgctgggattacaggcatgggctactgcacctgacctcaactgttttacttggggtgtttttctcagctcaccccggacctgtagtatctcaggtggttttattctaattttttcaatgtttaaattgtcatgtttcagttgagttacattattgttttaacagaagtgacagctttgagaaccccgtgctgcagcagcacttcaggaacctggaggccttggccttggatttgatggagccggaacaagcagtggacctgacatgtaaggaggttgaatagagtagttcttttcatgggaggctttcttactggttccactctgcaccagtaatttgggtgcatttcccagtcctctctaaacacttaacctcattccccagaccccctctgtttggaagcttttccagaccagcttaaacagccagggaacagatttggctggttccatagtgagaggaggagagtgtcaggcttctgagacctgcctctgcactaggccgccctgtgactacatgctggtgaaatttaaaaaataatataagaggctgggcacggtggctcatgcctgtaatcccagcactttgggaggccgaggcgggtggatcacgaggtcaagagattgagaccatcctggccaacatgtctctactctgtctctactaaactctgtctctactaaaaatacaaaaaattagctgggtgtggtggcgtgtgcctgtagtcccagctactcgggaggctgaggcaggaagatcggttgaactcaggaggcagaggctgcaatgagccgagattgcaccactgcactccagcctggtgacagagcgagacgctgtctcaaaaaacaaaacaaaaacaaaaaatcaataaataatttaagaggaaataagtggtggatttgggtttagaatccagcgactcgcagccgggcgtagtggcttacgtctgcctcctaggttcaagctattctcgtgtctcagactcccgagcagttggtccccgcccggctaatttttgtatttttagtagagacgggatttcgccatgatggcccggctggtctcagaatgatctattttagacaaaatagccccagtgttaaaagcagaagagttattggaccattgttactgtggtgcctgcttagctgtgtctggcgaaagagaaacgttttgagctaaacagcccatctcctcctttcaggccttaggcaaattcagaagtcggtggcctagtgcctagcaaggtagtttaggacacaggtgcctgccaccaagcccggttaatttttttgtatttttagtagagacggggtttcactgggttaggatggtctcgatctcctgaccttgtgatccgcccgccttggcctcccaaagtgctgggattacaagcaggaggcgctgcgcacggcctattttgtgtttttattagtgattgggtttcaccatgttggccaggctggtgtcaaattcctgacctcaagtgatccacctgtctcggcctcccaaagttctgggattataggcataagccaccatgctcactacttttatttttatttttagtactgagcataggctggacctcagtacattcattcattcatttgagacaggttctcactcttgtcacccagactgaagtgcagtggtgggatctcggctcactgaaacctttggctcccaggctcaagcagttctcctgcctcagccttccgagtagctgggattacaggcacccgccaccatgcctggctgatttttgtattttttggtagagatgggggttcaccatattggccaggctcatcttgaactcctgaccttaggtgatccacccgcctcggcctcccaaagtgctgggattacaggcaagagccactgcacccagcttctctgtacttttaaaactctacagatgattcccagattgggagccagtgctcttgcagaggttcccatgatgtggaccaggggacttctgatgcagcaggagcacagtttggctccagcattgtgccatctaggtacaccagcaagagctcccctccatgcttggcaaatacgggcatgtgagctgcccatctcatcacccttgcccttgatgtgacacagctcatgtcagaagcttgatttaacaatatagttgtaagctaacaaaaaaggaaacaaaagtatgatctttcctccaaagttgccttttcctgtcatacttgctccccctgtttcagccagtcatctccccatcccactcctattcttcttacattctggtttccagctctgtgatttcagttaaataataaatcctattctatcagtaagtcctgccagttctgtcacttctcatgtttatgggtcctcccacccacaccccacttcacctgtcttatcttaccctctttcagttcaccctccatgcagctatcaggggattctttggataaggcctaattccttggcaggcatcccagcttccatgacctcatcatacccatctttctcacctctctgctggccctgtcctccttaacaccctaccttccagctatatgtcacctgctatttctctcccagtgccttctgcttcttatctttcaccacccctcctgtgttccagtgtgcctgtacagtcgcttcttgcatggtgttgcccaactccactgcatcgtttttatccacctcctctctctcactgggctgtaagctcaccgcaggcatgagcacttgtttgaattcccagaatctagcttagtatctccactgtaccactgccctttgggaaagtcatgtaatctctctccttttctcctctgtaaaactggggacaaatcaagaggctgaggcaggagaatcgcttgaaccagggagtcggaggttgcagtgagccaagatcgcgccactgcactccagcctggcaacagagcaagactccatctcaaaaaaaaatctaaaaaaaaaaaaactggggacaaatttacctatcctataggttgttagaaggagtaaatagagtaagtttaaagcatttacaacagtgcctggcggtagtatgtgtaattacagtaaatgcaggtgttggaaggtacttggtaaatgctggaaagacatttccctagacccctcccaccttagcagttaggtgctctctcttctggttctcagagagttctggaagtggacagcaagctggggctcgtgactcaccaggccactcttctgtgttttgattttctagtgcccaaggttgaagcaatgaataaaagactgggctccttggtggatgagtttaaggagcttgtttacccaccagattacaatcctgaagggaaagttaccaagagaaaacacggtgagaagctgaatgtggacatgtgggctatttttaaaaattgcttttatgatagtcttatcacagtgggcaatatcctttcagaaatatctattcacagtctagttaaaatggcttttatccaaaaaacagacaataacaaatgctggcaaagatgtggagaaaagggaaccctcatacactgttggtgggaatgtaaattagtacagccactattatggagaatagttgggagtttcctcaaaaagtgaaaactagagctaccatatgatccagcataccatatgatccagtcagtatatacccaaaagaaaggagatcaatatatcaaagagatatgtgcactcccatgtttattgcagcaccattcacaatagccaagatctggaagcaacttgtgtccatcaacagatgcctggtaaagaaaatgtggtacacgtacacaatggagtactattcggccataaaaaagaatgagatcctgtcatttgcaataatatgttaagtgaagtaagccaggctcagaaagacagacatttacatgttctcacttatttgtggaatctaaaaatcaaaacaattgaactcatggagagagagcatagaaggatggttaccagaggctgagaagggtagtgaggcattgtggggttggtggggatggttaatgggtacaaaaaaaaaatagaatgattaagatctattcgataatacaacagagtgactatagtctaatttaattgtacatttaaaaataactaaaggaatacaattggaatgtttgtaacacaaaagataaatgcttgaggggatggataccccatttatgctgatgtgattatttcacattgcatgcctgtatcaaaatacctcaggtaccccacaaatatatatacctagtatgtacccacaaaaattaaaaatgaaaaaattttagaaaagaactgtctatacaaccatacatatttacacataccaacatacatatttcagcacaaatggaataatacattgttttctagtttgctatttttgttactcagctatatatgttggacagttatttatatccacacttacctatctcattttttaaaaaatgaggctgcagagtagttcattggatagatataccaggttatttaaccagacctgtattgacaggtggatatgctgcagtgaacatgcatttccatcgtgttcttgtgtgaatagatccacaggatgcattcttgcagtgaattgcttccaaaacagtgatttaccctctatccaagaaggagtgaatgttttcctgcactctcacccttccaggacttaatttttttaatttctatttaaaatgatacagaagttggccaggtgcggtggctcacacctgtaatcccagcactttgggagcctgaggtgggcggatcatgaggtcaggagttcaagaccagcctggccaacacagtgaaacctcgtctgtactaaaaatacaaaaattagccagatgtggtagtgggcgcctgtagtcccaactacctgggagactgaggtaggagaatcccttgaacccgggaggcagaggttgcagtgagccgagaccacaccattgcactccagcctcggtgatagagtgagactccatctcaaaaatgatacagaagttatatcctttttttgtttttagacagtcttgctctgtcacccaggctggagtccagtggctcaatcacagttcactggctcactgtagcctcaacctcctgggctcgagtgatcctgcagcctcagcctgctgagtagctgagactgcaggtgcacaccaccatggccggttgattttattactttagagccagggtctcactgtattaccaaggctggtcatgaacctgtaaaagattttcaaaggaaggaaggaatgacttacccagagtgagcaacagttttgggtaaactgatggcattcacactacttgtaatttcctcctaggtgtgatctgtgttttattttgcactttaaatgaagctaccttatcgagataagtcttccccatggtgtcctaggctggcatcacagctttatggttaattgcagcccagattatacgaggtcccccatgccatgtagctgggatgccacttgtatgtagcatttccagtcactctctcctgacctttccccccagataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactatatactgtt

SEQ ID NO: 130 - DNA, 96997 bp, Homo Sapiens
acggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggtataaagaaagccatggacttgggctttacccggactggggatccggagagggtggttcggaagcaggaatcgtgggatcgcggtcaagacaaagaatggggcaagagaagatcatggtggtgggctcagtcaggagggccgggaccgagggatgcgctatgagaaaagctggagatttggggctccaagacctgaatttgagcctcgctgactccacctcttccattacccacccatcccatccctcttctccctctctacctgctctttgtctcacctgcctccccacccgcctcccctctctctctctttatcccattccactccctagccccacttcctctattacttccgagcctgggttcttaagatctctatgagaatgaaaattagctgtgataaagcaactatcccacagggcttgttgtaaaacttaagagagggactatctgtgactaaaataacttaaactgtaaagcgtcgtattattagctttataataacgtagtatcccgcatttattgaaagcccactctgtgagggacggatctaaaccttttattcttatctcatttaatcttcacaaccccttgaagtgaaaactatttatccccattttgcaagtgggaaaaccgaggaataaagaactgtgggcttttcctggtgaaatccggatttgaatccaagctgtctggtttcagggccctggagaacccctgtgttgctagaaatctatgaccattggtgtcccagatcagtaacagaaattacaatgaattttaaagtgatttttttttttcaacataaaagagtggtagttgtctctgaagggtcactagagggagatgtggttccagggattaatgaatttattcaatacagataaacaagatacgagtttgagcaactgatccctagttccctcaactcctcattgagaaatgttgattaaaacgatcatgaacttttaataatgccactcacctccttttttcgtcctctttcagctgctgaaaactttgtagctctagtggaggagctgtttgttgcagatgaactggaagtaaaattctaacagcctgtattgcttcggtatagaaatgaagagttgctatgctacccggtttctctttctcagttttcttactgctgccagataggaactcagaaatatagaccattctgcttccagacaataagttccatatttgaaaccctttgatggcacttactggatacctaattcatgacaaaagtgctttagtcctctagagttttctggtttaaaagtagcttttgtgggtgtgtatcaaataagtgcagcagcatattttgtgactcttaagtttttttaggttatcatgccccaggcattgaaactgggatgtgcattttactgttctcaaaggaattttgtggtttattagcacgttttttttttcaaataatctaattttacttcagaaatctcttagtgcattgtgttgtttgtaaactagtgaaaaataatcttttcttttcatgtgttgcctgagatataaccacatttagaaatcatctataacttccctgataggaattcattcaggtttttaaaacatttctagggtcaagagatcacttaaaaaagagtagtttctttattgatcacttctaaatgttattttttatccctcgtatggagtcgcatcagtctccctgtaacttccatctgttgatcccgttgtctttcttggcagaccaatccttttatacaacagttgtcaaatatctggggggaggccagacacggtggcctatacctgtaatcctagcactttgggaggcggaggtgggaggattgcttaagccaaggagtttgagaccagcctgggcaacacagtgagaccccaactctacaaaaaaaatttaagaattagctgggcatggtggggtgcaactgtggtcccagctatttggaaggctgaggtagcgggatcacttgagcccgggagatggaggcagtagtgagccatgatcatgccactgtactccagcctgggtgacagtgagaccatgtctcaaaaaaaaggaaaaaaaaatggtggggaggaaaactgttatgttccctttaatcttctcatctgacttaaatatctagttatttccaactgttctttacatcatgtattcttcagattcttccctaagctgctcatttcatgttcatttgtaattaattttcctggtaagatgttagcccagaactgctcacagtttgtttgatcggtacaaagcactgcgagactatcagtcagagtcaaggaatgtgaactccagaaaggaccttaaacctcatctagtccaacagtttcctaccttttagtattattaacagtgagattaagtgacattcccaaggactcagaactaatgggtaggagagatgggactagatcccaggtctcccgattgctattatcttttttcaccagaagacccttcttttctcttcttgaattcactacactgttgatacagaccaacatatttaggcgatgaagtaagataggtgtggggaatgtggtgcaaaagacatttcacgttgttgattgattttataattcacactgaaattgtgagttgccatcaatccaggtctcttccagcttgtgttcaggtaaaatttggaagccaggtataaataactttacatgtattccttttaggttatgtttctcttattttcttagtctcctacatacgtgattgctatgtaatggcttgtgccttagcttatgtgattccgtctgtcacttacttgttcacatgattgactcctactcattaagactcacccaaggaaatccacattcaggaagccttttctgccccttcaccgctctggtatcccctccaccagtcttgagtggatgctcctcctgtgtctctcagtgcccagtgcatacttctatcatggaacattgttctggtattatttgttatctgtctgtgtcctctactagaatagatttggtgtctttattttagatcatcagtttacaaactgactcaaattgtcagggtatacctcttagcatatatatagattctagcagtcacttcttgtgacaaaaatgcttcataacaaattatgccccgaatcagtgacttacagtgaaagcatctgttctcatgtttgtaggtctgcaggtcagctgcagtttgtctgatgtatattgggcataaatgggtttaactctggcctgcaggttggcatcatatgtactcatcatgggtttattctggggcttaggccaaagaagtggcagctatctggagcatgttcctctcctggtagaaacttctgtagcttttagaaagtatcaggactatttaagggttttccatagtgaaaatttatatgtcttacacacattcttatgtagaacacatccctttttcacacctttcctaaatactgatacaggttcatgaatacaataagcaagggacattcttacagtcttttcttacgacttattttctcaaacactctttggaactttgtttccaggcagctgttgtgctgtgtatggacgtgggctttaccatgagtaactccattcctggtatagaatccccatttgaacaagcaaagaaggtgataaccatgtttgtacagcgacaggtaagtttcagattgacactgagcttgtaacccatgtttgaactgcttgttgcctctacctactaatgcaagataccagcctccttatagtgtccagcccctctgtttggggggattctggggagtttccttacatgtactcacatacaacttcacctaccactagagtctgatattttttcttccctcgttttggccccttcactagatattacagtttttatcggaaacaagaggcagtaaaaagtaatgtttaaaagcacaatctctagagacagatggcttgggtttgtatccttgctctgccatgtcatttactaaccttctgatgttgaacaagtccctcaacttgtttgtgactagttcagttatcttttgctgtgtaataaactaccccaaaatgtagtgtctcaagtaacattttaaaaattcatcattcatggttctgtgggatgactgggttgctcagttgggtgattctctattgaggcctcttacgcagttgcaatcagatggcagctggggctggagtcacccaaaggctcaactggaccagatgtccaaaatggctcactcacatggctggaagacgatgctttctagtggctgtgagctcagttggggctgtccgttagaatctctacatgtggtttctgtatagtttcaattttcacatgaagcagctggttctaaggagtatcccaagaatgggttttctatgagaccctgcctatgtggcttcttaagacctatttttagaagccccagaaagtcatttctgttttctgttagtcaagcaagacactaaggttaggtcacatttaagggaggagaattagactccctctcttgataaaaagagtagcctgcaaatacaaggagagaaagaacggatggtggctatcttggaggttagctactacagtgcctcagtgtcccatgtgtaaaatgagaataatgatacctgtcacatagggtagttttgaagaataaaagaattaatgtagataaagtgcttagaatagtgcttggaatattgtaaacactatgtaagcatcagctgtttttatttctgccccttctacttggtatgactgccacttttgctaagtccatgagttcctgcttctttcattgtctactgctgctcctcctggacacttctgtttcttctgtgtgtttacacttccgttgggcactagtacttcccacctgtcattctagatttttaaaaatcttgatgacctggagtccttgaggtgttgtgtcaaggaaggtgctctaaccctgttcttggttatagttgtgttggtggaattcaagtagtgtggctgtcccctggtatgctgttagagaaggtaagtagacatgagcagggcaggagagagggcccccgagaatgttgggcatttgtgaagccatggttaggcaattagaaatccgtccctctgaagtgatgagcagggcaagggaggggccccaaagctgtcaggttatcatcgaggggaagacaggcgggcataaaactatcactgtaaggtaataagtggccatgattggtgtcaggaattacaggaatcttaacagacagaaaacacctggagttagcaagctataatccttaaggtttcgagcatgcgcagtaaaagagcaagatggtgaactttaactggtataaaagctgcctctgggggcgctcgaccaataatgccgagttgccgctactgagcatgcgcatgactagtaaccacactacgcatgcggccccctcttaagcagtagcagggctagtgcgcatgcgttgattaattcgggctgctcaagggaggaacaaaggagactggaagcccgggaaaagatggcgccggtggttggggggcggggcggtctaaaaactaaacaaagaagggcgcagggcacttgatttttcacgtggccctcttggttctcttccaagtgtactctgctttctccagtaaactctcactttgcttaaaataaatttttcctcctgctttaaaccttgcttatgtctgtcgtttcaattgtttacttcgagaagaccaagaaccgagattactgcggagtcgccactccggagtttctctggataactgccgacttacaccccagtaacaagagtataggtgtttttttgtttgtttgtttttgttgtagagagaaagagtcagaatcaggaagtcagaatcaggaacttagtgccagtcccatactacattcagaatttcctcccctcccatgactgagattttgtctagggcaagattaccttgccttaagatggatgcttgtctaggcggcagatacctgcccagccagtatgctacgcatgcttgaatccagcagcaggcacccagacaccgttagtccatgtacaactgggaattgttgtgttgtttacagactaaaggattaaacagaccctacaaaaatgaagaatgacagaattccattatctctccatacagcactcttccccatcaatgtaaaaaggcttatgttaataattagacaggactgtcttttgtgtcagatactattttttgtttttatatttcattatgaaatatttcataaaataggcaaatatggagaatatacaggtaaccaattttcccattgtcttatgctgtaaatcctaatgtttcatatttgtttgattttttttttaataaagtgttacagataaacctggaggcccttccttaccctttttttctcttctccttttctcaggattttggtagttattaccatgtatattttatacttggacataagtatatattcataaatacttagtattgtataaagctgtcaaaagtgtaaatggttttatatgctacatgtaattctgcagcatatcttttatcaacttattttagatctattcatgttgatacgtgttgcacaaatttattcatttttactggagtatgatatttcgttgtataaatattctgcaatgtatttttgcattctcctgtttgatagtttgcttccagtttttgccctatcataaacagtgctgaagtgtaaacttcctatctgtacataatttttctagggtatactgtatatgcctgcccctgaaattgctgggatataggctatcctgcacttttttttttaacctctggaaaatttaaaccttagacattccataaagacatactaaaatcttttcacattacccatttttggttctctcattgagaattagagtttgatttcgctggaaatcatcaagaacacttactaccctcctatttccacacctcaacttctgctgaaatgaagggtgagacttatggtcaatgaaaaacatctgttcagaacctaagaattgtcattgtctgtaagtctcatgtttcatcccgcccaatactatatggccccagggacctgccatagggaggtctggttgtcctgctccctgaaggttaggtattttattgcttccagattgttctaatatggttttcagccatctgacatttttttctaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgactgtatcctttttctgccagagaagactttaagaaatttcctttattctgggaatcgtacagcagtttgatgagacacccccagagtttcagctatgagtatatgggtatattttgctctgaggagggggaggtaatgtgttaatagggtttaatgtgaaattaatcagtttaaaacagtgcctgggctcccagccctccactcacttccctgttctctgcatgggtgatactgagaggttgggaggcataggaagggggaagatcctagggagtatatgtgagcattgactatatgcagagggttttagtggtgctcgttagaaatgtttggaggcggatagaaaatatttttagaagagcatcctcccaatgttctctcctttttttctggatggaagatgtttttgtgccagaaatcagattgatacccaaagtgagatttccagtttactccacaggtcccctaattttaagggatcatcactcttgttctttttctaatcagttagtagtgctattcctgatcactgggaagtgctgttgtgttaggagtgacttgcaaatgctacattatggttcgcttcatatttaagaatggactgtggccaccaagaatgggttctagatactattaaatgacataatttttggttaaatgaatgcaatgtgttagattaccttttgtttatatttcttggttgtttttggcagaatatatagtttgatatatagaatgtatgaatatatgttagtgaactttggaagaagggcactcaggcaagtactttaagtcatcacatagttcagtgtccacaatttccagcacggtggacttcattggaaagagttgcgtgttcacatgaagagactgtttggtgatatccctatccttaactagctgagtcctggatgcactaatcgtgagcatggatgtgattcaacatgaaacaatgtaagtgttccaaggaagagagctggaagagaatctttttgcaaaaattgtatgggttaatgtattgaatgtattttgtgattcattgttaatcaagctgcatgtttgtgtgacaagagaaacattttatagaattgaatggttcagtccaacctctctgttttttaaaagttttaaaaggggaagggctgtactcggtgattatttctctggaagaaataaaacatttggcttatttcagtttacttcctattagacttaagctgattaccaggaattttaaaaaacactaagtggtataagccatatgtcattgatattaagtgcatggtaactctggccaacttcccttttttgttgtgtgtgtgtatgttttttgttgtttttttttttttgagttggggtcttgttctgtcacccagactagagtgcagtggtgccaatatagctcacagcaacctcagcttgatctcctgggctcaagagatccttgcatctcagcctcctgagtagctgggactacaggtgcacacccaagtccagctaattttaaaatttttatttttgcagagacggtctcactattttgcccaggttttctcagactcttggcttcaagcagtcctcctatcttggcctcccaaagtgttaggattacaggcatgaaccaccatgcctggcctgcttcctaattcagtatttatttaattattgtgccttggaagtgtatctctggagacatatatgtgcatgtacacatacctcttgcctgtcaggaaaatcatttgcactaaaatcccagacctaaatctgtgtaatcatttctcaatctctgtacatcctctgccaaatcttgccacacaaaatctgtgcatggagtcagagcaggatatttagaaagtgaacctgagcaaggctgaagttagagtatgctgggagaattctttgtttacattctgcctatgtggaggctgggaagggatattttttcatcacatttgagttcggaatccagaaacataacatttccataatacccagacattttggccaagatgttcaaagtataaagtgtatcagggttgattatgaatttaataagaacttaattggactactagaatgtaatcacatttattaactctagatccatttctaagcttctctcctcagtgaccaagtgtatttgaatttgtagaaaaataattcaggagaatgatttcttaatatgataactctctcttttagaggaaagaagtttgagaagaggcatattgaaatattcactgacctcagcagccgattcagcaaaagtcagctggatattataattcatagcttgaagaaatgtgacatctccctgcaattcttgtaagatcctaagaataatgcatgtagacaaatcctatgatttcctaatatagtgaatgggccctctgtatagagtacttggtttatgggaattttcgctttctgctccaaggctgaatctgtcagatgactgactactcagcaaacatttgctggttactctctgtgttctaggaactgttctgagtggtcgtgacaaaaagatgaaagtcagtgatccagaagaattgagcttagtggcagatcattgtttagtgttcttagactcaaagaattgaggattagaagaaccctttgaggatattcaatttgtctccttcctgcatagaaggctttacccaaacaattagcagattgatggatttttttttttcttaaacagctctagagaactgtgtcctatacagagtgcatgttttagggtagacaggaatgccaacttgggaatcattctaaatacataacatgtttatgtttaactcttttcagatccaaaagttgtggacacatatataaaatttaatttgcttctgttaattcagagatggagtataaaacttcaggggaaaaatatgtatttcacaatttattagggagagaattcctcctcaaaaagtaacttgaatattccctccgggatttactttctctgtgttatatccctaacaaaaatttcttttcactacactaacccttcttgctgcatttgaaacatattttttcttgtcctatttttggtgaaagttgagtgatggtatagaatgttgaattattaatcttctgggaatactcgtttttcaaattgagagctatgccaagaagcctctaggttagagtggtaagcctttggcttcataaaatgcctgcctgggggtattaagaacttgttttgcatgtgtgagtagtcttctcttaagactacagagcgacatctcctttctgtacgactgtggaaaaagagttcagaataacccatcaaaccaatacttgttaagatggtacttcagagaaattaagtgcttttaagtgacacttcttactgagttgaggtttttctcagtacttcagaagcccagcacagcttctggtcctttttcataatctcaggatgcctttacatgttagaagcagactgcatttcagtgaatgtcattcgaaagagctactctttttttccatgagcaatacagaaaagtgcagaagaggaagcatagcctttgcttctatttgctttttatttggttgtatttttttcttggtaatatgctttcttcctgtgctacaaacctccagcatacaaagtagagttcatagttttactgtttggtgtattccatgtacagctgattgttgtaattggactaaaaaaataccagcagctcagagaagccctgtgttctgtttttaatttatttttaatttttttttttagaaacgtcttctgtagtggcatagttatagctcactgcagcctaaaactcttgggttcaagtgaacctcctaccggagccttctgtatagctgagactatagatgcatgttaccacacccagcagtttttagtttttcttggttgttgtttgtttttgagatggagtctcgcactgttgcccaggctggagtgcagtggtgcaatctcggctcactgcaacctccgcctcccaggctcaagcagttctcctatctcagcctccctagtagctgggatttcaggtgtgtgccaccacgcccggctaatatttgtatttttagtagagatggggttttaccatgttggccaggctggtcttgaactccggacctcaagtgatccacctgcctcgccctcccaaagtgctgggattacaggcgtgagccactgtgcctggcacagtttttagtttcttctactgactactgaggaagcttatttctgatctaacgcagaatagacagaacagttattatttctttttccaggataacttcctttctcttcacttttacgacatttgtccttttctggttattgctttgaaaacaggagtaacctgatgcaaaccctgtgtctcacactttcctccctggaaactttttacctgataaatgcaggacatgcaaattacatcatgctgtatttgctaagtatatgaagaaaaattgtaaacagccttattttaagtgtagcaaataaaatgagaaatcaccttaaaaacaaatttatttctcacagttctggaggccgggaagtccaagatcacagcactaacagatttggtgtctgctgagagatctttgctctcaagatggtgccttattgctgtgtcatcccatgtcaaaagggctaacactgttctcacgtggtggaaggacataaaaggcaaaaatggcaaaaagcctctcccttcaaccattttttttaaggtcgctaattccatttatgagttccccaccctcaggacttcattacctcctaaagggcctctgtcttaatagtatcatattggtgattaggtttcaaaataatgattttgggggacacgtgtagaccattacagtgtggaagaggccagtcggagagagtgaagccagcataaaggcaaatgaaggtaaaatagagacagagagagtaatccttgccacagttgagaccctgggtctggacttcctaaggccttgtgccaccctgccctttcagttacttggttatgtagtagccagtgattttccccttttacaaaccaaagaggtttcagtcacttgaaactgggagaatattggctaaggtaggtaagagtcgtttgacagatgagaaatttgaaacttgaaaaggttgactgatgtgctcattttctcatagctgatgagttacagttacaggattagaacactaactactgttgatctttcttaatagcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcaggtaagaattgaaaacattgatgggaatttttaattgtacccacgtaaatttctcttttgattagaggtctcccaaatgtttcctttttctgggccactctctaattagtcattgcttaatattctgagttttattaaagaaatagtacacccacccttaatcaccctttttaaagtttgtgttcttggcacatgtttctcatttatttccaggacctgtgtcagtgaagttcaggaatatatagataccatgagaaattaacaagtcaaattgcaaaagatgaaatagtagatttcttcattatgccaagcttgggatacattttttgggcccttttttttttacacatctacaaaaaacattattaattatagaaagtggtctcagatctgagatagtcagtatcttcttatcatcctattaaggttttagaaagtagcatactatggtatagtgattttttttttaaacttttgatcacaaagcagtttgattgagtgaaaaaaaaaaaaacctgcaatgtaaagagttcatagcctacttactttacgtgggcgttggaaaggcaaaatgatttaagaaaagtgaattccttgaagtaccgtataacaataaagcaaactgctttttcaaccatccagctagagactatggaagagaccatctcctttatccatcttattcttggttggaattggacatacatgcattttgagcaaagaacctaagaagaatcggtggcatctagaatagtgtgtgtcctatggggttcaatttggtaaaagtggcaatagagtactttacatagcagtatggcttgggtggttcaaattctcaggggtaatactgcttgatattcttgaattatttccagcttatcagtctgtacacaaaatactggctgtttaagcacattgaagtagtgattgaacaactagaatttttttaagtagctacagtgtatatctccttaatattttttctaaacgaccatttttaatatttctgatgagctataattgacaaaaattatgttctgattttctaaatacagacagccttgaaaaatgataggtaaatttaggaaacagaattgcccacgggattgccctaggaatcagtgaggaatcctgtgaggtgaagtttcttggcgtaatgtgttcttgtcacaatatttacagatatgtgttcctaagttgtttctctttcaaattttggaataaatgccttaagctaaacatattacccatgatatcacaaagaaaaattaggctggacacggtggcttatgcttgtaattccagcactttgggaggctgaggtgggcagatcacttgaggtcaggagttcgagaccagcccagccagcgtggcgaaaccccgtctctactaaaaataaaaaaattagctgggcatggtggtgcatgcctgtagtcctagctacttgagaggctgaggcaagtgaatcacttgaacctaggaggcggaggttgcaatgagccaagatcatgccactgcactccagcctgggtgacagagcgagactccgtctcaaaaagaaaagaaaaattagaggccaatatagattactctttaaaaagtgtttttgtttgttttttaaatttttctgtagcatatcagatagggaaattactgactatgcattgttttagcatttcgacgctactttgattttaggtctgccatgaaggtgtagaccagaactttgccatccagtacagtagccattagctacatgtggctatttaaattcaagttagttaaaattaaatacattttaaaattgagtcccttagtcatattatctgtgtttgaagtgtctattgggctagcatggttagaaatagaacattaccatcattgcagaaagttgtactggacagcactggactagattatctccatatagatcttaggaagagaacttgacatctacctgaggagattgagctctactgcagaactgagtcagttgttcttagattttttttgagacagggtctagctctgtcatccaggctggaatgcagtgacgtgatctcagctcactgcaacctctgcctcccaggttctagcaattctcatgcctcagcctcccaagtagctgggattacaggcatgcgacaccatgcccagctactcagatcttatatattggatgcccgtctttagaattttccctgaaatagaatctaaatctcatggtgattttaggccatgaggtttatattctgtttgactagtaatgttgtatgagacacgttagacctggttcagacccattcattcctcagcaaatccaaagccattgtgcaccataggctttggaagctgggtgtcaggtaagatatctactattcgttgtaaattatttctgaaaattggagtctcttgcgacctgtctgtccataactctgtggataatgtaaaataattctctttaccactttgtagatctgttttttatctgtaccaaggagttcagccagaaagtctggactgtatgctttgagtgtattttgtcattaatttctttgctgcttattttagtgaataccacaaattccacctatctcctatcatcttccctgttgtgtttgattatgggccagatgaaaatatgattgattttcacttttgtttaaatgaagcagcactccacaacactgtttgcacctctccccagcttttcccaccagtaagaaacctagagttaacgtgctttaccttgagactaaatatgaactaaattcctttattccttggatagtctttaactctcactattatatacatataaaaatgtgtatctttaatattcagaattggaattaatgaattatagagttgtaaacagtgatgataattataggatggtgccctccctttgatactctagaacagaggttcttttttttttccttttttcttttttttttttgagacaaagtttcattcttgttggccaggctggagtgcaatggcgcgatctcagctcaccgcaacctccgcctcccaggttcaagtgattctcctacctcagcctccctagtagctgggattacagccatgcgccaccacacctggctaattttgtatttttactagagatggggtttctccatgttggtcaggctgatcttgagctcccgacctcaggtgatccgcctgccttggcctcccaaagtgctaggattacaggtgtaagtcactatgccggccctgagcagaagttcttatcctcaggtccgtggttttcagggagttggtagtgaatcctttatattgtgtgcagactcattcatgaatgtgcttttatcacatcctcaaaggtgtgctggtcctgaaaaaatgttaagaacctctggcagagttgaaataaagtattgaataagaggaaaatagagctgttcattttcacctgttagtaaagtaattcagctcctcttcccttctaagccaactcactcttgccctggctatatctcccaacttgtggttgttgttttccggccatctcctgctgtttctctctttataattaacattagctcacttctcattgtagaaaatcaaatgcatcatccagcacaagttaacatttaaaaattgttgctttcattttatatttttctttattaagtgagagtctgagaaaactgtgcgtcttcaagaaaattgagaggcattccattcactggccctgccgactgaccattggctccaatttgtctataaggattgcagcctataaatcggtaagtggcaggtacacatttttaacagaaatgttaccaggcagataaatatgtgtatataaggaacagacaattcatgtgtgtgttactcggaaccataattactgcttttctagttgttctccctgctcatttaatctctgtttagctttttgtgtaaaaggcaggctaggagaggaagtttaaagaattgtctataatagagtttgatttcctcctcttttactttctctccattggtaattgattgttaatcataagttctaggcctgtctcttttttttaaaagaaagaaaatgaaatgcattaagctgtgttattgtagtatcatagcagaaatgtagataatgcaccaaagttaagttcagttttggagctcagtgacacctaattcaattatgaatgatctgatagtaacaacatctgtgaaatgtaaaaaaatgttttgttactgtaaaattgcattttataatatatgtacatttatatacaatagcacactttaaaaaatgagttgcttttggtgattatttgatgaaattctagtttgagtaggaatctgatgcgtgccttcatataagcctccttgcctttttcctttaagtgttcaaaataaataggaacattttagacatataaaataaatatacaaaaacatgtttttatgtatttagtttttttctttgtatattaaagaacttaattccaaaatacatgatatatctgtgagaaccttggggcagttctttatttatttcagcttccatcaaagcctagaatagtgtccctaggaatgtgaatatagtctccctcctcttttattttggcctgcttttcaaatttctttgttgatttctgacacagatatattgcttcttttttttttttctattggaaactatgataaaatgtatagtcctctttttattaaacagtctggctgggtgcagtgactcatgcctgtaattccagcactttcagaggctgaggtgagcagatcactttaggccaggagttcgaaaccagcctggtcaacctgtctctactaaaaacacaaaaatagccaggcatggtgatgtgcgtctgtagtcccagctacttgggtgtctgaggcatgagtatcacttaatcccgggaggcggaggttgcagtgagccaggattgcaccactgcactccaacctgagcgatagagcaagactctgtctcaaaaaataaaaataaataaataaaaatattagacagtctgaggttttgtatagaaagtgtgaatgtaaatatttgtggattacttttgggagaaaatgaaatgtagagaaggttatccagtatattttgttatgaaataaactaaaattttcataataggcatgagcaaacaaaataatggagctagagtaattgttctggatttttgtctgtgccagagagtgtattaggttttcatcttctatcaattggaatcctaactttccttgttttccctttgtgttttggaatgtaagattctacaggagagagttaaaaagacttggacagttgtggatgcaaaaaccctaaaaaaagaagatatacaaaaagaaacagtttattgcttaaatgatgatgatgaaactgaagttttaaaagaggatattattcaaggtatgtcagtaagagttttcactgttgcctaaaagacattttcttcaacatgatgtgatgcaggctggggtttgtattattctttgtttaaagttatttctttgagttatagaaatataacagtttgaaaggataatgagaccctaggtcctttagctcatttgttgggtcttaggcaggttgcttctcaggagtacacttgggtgttccatctctgtgagttttaaatgtcttaagtgatagtactcaatacttggctttattttaaagtttgaaactcactagctaggagcatgtttaatatggttgaactaaggtttttttgtttgttttatttttgactttcatggtgattattcttctaagggccaacttcaggttttatgtcctaccagatatgcttccttaatttaggggctgaaaattatttgtatttattatattgcttcatattaaataggattttttaaaagttgtactcctatgttatacccatttggattgaatagtgtgtctagatggcatctttatccagaggacttagaaactagctgaggatatctgtatgttcaagacctaaaattattaagataccaaatgatggttaagatagaaacaagagtccttagataaatgttttgccaggctattcactacccagtatagttttgatttgcaagtcttgaaaagaattcttttcctctgtgacactgtatttcatcttacagtgtatatatttgtgtgtgttggaggagggggttgtttaaaggtggtggtggttatgattccttcctttctcctgatggattatatgtagaatataattaataccctacaatttctaccagttcttgaattcaattctgtagcatagaacatgaattttggaatcaaacctgggttagaatcatggttccatcattggttaatcatttgatcctagtataatgactggctcatagtaggaagaatagcatgattaaagccacaagacctggaaagtagggggacttctcagagatactaagtagtccacttgggttggtgtattgagcatatacaggttagtacttgagggtaacatctaatggacagcctgcattttctcttttaatcatcagcgaccatcttataaagcaggcactctttgttatttccattttatagataagggaactgaggctgaaagacactcgttcacatattcaaagccccacagttctcaactagcaggacttggatctaggcctgtactgcttcagagtctgtgcctgcattctattctgaatttggactgagtaatgaagggctttggataataggctaagagtttatgcataaccttgaaaacaacgtggagccacttacagttttgaggaagagaatgtcactggggctatattttaagaagattaatatgacaactggttgtaggatggattggaaggagaaggatctagtgataaggatggatgccagttcttttggttgtcagcaaggaaggcatccctggttatcttaggcaaaaaggaaatttattgctggggcaatggagagggaagagttaaaaactgcttgggttcaaagagcgtagaagtgcatcttttctcctgtcctccagtttccagcccctaatcagctagaggtttttgctttttgttttttgttttttcttgaactaagggaccagtatacacatgtgggcaaaggaatctggttaaatgttgtagtctattgtaagtatacaatgtacaaaagttggagttatatgccatttcagtagatgaaccagaaaacatgaaacagttttagttagaatgttcattacaagttacacaattcacacgattcaagtaagatgatgactgatgacagagattaagacaaacatttggtttaggtaccagtcttaatcatgtgccatacatttccctgttaattttttgttggaaagtttggttttgtcactagctttttaaaaaagacatacatggaaataaaaatgtgtttctattttgagacggagtcttgctctgtcgcccagactggagtacagtggtgtgatctcagctcactgcaacctccacctcccaggttcaagtgattctcctgcctcagcctcctgagtagctgggactacaggcgcgtgccaccatgcctggctaatttttttttgtatttttagtagagacagagtttcactgtgttagccaggatggtctcaatctcctgaccttgtgatccacctgcctcggcctccccaagtgctaggattacaggtgtgagccactgtgcctggcctaaaagtgtgtttctttttaataaaataaatgtcatcaacagactaacaggaacaaataaacactagatcacagaatctgtccctggatatgaaagttttattgtgtcttggggtaaagatgcatgtgcttttcctttgcatttgtccaaggccagaatccttggattttgatgctccttcttcccacaaaacatagaagatactgtgtattgaaagggtgtgatttttcatagaatataggctacagaacagggctggactttttttttttttttttaagaagccgagagcctatgtttatataaatatcctatgtaattaaaaagaaaaatacagttaaatcccagaaataaaagaaatttaaatatagaaaaatatataacttatcaattgaatgtttccaaacagaagagttttagcttctgtcaggcattgcatatctccagcatacgtttttgagaacattttgttctgaaaatttcctgttggcatttttctctgtgggtctctaggtttctgaataatgtgttcttatgtttacaaatcatgctgtactttagtcaaccatggtttatctttggaggataactagtacgttaacatttgccagattttttcttttaggctgggtaatcattgagctaactagattgcaaaatatgctactttaaaaaatgtaattagattttaatcatctctatattgtatgtgtggtttgtgtatctgctgctgctttttcaccattgatcacaaggggcagtcatctgattccagggaatagaagatggaggcttgctctggcgtgtgcgtgtgttgttaatgtatgcatggaactaatttcagcttgtagaaaatgaggccccatatgcttaacagatgctcttctctttttctccagggttccgctatggaagtgatatagttcctttctctaaagtggatgaggaacaaatgaaatataaatcggaggggaagtgcttctctgttttgggattttgtaaatcttctcaggtatgattgtgaacaaactaaatgagctttttcctagctgttatttgaaatggtatgcttttgattggtcattttatttataaggtatatttatttcacttttaatttttctaaaatgtagtctgggggttaatgttgccatggtatgtattttatacattgggaaactgaggttcagagccgttaagtaaatctatatgagcatagcaaactaaaaatacaggatggtttttgaatggggaatggaagcggagatgaggggtatttgaattatgtgggcctaaccctcatccctttgaggttcagtcttcttgagctggtattatggtgaaagtgctcataatgtctcaactctagaggtgggagggcataaaaatgcatgagaaacattgcccaatacagcacattgcatgttcttgaaaataaaccgcaggctccagatttcatagatcagacaaagttgatcttggtagataagtgcaggtggttatgattttcagaactcttcaatactcattttctaatctggtattagtagagctgtcttgacccctcttgatactgtgctagataagttaattgaatttaagggggtggggggagagacatgcagtacttatttttgatttaatttctctttctttcaacccttcccctctaagtcttcactcaagcctctactgttcatcagtgcctcagtgttactcttaggaggaaatgcaaaccacttagctttgtttttaggagacttcatcatctgatctttgttaatctctgtaatctaatttttcacctttcctctcacacagtggcactgtactactccaagagcagttctccaaatgtaccatgcttttacagcactccagacttctattgatactgttttctctgcctggaacgcttgtgcccagacttttctcttagttcctatttgtccttttaagtctcgacttaggtgtcaccgtttgcagaaaccttccctgatccctcatgaccaggcttggtgccctccttatgtgctcttaaagcaccatgtaaccctggaccataatactacactgcagttaatttcatatttatctattgaagctcctcaagggcaagattatgttttgttcactgttgtgtttacagtgctcagataatcttgaacgcatgctgggtgctcagatatttgttgtgttgtattgaattaaacttcaggtaataaggtgtttttagtatctgaatgtttttcagtaagaggattttgaatggaatttcttggcaatgtgtgtcatggttatacatgttacttattttggatcaaaagcaattcttttcctctcttgtaggttcagagaagattcttcatgggaaatcaagttctaaaggtctttgcagcaagagatgatgaggtgagttggcagcaggtctttgaggtagtgctacagaattgaattgtaagtctatgaaagcaagttgtttggggcttttatagtttaaaatgacatgaattcttgcaataggagtggggaaatccactgatgtttaactgaaaatggagatgtggtaaatggatttgtgttagcatgagcacaagacccgaggacatggagaccaaggaagtattaaaaacattttgaaccactgcatttaggaatgggaatttcacagtcaaatgttaaggagggttggggtcaggttgacattttgtgttgtcataagcatcctggatgtgcacttcagtgactcactagactgcttttgtcattgaggaaatgtgtcttttctctattcctctctcttggtactcttcctgcctccccaagatactctgttttcaggctggtttttctctagctaacagcctatgactgctgcattctatactcacatctgccctttctgtaaatatttactgtttgatctccaagttagaactaactttgttggagatactgattttaactggaagattgcaatctactatctgtttaaggcagctcaagcaggtttccaagttcctgaagtatttgcatttgtaattaataaactggatgtagaaggcttgtttggggtgggggtagggtggtggtataactagtatagttctctttttctcctcacttctggaaggtagctggttgctgatatagtggatgggtatgccattattatctcagaacagttaagggaagaaaatgtttggcttctaccctgttctgaatgaattattagagcacaatattagcatacatgaatcttcaaatttgagaatcctacttcatggatttctcttgaatcaaatcctgttgggaatcatggaagtctagtatatactgtcaaaccacaacttagctgaagttttattttgttttgtttttttaagagacaagatctcatatgtttcccaggctggcctggaacctctgggctcaagcgattctcctacctctgtttcccagatagctgggactataggtgtgcgccaccattccttgcttctgctgaagttttaacttccacttactgtctctttatgcaaagaacattctgatcacttcatgagacttgctgggtatgcagtgaggaatcacaaagttgtgttgagacacacatgttgggtaatgatgtaggcttgctagctaagggcagccttgtggattgtgtaattcaaatctggccttatacaacactaatttctgtatatcataggatcactttgagataactcaagaaaaacagatttatctcctaatggcaaagggatactctctagtgtcagtttttgaggtagtcaaaaaatgataatatctaattggagcttctgagataagcaagggagtaaggaaacaatgtcatatgaggacttccagtaaaacaaaacaaaagaatgcctggagaagacttgtgtaggtaggcaggggtgtaggagggatggcagacataatagcactcttcatgcatttggagaattatcttgtagaatagaaattaaactctgcttcgtatcagaggggtgaactggaaacagcaggtggtgctttttgttcaagatgaagaattattttgtcaacaaggattactgtccccactggattgttttcttgtaagatgatcagatccccatttctgtaagtttacaataaaagtctttatcaccactagtcagatgtacatgtggattgttaaactagatgaatactgttgttttttagctcaaatattctgattctttggataattccctctttaaaaagttttctctggtcattagcatataattttttgtattgagaatctatactttcatgtgctgatttgcactgtgtgtagaaaacaaggagggaaaagaaaggaaggaaatggagctttagttaagttatacacagctgtagtactgtttcaccatgtagcagtcattcacagccccatccttccttcttgtttttttttttgttttttttttttgagacggagtttggctttttgtagcccatgctggagtacagtggtacgttctcggttcactgtaacccctgcctcccgggttcaagtgattctcctgtctcagcctcccgagtagctgggattacagatgcctgccacaacgcccggctaatttttgtattttttgtagagaagggggtttcacgatgttggctaggctggtcttgaactcctgacctcaggtgatccacccccccccctcctcggcctcccaaagtgttgggattacagttgtgagccaccgtgcccagccccttccttcttttaaacatcctaattggtcctgtcaaagacatataaataaaaacttcaaacaaattggaagtaatctcttcctcagattctcattgtgcttatctagccctttcttatgggacttaactattagaacatacatgtttcatatttgctacatatctcatttctgctaataaagaatgtattaggtaagtgaggtcaaggacttggctttgttttttcacagggctcaagacagtgcctggcaaagaacaggcactgagtaaagtagcctttgaattgaactgaaaaagtaatgattctgttatgaaatctgtacaggattctaatggccaggtcttggggtcatagtttttttgtttgtttgtttgtttgttttgtttttacaacagcatggctgggaggtcataggtttttaactttgataaggttaaccgtgatagtgagagaagtacatagtgtttggggagtttctgcagagagagagagagagctgactaaggtaaatctggaatggagagggtatcaatttactaagcctagagaaaaggttagaagctggagagccagagattagtaaaggggcattctagctaggaggtaatggtatgagcaaaggccaagtatgagacctgcccccagtcagtgatcagctcagtgatgccagaatagaggaacgactggaagggagtgacgtgatgagctctgggaacagaggtggctgtcagggaagagatggatttgagagacagtatagaggtagaattggtagtttcgtgaacacttaaaaggtgagggatgaggcccagcactttgagaggccaaggtaggtggatcacttgaggtcaggagttcgagaccagtctgggcaacatggcaaaaccccatctctactaaaaatacaaaaagttagctgggcatggtggcgcgtgcctataattccagctactcgggaggctgaggcacaaacattgcttgaacgggggacacagaagctgcagtgagccgagattgtgccactgcactccagcctgggggacagagtgagactctgtctcaaaaaaaaaaaagtgaaggatgagaatggtgcggtggcattatcaaagaccggggtttccagtgtggttgattaggcaatgatgttaatggaaatagggaatccaggaggagaatgagggggaaagatagtaagtttaggttttagtcttgtcgtggtgaatgtgaacagttcatactgaacagtttgagataactgaagatgccatgtcagatatccaccagctagcaggcagtctaagtctagatcttaggagagttttaaaaatgaatgtacaggcctggtgcggtggctcacgcctgtaatcccagcactttgggaggccgaggcaggcggatcacctgaagttgggagtttgagaccagcctgaccaacatggagaaacctcgtctctactaaaaatacaaaattagccgggcgtggtggcacatacttgtaatcccagctacttgggaggctgaggcaggaagatcgcttgaacctgggaggtggaggttgcggtgagctgagatcacgccattgcattccagcctgggcaacaagagcgaaactgtgtctcaaaaaaaaaaaaaaagaaataaaagaatgtacagatttttgattcatcaactcatgggactggatgaaataatccccaagtagaattttagagtgagaggaggagggaaaggtctaaagtagaatttacaaattggtggagaaaagagaataatcaggggagaatgttgtttttgaagccatgaaggagaaagtatatagagacagtggaatggtgagatgctactgtcaaacaaaaaaatcgagaaccaaggagttggcaattagaaggtgatgggtgacttcagaggataatttcattaaggaagtgggggcagtagctggactagactgaagaataataatgcactaagcagtggaaacagcatgcctattattttaagaaattcagaggtaaagacaggaaagatactgatagcaatttgtggagagggaaggacaaacaaaagatttgtttaggagggctgacatgagtttatttttagggtaaagataaaaatttagagaaggaaggttgaagcagtaagacggatttagttaatgaggttaagtcccagaagagctacagtaaatgtaatcaaaagcaaatgtgtgcacttcgtccttcaagtcagggggcaccctaaaaaatgtaaaatagaaagaaagtgataacagtcttaaagtattgagttctgttgtgaaaactctcacatgttgaatatgtgttaatacatccatctttcttaccaggcagctgcagttgcactttcctccctgattcatgctttggatgacttagacatggtggccatagttcgatatgcttatgacaaaagagctaatcctcaagtcggcgtggcttttcctcatatcaagcataactatgaggtaaaacccaaagtcttaatgttattttttttcttcagttcctttattctaagcagtgtttctcagctgttaatgttcatgacaattacttggggatcttgttaaaatgcagatcctcattgtgtagttctggggcagggcccagattctctgtttctctcgagaaatgctgatactggtctgtgaaccacactttcggttggaggaaaaagtatacgttataaaaataatataagaatcttttaattataaagtatcataagaatctttttattaagtattatgaaaatcgttttagattaaaagaataatcaataaaggttcaccatggccttttcttggttctcatccttcttgacttattggaaccaaatagagaaattacctccatttttacaaatgagaactatgaataaaggctgaggatatgattttgttgtgatctttgtgaaacggtttatttagggctctcttgtgtaaaatacagttctaaattccttatcatttcctctgtctcagagaacttactgtggccgaactggaaagagaaggcacatatcttgacttccaggtcaaccttctggtcaccctagtcttctcatttgttgtattggtcatgcatttgatagcagtcctttagtattcttttatacatttctcttatgcttaatattctttatactgtttgcagttgtgaacagccagtagcagaagtcaaaacacttcacttttcatatgccagagttgggctgtccgatttttgaaatatttctgttatgctactttcacagaatttgggatcagttttatattttttcattaatttcatcgtttctgcttttaccccctttctttctcattagtgtttagtgtatgtgcagctgcctttcatggaagacttgcggcaatacatgttttcatccttgaaaaacagtaagaaatatgctcccaccggtgagtttgttttcatttagatcactcattgactacacacactgttcttgggaaatcacctgtctgctagttgttggttggggctaggtatttatagggtgcaattagttggatttccaatcatacacttagacacagtaatgatgaaggtggtttacttggtgtttttccagtagtagggataggtttgccttaaactcacccaacactgtctagtttttgccttggagcatgtacctaggggaaagcttgatggtaatggatgtccatctctagttgtgagcagagtttgcccctgccgaagtgaatctgagcagtatcaaacctgtgactttagtgttctgtgtaaagtctgatgtagctttgaaatgaaaagtgacagtgctgaagattaacttttctctttgccctgtttttgtagtttgcaccaacagtccaagtctcattgttacttatttctggcttttaggagttacttcaggcttgatgtgaaagctcctgattgagcatctggctgcaaatgtcagggtcctatatagaattattcttagagccacaggtccagtcttccagagagcctgtcatttaaaacaattgtaataaaatataatagggggcagaagtagaaaacataccaaaaagaacaacaaatgatgagtagatgttttaggttacaagtttatatataatgtctgtgtctgtgttaagattagggaattgtgaggtgagtctcggaactcaattctttctgttattttggctagaccctttggaagtagtgtgctatagaaaggccaagaatcagatgggtccctagggcctgtatctttatcttccttctagaaatgagtctgtctgcatcacggtggaggcaggcatggacctgattatatggaagttgccactgtattacagtattactctgtctctatttcctgataattccaaaatttaaatgagtagaatatttaattatttatttatttgagacagggtctcactctgtcacctggctggagtgcagcggcgtgatcatagcttactggagcctcaaactccctgtgtattagttcattttcatactgctgataaagacatacccgagactgggaagaaaaagaggtttaattggacttacagttccacatggctggggaagcctcagaatcttggtgggaggcgaaaggcacttacatggtggcagcaagagaaaatgaggaagaagcaaaagtagaaacccctgataaacccatcagatctggagtgaataaatctatagacttattcactatcatgagaatagcacaagaaagaccagcccctctgattcatttacctccccctgggtctctcccacaacatgtgggaattctgggagatacaattcaagttgagatttgggtggggacacagccaattctggctcaagcaatcctcttgcctcggcctcctaagtagttgggactacaggtacgcgccaccgtggctggctcatttttaaaattgtttgtagagatggaatctcactatgttgttgtggctggtcttaaactcctgggttcaaacaatcctcacatctcagcctcccaaactgttggaattatgggtgtaagccatcacgtccagcccagaatatttttaaaaacccagtttattgataatttattttgtcgacataaatcactcaggatctgaaacattaaatatcttctgttatctattttctgtgagttaacatttgtttacattttctccattggaaaaatggaacattaaagttatttcatgtatttcccagtagatgtctatgtaggaatgcaatgccaggatgatctggcctcctgctaccttgtagtagtaggtgaaaatcactgaatgttcacatgtacaagtactgccccctacctgttgctgggagggccttgaattagcaagttcaagatggtgttggctgtgccattgcctgaaacctccatggtttcaccatgaaaagtccataaatgggtaaaaaagaaatatctgatgataaatatctgtatgctcttttattttgttgtagctgtacaaaagggatatttgaaaaggtgcagaatagaagtataatgtactttttaggaactacttactcttttccaccttttgcctggtgactgtgaatgttccagaaatagtgcctcaggttcaacagctgaactgctgtatgaatcagtaaaatgaaagttacacacagtagtttaggcagaagtatttttgggagaattgcctttcgtccatattgctttgggctgtaccatttttattgactgagtagatttttattgaggagcacttgttttttattagtattaggagagacctaaggaaagaggatgtcgtatttctgctctcatggaacttgagagtttgaatggagtagggcaagacatgtacgcaggtgtgagtagtgtcatggaggcattaagagaggagagagcttattcagcctcagtagattgtgaaggaatcagctcaccctgatccaatggtgtcttcctgttaaggtgctgtactctgataaaagttatattaaagtcattaaaatgcttatgcttcattaccagagaggttttttctttttaatgtttttcttctttagctaattactagtttttaaaatattagctcaatggatactaaatattttgttccagtctccttatagggattggtttttatatggctgtattcctctgaaacaaactttcttgcttttgatctgatactccattgtcagaggctcactgaatggtagaactggaacctaatcagtcagtcactctaaatcgatcttttcatggataagaaaaccaagacttgggttaaatacgtgcatagctagagaatactttggcagggccaggactgtataacctgccaatattgccgtggatatctctacgtagaaagcatttgttttagtggagaataatggaaataatcatttttctttcggcttctctgtttaagaggcacagttgaatgctgttgatgctttgattgactccatgagcttggcaaagaaagatgagaagacagacacccttgaagacttgtttccaaccaccaaaatcccaaatcctcgatttcagagattatttcaggtaagagaagaaggatgaacaagtcatatttcttttaaatgaaagagagctaagtgcaaagttgcggtaattggccagtcctaaataaatgtcttttttctctgaaggccccatttgctctatttaatggaagaataacatcttcctctcctacttcagaaggtaaaaatattctgagctcttaaaaagaaaaataaagttggaatgctttctttcttttcttttttttttttttttttttttttttcctggaagaagcttactttaacaaaaaaaatacaggaaggccagttgcctatgctggagtgcagtgttgtgatcatagctcactatagcctcaaactcctgtgctcaagcactcttcccgcctcagtctcctgaacagctgggattgcaggcacatgccaccatgcctggctcatttgtaaaaatttttgtgaagacaagtcttggccacgtgcggtggttcatgcctgtaatcccagcactttgggaggctgaggcaggtgcatcacttgaggtcaggagttcaagaccagcctggctaacatggtgaaaccctgtctctaccaaaaaataaaaaaattagccgggcatggtagcacgtgcctgtaatccgagcttctcaggaggctgaagtgggagaattgcttgaacctgggagatggagagtggagttagccgagatcacgaccctgtactccagcctgggcggcagaatgagaccgagtctttaaaaaaaaagaaaaaaaaaggttcctaggctggtctttaactcctaggctcaagcattctgagtagatgggactccaggtgtataccattgcccccagccagatgcctcttttatattttttcaggcttttctcctgtattgtatgtaaataacacttttctttgttttctatatcaaaatagtaggagagcttatatgaactctataataatataacattgttagagaagaagtgttctaatgtcacatttctcaaaaatttcataattaaagggagcataggggtcagataaaaaggttatattgtgaaattattaaagaataattaaaatacagaaaatataaaaaatcttctgaatctgagtccaaaggaattggaaggcagagattggattaaggtaaattggggaagttgacaagagagctgacttatgctgaggaaggggagggctagaccaaggttgaaggagaaaggaatattccagtcctggattcagttgatgacagcaggacataggcttctctgacccccacaaaactgaaaaaaaaattatataagcagctttttaaggcaagctgttgctcacagaggagtagagggcccttttctgcaggttgggggtaacagggcatgtgctgcagagaccacagattctcccttatgactcacttcatgaaacatctgtaactaacttaagtccatattggggcttgtgatttgagggatcctctacttgaaagaaactgcctgtttttttgatgcttgtaattcttttaagtagtgaaaaaaatcttttgttctaaaattagagatgtgaagcttaacatgtgaagacttgactctgaatactcatgcccctcagtttatgatggggatacacgcctataaacccatctaagttgagaatataagttgaaaatgcatttactacacctaacctaccaatcatcatagcttagcctcacctactttaaatgtgctcaaaacacttcacattagcctacagttgggcagaatcatctgacaatatcatgcactgtaaaggttgtctacccttgggagctgcagcttgatatcactgcccagcattgtaagtgtcctactgagttctactgaatgagtatcgctttcacactgttgtaaagtggaaaaattgtaaattgaaccatcataaaccagggaccatctgtactctagcatgctaagtgtaatgaagtataaattacagatataaaaatcctttggtgtttttttggcaaatgtacttgaagacctaaagccttgtgccatttgtaggaaaggtaggagcagaccagttcaaagcttaccaaaatggttcactgtggagaaaaagagaaacttctattaatactattttgcacacttatctacagtaggttgtatttatctttaataaatgcttattggaataacaaacagatacaagccataaatgcaggcatttttatattccaaagctgctgcaagcacgggctttgatttttattagtttgttttgtgggggagagtttttaatgtggcttatctatataaagaagtatcttcactaggatacataaacttaaaaaaaacttatttattgagtactaacaatgaaccacgtgcgaaagatactataagctgctttttttttttttatttttattttgagacggagtctcactctgtcacccaggctggagtgcagtggcgtgatcttggctcactgtgagctctgtctcctggttcacaccattctcctgcctcagcctcccgagtagctgggactacagatgcccgccaccacgcccggctaattttttttttttttgtatttttagtagagacggggtttcgctgtgttagccaggatagtctcgatctcctgaccttgtgatccgcccgcctcggcctccccaaagtgctgggattgcaggcgtgagccactgcacccggccaagcttacttcttttatggacccctctagaagaatgagaaaagtagagagagaaaaaaccagttgttaaaacagtggtgggaaaacaccatgagaataagaagaaaaagatttttgcaagtgggtgacttagggaaggctttgctgaggaattagcatttggacagagttctaaaagaacaaaggcggtgcatgtggtaaggagggcatgccatgcaaaataaataacatggaaaagcatgaaaatatgaagagccaggatgtggatccctttggctgcagaataagttctgtatggggaaatgatggaaaacgtgacagagaaggtaagtagtaagtaggttgtgaataccttgtatgccatactcagtcatttggattttacagcagtgggtaattaaagaattttcagtggcccacttgaaggcttaagagttaaagcagtgatggagagagtggagacgagaatcaattcttaaggcatttagaaggtatagatagaacttgagtgattgatggaaaataaagaggacttgaagataacaggatcctagcttgggtgactgaaaagatgatgtcaccattcaatatgataaggaatacagaatgagcaggtggaaaagataattcatttattttcacaagtgttaaatttgagaaaatctattggatatcctggtacagacactcattgggaagttacaaacagggttgcagagcctagaagacaagtcaggtctaaacacagatttgagagtcctcctcattgaggcagaaagacaagtgagtaagattgtctgggagagcacactgggtgagtaggagagagaacaaagtagagaactgcaacacgtgagtgaacaattagacatataaaaaagggttgttacaaaaccaaaccaaatgctcctacctccataccccaataaaaatcagcgaggtagaaaactaggagaaatgcatcttggaaggcacaggaagagacgagttggaaaggaaggaatcgcaagtcagatgcacaatggggagtagaggtgagcttagcaaagggtctttaggaatttgtagtccagtttgaggactttggggacacagaatcagttgagtaatggtgtgcaagccaggttacaatgcctagatgagaaagactttctgatgaagggagagagaaagagaggacacagtaatctataggaggttgtgggatccaggaaggccacttttttctttttgaaatacctacagttaagggtaaatgagcttggagaaggagagagagattaataattaatttgttatcaagaggttaatttaattctagttttggaaagaaatgctgaaaatatatcttgtcaagtatacagttaaaaccactttttaaataattgatacaatggtgctaaaatcagtatattggtaacttttgagctattgtggtctgtaggtttttcctctaatctttttcaaattgtaaaaatcacatccagtaacagttgcttaaaagagaaataaataggtgatctcagcttcccatctactcagaaatgtcactttctcataatcccatttttttagtgcattgggaatttttacctgaatgaattttgtaagtatctcgcttagcttaatttgcctaaaatgtgacctttcagaaaatatgagagggaggttggtacctcagaacatctcttgtagatcctttattattgacttaacggatgatgacactgaaaagattgcctggggtttatgctgaaaatctggaatgttttacagtaggaaggttgggtaggatacttgtccattggttgttctagcccttttccaagaaatgtcaattggatatcacagatagaatcttcaggagtttatgagaggtagtctgctatgttgggtgtttgattactgctttacatctttaggactttctaagctgttcaggtattttaatgaaccaagggagagcactgtgaataaaggattatgcataataagaaggtggtgagggggtagattcacagagtttgggatcttttggatttgcttaaacagtttggggattaccttgctttacattgaataggcctgatgttactgatgctcaagggaaagtcaagtaattaggaaagaagaaagcaggcatcaaactcagacaaacaaatgaatatactatggagaaggaatagttgtggttggtggttgaaatggggaagggagcagggagaagcgcatggaatttctggaggaaattggtacttaattcctacttcagggttttcgaaacttacaggacattgactcttggatgatactattaaacctaagcatcttttatttttttagaatagaaactttcagcttacattttcttcagtgtaggaaaggagtccaggggaccaggggatagtataaatcacatgctttgtgataggagcagtattttgaaattacaggagctcttcagctccctggtgttttgtttgttttttttagaattaccaatttataagttgtttaaaagtgggaatagttataccttaattttggaattaatcttcatcgaaggaaggaaaacatcaataaactgatagtttcatttctttctttgttttttaatgacatctaatcttactgctttctatactccttttagagcatttccttttctgggcaggccaaggcctggcccagtagacttgaggcaggataggtggttgaatgaggtggcatgctgtgtagaacttcactcacatgggcagtggagaatttgccctggccttgatcttggcgcccctcccccttggtgttgcttcttgacaccgctgtcaacaactagagccctggaaaagagcactttattccttcagctgttatcggccaggtgcttattatgtgccaggtagtatttttggtgcttagaattcattcagcagtaaagaagagaagagccctacttgtaaggaggagggttagataataaacaagtaaactaaaaaattgataattttagataatgatggagcctataaaaaatataaaataagggaagtgacagaaaatgactggggtggtagaatggggtggaggggctacttcatatagagtgtcagggaaggcctctctgcggagatagtatttcagcaaagactaaaatgatttttaaaaaaagggcaagggtggagctgactcttgaggtttagggaaagacagaggaggcagaggtagtgttaagcccaggccccaaagttaggatgagcttggtgtatgagcgaagcaggagcccagcctattggggttgtgagtgaggagaacaagtggctggtgatgcgatcgaggaggcaagcagggctgcatcataggaccctagggtatggtgagcagttcattctcggaccacttccagtcagacagtggaaagagaagctgggaaaccagttagaaggtgactggtaggccagggatgaggtgatagggcttgggcaagaatggtagcagtggggagagagaaaggtggatggacttgtgctgaaaagtgcaaactcagcactcagggacaactcagtattctcatctcttttgcagacctctctctgggactcactgagcatgggcagcttccctgtagccacctgtttcatccaccacatggcattctctgagattaagtgagggagaaagcacagcatgattaagagagataaaaggattataacaagaaagttataatcccagattatcaggtcttagaatcaggtattttagggaatcttgtatattccccaagtagtaaaaacaacagctttgatttataaggtgaggctcctttccaggaggtccagagcagaagatactgttgctaggcttggatctatttttacaattggttttaggtattgaccaatatcctgccaacaaaggtggttctaggtgaatcctcttgattgttttttacatgtggtatgaatcacttagccctcccacactaaagatggaggatccctgatcagaaaatataaagaagccatatatgtctccatctgtgttttaaaatccttactttttccaacagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaagtaagtacttggtatagttgcatttaacattggggtacataagagttgtggtcattttagagtggctctggaagtgtcacataggggtctatggaatttaaaaggtgagaggaagaagccttttgctatttggcccttatattgaaatattgatttcttatatctgtctgctgtgatcatattttatccttgctgttcactttggatttagagctaccttctgggctgatgactttttgatcagcatcagattcttggtgaattatatataatgtataattcagataagtttctgaatatctaaggctaaatgtcaccctttttaaagtaaagtactgagaatgagtgtgttgaagatcataggttttttgggttgggaggagattagatgttggggatgtcaatgagatttttggaggaaaagtgggaacaagagtgaaaaactatcaattcttcagccgttctattagtgtatcagtgatgtatttggttgtgctattggggaggtgtttgtagttttaagtattgcaaaatgcttttcatatacacttaaatcaagcttacaactggctattaagttttttccctcttctgttcacaatctgtgtcagcttccattcaaaacaaaacaaaaataaaacaagaagaaattgttgttgcttatccagaattatttgagtatgtaaaattgatttttaccaggtttaggtcaaccagttattggtgacttttttttctcaagctggaataatctatacatttcttttggctgtattttgaaatctgattttaaaccatgaatcttttccccttttttatttgatttttctctccacaactatctttattgacaaagcttcttatttataaataccccagtggagaagtattgagtaatttccggaagtcttcacaggtttctataaatcattgatttagagaattactgtctaaattgaatagaaagttgtgcacattctgtgactttctaaaggttaacatccaagctttgtcagaattgaaaaaaaaaatcatgtacttggttccgccgcaccaactgcccgccccccataagaccatctctcaaggaaattgatagattgtttcttgatagattttatgatgtgcatttcttacacatcctggagaggttttcatttctgtttagtctatcgttctacacaagaagactgtccctaaaaattcactttccccctgctatccttatctaccttctggatttgtattttaaaacagttcaataaaagtctgcagccttttctttctatgacaccttgctgaagtctcactgcaatcacagggctattctctctctgtgtgttaaatctccagtccgtgatcttgattaccttctggtgttgtgggaaagaaatgggccattttctgctcttccctttgattaaaatgtaaattagctagttaaaaaagcacaccacccagacccagaaggatgcagttctgtcgtttgatccctgctatgatcacacctttggctctggtcctgctgggcactcttctggaagcttgggtgtgctgagcttcttgttctttgctcccataatggctcgcagcatagctaagttaatcttgcaggggcctgagaagtatcttactcacacacgcttgctcacgctcctattctctctctcttctgagaaagcttagtttttaagaattgtggaaatgattcatttagcaaatattgagtaccacctgtattcaagaagaatggttcagtcctttctacaaggttctaaaacccctcaattttgatgataaagctccagtcagttctagaggtagtttttccaaggaaagaaaaaattgccaacaattcgcaatgtttttgtatatattcatcatctctggatccagggtacatatttctagtggaggggagaggggctaagatcaggagtggacaaatgtctgttcaggaagtttaatcatcttaagagctgggaatcattccagttttttcacttgatatgattttggtgaaataattttacctttatgagattttcttcacctaaagaaaaatctcaagagatactataacaatgaacaaagatattaaagcactttgagcaactgacatccttcacttaacgacagggatacattctgagaaccgtgtcattaggcaatttcgttgtgcgaatgtcacagagtgtacttacacgagcccacatggtagaatctactacacatctaggctatgtggtatggccttttgtcctcaaggtacaaacccgtgcagtgtgttactatactgaatactgtaggcatttgtaacaaagaggtatttgcatatataaacgtatctaatgatagatgcctagggaggctgaggtgggcagataaccgaggtcaggagttcgagacagtctggccaacatttttagtagagaatccccatctctactaaaaatacaaaaatgaactgggcgtggtggtgtgtgcctatagtcccagctacttgtgaggctgagacaggagaatctcttgaacctgggaggcagaggttgcagtgagctgagatcatgccactgcactccagcctgggcaacagagcgagactccatcttaattaaaaaagaaaaataaaagaaaacgtaatgctttgcgctatgatgtcatgacagccctgatgtcacaaggcgataagaatttttcagtttcattataatcttatgagaccaccattgtatatgtggctcatcattgaccaaaacgtcattccgtggcccaggaatgtatttggagggaaggcaatagtcaaaacctaaagcaataatagtatcattatctataaaaacattgaacctttgagaagatctgatatttgtcttggacttgttgaatacctagtgttagaagtgatttcatttcaagaggataagagcaccatttgacactgtagacccaaaatatactaaatattaccctcatcatataaaagcattgcttccatttatgttgctgtacacccttgaaatgaaaatgtcatctcttggacggggaacttgcatgagaattcggacatctcaggtctaatcctgcttgtgcagctgatgtatacgtgatcttgatttctgtttatgcaggtggtctaaagctttctgctcttttcaggtccacgaagactccttctcacttactctcagcagacatcctcacttggttaatggttaagacttcagactccagagtcagccaatatgagtcagaccccttgctctgcagtgtggccttaggcataggttacatatcctctcaaagcctcagtttcctcatgggtaaaatagggataataggaatatctgtcttatagagttgtcatgggggttaatgcgagcagtgtatgctgttcactcttgtatccctaggacctggcaaagtgcctagcaaatagtaagaacacagtgtttggagtaaatgattttaaaaatcctagtaatatgcctggcatgttagtagtgacaatgacagtagaggccaataggtggtgtattagcatcactcatgctgctataaagaaatacccaagactgggtaatttctaaaggaaagaggtttgattgactcacagttccacatggctggggaggccttgggaaacttacaatcatggcagaaggcgagggagaagcaaaggtgcatcttatgtggcagcaggcaagatcgagtgtatatcagcacagaagaaactaccttatataaaaccatcagatctcatgagaattcactcactatcacaagattagcatgagggaaccgcccccataatccattcacttcccacccgctctctccctaaacacctggggattacaattcaaaatgagatttggggctcggctcagtggctcatgcctgtaatcccagcactttgggaggccaaggcaggtggattacttgaggtcaggagttccagaccagcctggccaacatggtgaaaccctgtctccacacaaaaaaaatacaaaaattggttggctgtggtggcacaagcctgtaatccagccactcgggaggctgaggcacgaaaattgcttgaacctaggaggcggaggtttgcagtgggctgagatcacaccattacactccagcctaggcaacagagtgagactgtcttaaaaaaaaaagagagaaaaaaatttgggtgggaacacaaagcgtaaccgtatcaggtgagaactccgcagttttgtggcccatcttatctcaaaacatacctgtttttgcatgtacctcccttcttttcctgtctcagtgaaatagggtatttatttcatcctgcctaaagtgaattcctttacctgtgccctggatccttttttttcttgtttttttttttttaattttagtttttgagacagggtgtctctctgtcacccaggctggagtgcagtggcagggtcacagctcactgcagcctagacctcctgggctcaagtgatctcccaacttgaggatcctcagtagcctcctgagtaactcacgccggctaagttttttatattttgtcgagatagagtcttactttgttccctaggatggattcctttttctgcttcatctggtaccttaggccactaataatttcttctctctttctgtatttttagcttctccctcgctaccactaactcctttcttctctcatgttaaatttctttcatttaacacaaaatagtccccctagcttcttccctctaattactacctgttactaattactaatctaattattatctttccttccagaagccaggctcttggaagaatagtctattctgcaacctttctcagctctcattctcaccagcttttgcccccaccacatccttgaaactcatctttcaaaagacactaactgctaaattcacttcggctttgtggttctttgctttcttgacctctttgaagcacttgacactgtcagttattcctgctttcttgagactcatgtatctgtcttaacttcagcttctccaaatttttctttttcaatctttggcagctccctctcagattcctgtgggggctgcttttgtgtgtttttgtgttgatattctgtagaatttgtcctcagaaacagcaaacatttattgaaccttatgctgaagataatgggaagccattaaagcaagggtttttaatcagggttccaaagattgatatcaaggaatctgtgaactacctgaaattacattcagacttcaaaacttaatatgttaagtgctttacatgatgctaagtgctttacacacattatctgtttggacccacgttgccatcctatgaagtagattcttctgttgacccccaacttaaagctcaggagactcaggattagagaagatgagaaacttgcccaagattgtagttggtaggtgttggagtaaggatttaagtgtaggcagtctgactccagagcttgtacttcaaactgtaatgccactttgccttagcaatgcatgtcccaagacctcttttttatttcagagcctcaaaaactactaaatacctatcttcagctcggatttctatcccatcaactaaatagcttaggtgcctgtaggcccctccagttcagtaagccagaaatggctttgttatctgctttcttcttcctgctcctttccaacccctcttcatgctattattctctatttcagtgaatgacacctaatttcttgggagtcttccttttcttttacattctatatgtaattggtttaccaagttgtattatatttacctcaaatctaacgctttcacttaaggttagtctggtggctaatggcattgattttggggtcgaatttggagctaaactcaagcatttccccttaaaagcagttgaaattggcaagttgctcagtgtcaagtggcaataacaaatgcctgccttccaggaggttggttaggagaatgggtgagtacaggattagttctttccctttactgtgtgctttaaacaagggatcaaactttcttcaggcttagtttgctcatctgtaaaaggatgctgataatagctaactcatagggttgttgcaaaatttaactgagataatttaaatgtgtgtaacatagtgactagcacatggtaagcattaaaaagaaacgtaagctcttaatagcatcgcccactgccactgcttttatgtaggccttctcattttagcctgcctcactgacataagctcttcactaatttccctaatttgtcttacccctttccaattcatgctgctacctgagtgagtttaaaaaacaaacctgatcccatcactgtcttgcttaaaattcttaaaagtagtgattcttaatcatgtgtgaaagacagagagtgcagtgaactcacttgatacaaaatctatgaactgtcttcccagaaaaatgctttaacatactaagttttgaagtttggatataatttctggtagttcacagattccttgatgtcatctttggacccccaattaaaaaacgcttgctctaatggcctcccattatccccagcataaggtcaaactcttttacacagataagagaatccagataagcagaaagaaaagaggcatctattcataatccaactatctagagaaaaccattttctttttttaaagtaaataaaaatgaacttattaaaaaaaaccatttatcatttcacaacacatcaataaccaagtagaaaataaaaaaatatataaaagcctgggcaacatagtgagacctcatctctacaaaaaatataaaaattagctaggcatgatggcacacacctgtagtcccagctactctggaggctgaggcaggaggatcatttgagcccagggttcaaggtggcagtgagccattattacacctgtgaatagccactgcactccagcttgggcaacatagtgagactcccatctcaaaaaaaaaaaaaaaaaaagacaaggaactaataattaggatatacaaggacctcttggcaaatcaaaaaataatttttcaatttttccatggaaaaatggtcaaagattataaaaaagcaaatcacaggagcagaaactcagctggcttacaagtgtatgaagagatcttcaatctcaattagtaatcagaaatgtaaatcaaagcaaaaaaaaacattggcaaatatttttaaacattagatgataccagttgttggtgagaatatgggagaaacaggaacttctgtgtactgctaagggggaatgtaaactgttacagtaggacattagaagcaaccagtgtactcgtcactaggggaaaatggtctgtaaacatggtagatccatatcatggattatgctgcaagtaacagccacatggacagatctctaaggtcaccactgaaggaaaattaagaaaaagaataagatctataatagcctatatcatcttgtacttaaaaagcacatacataaagcagtactgtgtaacttaataaaaatatatacacatctaagatgtatctgatatatcggtgggtacaagagggtaagtggggtgcagagggagtgggaaaataactatgaaggggaaaggtactaaaatacaacgagaagggcctggcacagcccatatttgataatgtgctaagaagtcattagaaattttgaatgactgaattccctatacctgaggtccccctttaaaaagctcacccttcttatagacgaagaagcgaagacactaagttacaatgatataaattaagctaccaatgacaaagtgctcagtcaaccttctgccttgtgttgataacactaatctgccctagttatatctaaagaaaaatatactttcatacagatttcacagcttttcaacatccatatatctggaaagataagaacatttgtatatccttccatatgagtccttgtgattcgttgaggccataggttaagtttcctttcagtcattccaaggagaatcagcatgaccaagcaaagcaggttccaaaggcaggaagcagaagcaatatgatgctgtggaggtacctttctgaaacagtctcttctgctgttgtggggtctttgggcaacccttcaatttaagtgcttggcaacaagtctgctgagataggctgaccttgtagcttttgtagtctctatcgtacagcactggtcagatctacataagcctcatcgatgctgacgcattcaatcacagcaaaacaagacttcctccatcacttcaacactggcttcccggtacttggtgaggttagctttcccatggtactcacgaacttgtgccagtagaagacctggacttaacttctttgcatcatctgcctacatatagtgaccccaaatgcaagagcttcataactcactgcaattattctaccaccttccatgatttgtactacacagctgcacaagatttattcctcaaatgaggattttgccgctgctccattggaacaaagtctatgtccatgagagtaaccacacaatcctgtccagtagccatttttcaaggtaacagacacctggccagactgccagcagtgggtgccgcaaatgctgggctcggtgcccactggaaggaaaatggaagaagggcttttgaatatcttttcgcctttctggggagagtttcgagagatttattccccgtgatgacagaggaacagagaaggggtcgtgaaggatcctgcccaggcgaccgtccccacagttcagcagggatcagccgagagcagtgtgcccagcaacaaagccaccagactgaggacagacagcacgcacgctgcctagagaaaaccattttctttcctcacgttttttaatgctcctaattaatgtgttttctagctccttctctcactacgtcccagcttttgcaccttatgctttaacccaatacaactattttcttttttttttgttttttttttgttgttgttttttgagacggagtgtcactctgtcacccaggctggagtgcagtggcgccattgtggctcactgcaagctctgcctcccgggttcacgccattctcctgcctcagcctttcgagtagctgggactacaggtgcccgccaccatgcccggctaatgttttgtacttttaatagaggtggggtttcaccgtgttagccaggatgatctcgatctcctgacctcgtgatccgcctgcctcagcctcccgaagtgctgggattacaggcatgagccaccacgcccggccaatacaactattttctatcctctgaaagagataggcctatcacagtattttgttaattgtctatatgtatacttcaatttttatttggctgaaggtgttgatggtatattaatttttgtatattgagagtttagagtctagcttagtggctgatatatagtacatattcagtaaatattaggctaaataagtgaattgcaaaattcatacatgtttgtgaaagaaaataagaaaggagaaagaacaaattacccatggtctcatcatccagatgcaccaactgctgacatttatatgtctactgtgatcttgtgtgtataaatttctactttctagagcttagcgccttcatagataatttagggaagagagtcattaccctttcccacttcacatagagattatgaatttagtgtatgcaaaattcctaataatgctgttaaatgatttggcctggagaatattaaccatactaaattttactgtgttgtgcatatgactggggctacttttacttgcctggtacgggaaaattgtgtatgtgtctgtttacccttctttccctagaacctcattttggagggttgaagaaattcttcatgtgattcaacttcatattcccccacaacttagctttttatgtgtaatccttcttaatactactatataagctaatctgtatttgtggaagagaatagttgatatactgatggtagttttcatcatagtgctttcctaaggagcagactgaagctcagagaggtttgtagcttactagactctaaactctagatagataaaaattagtacacagtgaacgccatcaagaaggtgtaagatttcagggctagtcagtggcaaaatcgagactagaatccaggtcttttgactccaactcttcagtagtttaatgttgttggcttgtctcttgggaagaactggcaaaggttaattgaaatgactggctctgacctttttttttaaaacagactcaacttctaatggaatttcattctaccttggatttctcctttttttctttcatttttccacgaaggctgtgtgtttattttttattctacttgcaagaaaagagttctgggtgacttaccccttgtaatgtttcctggttcccacccttctgtcttctactttgctcttgtctacttctcaaagggaaaacatttagtggtgaatgggaaagatgccaaatagtgaaaattttaattcatggatgtatggctgtgatgattactttagttcttttacctacctctaagaggaaattcattattgaaattgaggaagcccatatatgttttattttctcttggcttcattttatttttaaaatttatttttgcttcatttttaaaataacttcattttcaagcctcattgtctgaaggttgaggctttgagcaaaaaaacaacacatttagaaattctagtcctgaaaattgctgagaaattttaactgttctcataataaaataagtaaatgaaataatgcatatgataattagcttaatttagctatttcacaataaatgcatattttaaaacattttgtacatgataatatatacaatttttatgttaaaataaatgaatttttaaaatttctagatcttggttactaattctcttatcatttagccatttctgatggctgcttttgccctagattgcatttctctctgggagaaaaaaatcttaatttctttatgttcagcagcttaagggagattacaggcagagtctttggatttgattttcttctcttttgcaattaacttgacctcctcttgactttaagacaggctgttaaagccagcatgttgcttgaggcaagatgtttgatatacttttccttagcacacagatgctactggactgttagcatattgcacaaaacagaattaggtttataaaagaacaaattaaaaagttttcggggaagttttttttttatagtttacgacttctttaagagggaaagctcttgcatagttaattaaggattgtctagtaagttttgacagttgtaaacagaggcttataaagctctaacatacatgatagagaaaacgggttgttagacacaaaggtcttctgtgtacatggaaagctaatagctgtcaattctgagacaggaactagaaaataatatctgaagagtaaatggatttcttacttaaatgttaaatttccattatctgtgcttgcagtttcatcttttccaaggaccttatgatgtgattgcttaattctgattctcatactgctgtgaaacaaagccagggctgcctcaagttaggcccttaggagcccggtggctaggaaagggaggcagcttgtttgtagaaggactacatgtagctattgtttttcttttctttttcttcttcattatttttcttttcttcttcttcttttttcttttttttttttggtgcttggaaaataagtttcacaatagcaatctggttttgtattgtttgttctaagagaaattttttttttcttttctagccatgaagatggacctacagctaaaaaattaaagactgagcaagggggagcccacttcagcgtctccagtctggctgaaggcagtgtcacctctgtaagctaagcttttcaagtgcgcttccccctttgcaggaaggttggggcttgagggagagtgcatcaatttttgttagtccgttcttaccactttcaagttaagatcatgatcactttctctggtccttgctctatagaagccaaaaagacccattccatacttctttaagtaattattatcatgaattgcctacagaattatctatatgatataaggtatatagagctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaattaattaattaatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtcactgcacccagccaaatagtgccttgttctaagcagcattagtgtgaatcaacaaatcttaaaaattggccgataactttttaacacaatgtactaggaaggatagtcagggaataaagggcatgcctttattctcacctcaaacagaaactcagaaaaattgaatgtgtgaaaaatgatttagatttcatttagatgttttatatataatagtaaaggaaaaagtcatgatcttgttctgagagcttttctgcttcctatatccaagcaaactggaagctttagtatattttggaaccccattgttttctttcttatgagctgagtggttcttaggccctgtgagggttggggccagcagattaaaaacataggtataatcagaaagttccatataatatggcagtttcgtctttcaaacttcctcacccagcactgcagtacatctttgtacataatctgcttttactttctgaggacatgttcaacctgggtatgctttgtatattctaccaaaacttcagtgccaaagggtcagcagcagtcccactaatgggcacttcggtgaatcaggcattaagctgtatttctcatgttatcttagtggggcaaatctattcgaaaccgaccccacactgcagaatcctcggctttctaattggttgggtgacaggatatacaggcagtctgtgctacacaaagccttccagctgggctggctggtggcttgagttgtaatacttttttgacccttctggaaagaaatcagctttcataaagcaaggtgagtgaaagcacagagggcagctcttggaccactgaaatctgccggcctttcacagagccctagaaatgaaaatgaatagaaaagcccttctctttgtctttggttttattttataagagcacacttattacattaagccatcttgtattgcctggggtgctgctaaaaagagaaataacctgtaggtttatcatctgttggtatattttaggttggaagtgtgaatcctgctgaaaacttccgtgttctagtgaaacagaagaaggccagctttgaggaaggtgagtggttgactttgcatttaggagaagctgtttagttaagctaactaatttaaagtctagattaagaactgtagccttttgttgtaacactttagcatttttctttactggcggatctttgtggttttcccttgttagggagctcactgaggcaacattatgagcacatgaaagtgaactcagcacagattttctcaaaaggaactaatttgtaggtctccctacagaaaaactttgggccaacaccttggcgcttatagctccacttcattgaagttttttaggattttgtcgtgagctataaataaaacacttttatgtcacatcttcctattttattttcttccttttttttctttttttttttgagatggagtttctctcttgttgcccaggctggagtgcaatggcatgatttcagcacaccacaacctctgcctcccgagttgaagcgattctcctacctcagcctcccgagtagctgggattacaggcgtgcaccaccatgcccagctaattttgtttagacggggtttctccatgttggtcaggctggtcttgaactcctgacctcaggtgatctgccagcctcagcctcccaaagtgctgggataacaggtgtgagccatcgtgcccggccacatcttcctattttcagagacacataattcttgttccagtcctaagagtttgtggcccatttatagtagacctagaaagaccttgatgctgcccctaaatttaatccttctcaaaatggctgcatggtcacttttccttatcaggtagtacctagaatctcatttaggctgtggctaacataaaaatagctttcagggatgcacagagggcctggaactaacattcattcacttgattgcattcaggtttctgttcatttaccctttaaatggtggcaactggcagttgttaatcctgcaggtttatatataaactattatattcattattgctggtccaagtctggcctgtctgcgagctgacttctacgtatgtgagtgtttatgtttgttcatgtgtgtatagaactttctcttccaacatcctgcagggagcaggggaatcacttttttttttttagtgacagggtctcgctgtgtcacccaggctggagtgcagtggcaggatcatagctcactataacgttggacctctgggctcaagtgatcctcccacttcggcctcccaaagctctgagattacatgtgtaagtcaccatgcctggccaaaaattactttttttctttttcttttttttggggggacagaatcttgctctgttgcccaggctggagtgcagtggtgagatctcagcttactgcagccttcaccctggcctcctgagtagctggaactacagttgcatacccccacgcccggctaatttttgtatttttagcacagacggggtttcgttatgttggccaggctggtcttgaactcttgacctcaagtgatctgcccaccttggtctcccaaagtgctgggattactgtgagccacggtggcatgagccaccgtgcccggcccaaaaatgagagttaaatgcctagaagcactactgcctgcagtaggtctaatgcatcttactacttgcagtctaggaatcctggcaagatccccagatctactgtgctgttgtccagaggcaagcatgagcagctgagcctcagagagagcttacagtctaccaggcttaaatcctgtcagcaggaatgccaaaggccaaaccatgagaatctccagaggaagaacagcttcgttatcacagtaatctgcagtctcttaagtggggtgtatatgtttttggttttgagatggaagaagagctttttgtcctgctaaaagttgccatataggagaaaaactttgagttttaacacaaaacaaaacctcatgtaaatagaaggagatctgaagttctaagtgacagttttctaggattggtgaaaacagtacttcagaatttctctctttaatgtattggagtgatcaagacactttcacagtattatacctgttgtctgttcagctgtatattgttacagggtgctcggaaagtggcggagatgctgctgtgacaagtcaatgaactcttgtctatcaagactattgtgtttttgaaggaaaattgagactttcctagctttcaattgtatgtcgtcaattacctcagccagtcaaagtccaaggtcccccgtttggaagtgattggactctgtggttggtgtaggcatggtcttttcagggactgaatctagctgtcatcaccattatatggtagccactagcggtttcatatttactatgttcaaggcattgtgctagcacttttatgttattttaattaccctgcattagcagttctgcaaaatcttgtgaagaaatgaagaaaatgttagagctttaacagcttttgccagaattttctgagaggattgctttacttgggaaaataactttgataagtgcttagggtagagaatgagtctccatccccagacttggttggctagtccagaggcttcggaggaaaggaagctcctcagcatcatagaagtagaaaaactggagctggtttaggagaggaggggcttagaagaagaggggagaggcagggagacaaagtgggtgaatttacgcacagtcacggccttctacaatacgtttcaaactcatgaccacaaattactcagtgtcagtacaactctggaaatgccaggtttaagtgctgtatttggggaaactggcagtttggtatctggcattatttcatgcagagcagagaaagcacctgagcacacaggaggccagagtctgaaaagaccaggagagagtcagttactgagaatctactcacatcttaggaaaatatgtcttacccctggccatgggattggggattcagagcagtcttgtgaaaatagcaagggcaagcggaccctagatagcatgtaagttaacaattagtattattatctccattttactgatggataaactgtaaaattggaggagatgcattttcccaaagatcacataggaattcaaacacatgtctctttcaaatactggattttttacgtagccatattgtttcttttgattcctaatgacttcctttcctacgctttttaaaacaacattttaaggtcgtgtatctgaaaccttgtacctactgataggacttttgatgaatagattgttcttttatattgaatttgactttgagacccagcatgttgctagtatttcgacaaaagatgtccctctgacctccgtctaagacttggtgaatcagagccctctagtgatgtcacaaaaccagactctccacagagctgtcggaaaatggattgcttattagcaactagttctcgtgattttaacttggcttccgttttatcccttctgccgttcttggtgccagctccagaattgatgtcctgttctttgttttgggcatcttgtttgtttgtttttccgctagggcatctttttactaacgccctttataagccaagactcacttctcttgcaggcccaaagagttctccctccctagtagtggtcttcttttagagagatttctgtccagagtcgggagacaggaatcccttccccttttctccagtaaatttattttttaaaattcagttgtcaaaagggcgatcagcgatagatagttggtaagattgtttgacccttaggtagaactcggctgttttacctatcattataaattaaaatatgggtgtagttactttttctcaggcctgatagtagcataatcaaactgagagtcttgtgattctgtccccgacatcagcagtctatatatagtaggcagctacacattttcttaacttctggttttcagtgtgagggatgtatcttgttctaagcttactggcagagaggagataaccaatgccctgaaccccaggaagcatgttctttctggctgcccttttcccagtccctttcctccattctccctacccatcaccattctatcaccacagagttagaatagaaaacaattttttttctcttttccttttttgtgaaggggtctcagtctgtcgcccagactggagtgcagtagcatgatcacagctcactgcagcctctacctcctgggctcaagtgattctaccacctccaccccgccaagtacctggagctacaggcacacactaccacaccaggctaatttttgtagtttttgtagagatgaggtttcgccatgttatccaggctggtcctgaactcctgagttcaagcgatctgcctgccttggcctcccaaagtgctgggattacaggtgtgagccaccaagtccagctcagaaaaaattttgaccacagctgtatatataataatcatctatcagttatgaaagtagggttgtttccctacatacactattcataagcacatcattgccatcatctgggatttgttacctgtcgttgtgggtttcagagtctccagaggctctttacattgagtttatccacttgtttggatatcttccacccagctaatcaacagagttgctaaggaggaatgccatgattttcagctccttgcgctttcccaacttaggaagaatgctaaaataaaataaaataataaaatgtcaaaagatagacagcaggttcaagaaggaaaagccacattacttctttcctccggacaattcctgcgcgattatgtctgaatttataaattcccactgagtatgggagataatgtaaaatagcttgaatgttcttggtgtgtcaaaaacaggttttgtgaggatcttaagagccagaaaggatggatatatggggacagataaaaggatggaatgtaacttaactttataatgagacgattctctttcagggaccttgtttttgccactgagattgtagtttctgtattaggcttgtgtgtagtgacagggtggcagagctccatgttaccaaattgaattcacttgagcctgactggtttaaaaaaagtctgtcaagagaagacctaagtagaaataatacagaccccaaacagccttaacatttgactcatgtacaagagagcagtaatatgtacttgtccatttgattagaaggtgatcacttcatttttttcccctttcactttgtttggattacgtctcatcctagagtctttttgcctttgttcttcaaccttctttaatctcacttactagaaacatcctttcatttttaaaagatatttcctaaaattcactttttccaagcaatttcagcactagatagaatatggtacaattagtaataatatgatattcatcaaagccaaatagttttcagtgttggttttgtatggtatagcactatcccatttgcatagctgtttacttacatacattatgtgattttctgccaggagtcaagccctaaacagtgaaccttcgagaattgtgatctagcagaaatctctctcgtgtgtgtgtgtgggtttgtgtgtgtgtgtgtgtgtgtgtgtgtgtgtgtgtgtgtgtgtgattttttttaattgatcctgattcatgtaatcttgggtatgaattatataatgaattatactctgcccagatagataagaagataaaaatatggcgtttttctacacagcgctggtaaatttaagaaaaataagctctttcaaataccttgagcatcttaaagatgctaaatacaaacagtcactaaaattttaaacatctttagccctataaaagtttttttcttaaagaatttgacatacttttttagtcctttctccaaatagcattgatacatctaatcatgagaaaattcatgattaaggattccagaggtttagtctgtactttgtatttttattaaatatctcacttgtttttcactggttttctttttgactcattttaaattattaaacctcagaacctgacaatccaggcttattttatgcctcatttatcaggacaagtggtctcattgtaacacaaaaatcagtgtgtttggaattgtagagaatacttgctgaaagggtgtgttatctgacatcgtaattatgcaccattggcctttaaggtgttgttcatctttcatgtgggcggactgaggcccagagtagttaggatgacttttcacagataattgcaaatatgtgaaagactctggatcaaattccagagagccaattcttggcctctgtggcttaaacctttttactggttgtgtatatttcattggatggcacagcaccaccctgaagtttacatcttaatataatgaaactcagcagccaaataatttagatgaaatcattgaaatagagatgaaaagaaaaaataaaaagcacatgacgtagaaactaaagaccattatgcacacataatcattttaagtattttcatttttcagcgactcttcctaaaaggctttcatctattcttacccagcctttaaaatccttttaagttcctgtcaatctgtatcagaatatccctaattacaggatatagctcttgtaaaatgtagcctggctatccattaagaaagagaaatgtgtggtagcataaaaatgaaagcatgtttgctgtagttacattctgttaactgaaaaaaatcacaagatctataaatttagaaaaagagagctttatttcttataaagggttacagcttgcaaggtggaaatagcaaggccaagtggaccctagatcgcatataagttacagtaagtattattatccccattctactgatagataaactaaaattggaggagatacattttccccaaagatcacataggaattcaaacgcatgtctctttcaaatactggattttttacttagccatactgtttcttttgattcctaatgccttcttttcctacactttttaaaacaacattatagggtcacatatctgaaaccttgtgcctgttgataggacttttgatgaaagcctgggaaaggctattcctagtctattcaaaggctgggaaacatggcctccagccaaagcccagagacaggcactatgaaggagggtttggggtaagagcattattgctgacctgattgactaaacatacatattcagcaggttacaggaggagctatgaatattcatgaaggtggtcctgatgcatgagtattaaacatgcatgttacgtaatacccatgttcaccttgcagggaagacttgacatttaaatattacagttagaccctgtacatcaaaaggtcttttcaggacacagcatgcaaatgtgccatctttgtaaaacccactagaaccagtccgtggttggtggtcttcttatcaggagaaagttaccgaaatcactctcttgtccaatcaaagctgtagttatggctggtggaacaagagttcagtaagtcagcatctggtagagctgcaaattgttttaaaaacaatattgcttatcccaaggccagtgcttttttagctgcttaagaaaaagaaaaaccttttggcagttagaacatagtttattctttaagtttaaggggtgcgacttaacccttgcctggcatggccttaggtcctgtttactacagtttgttctctcagtcttatgatacctattttaaaattaatgctggaaggttgtgtctaaattgcaaaaaggaggggtataatgaaatgcacctggccgggcgcagtggctcatggctataatcccagcactttgggaggctgaggtgggcagatcaggaggtcaagagattgagaccatcctgggcaacatggtgaaactaaaaaaaaaaaaaacaaacttaggtgggcatggtggtgcgcacctgtagtctcagctacttgggaggctgaggcaggaaaattgcttgaacccgggaggcggaggttgcagtgagctgaaatcgtgccactgcactccagcctggcgacagagcaagactgtgtctcaaaaaaaaaaaaaaaaaaaaaaaaaaaaaaaaagatgcacttgaccccttgtcgtgtcatgaccaaaaactcagttaaggttttctgggatcccctttgtcaagagggggtccatttcatcagtggggagcttaggatttctagtttacatttctcagtgagcacctgaatttcttcctgagagctttttaaaaagtccttatgaaatatatgacagtgttcctgttttctcccagtgttttgttttctcatgctacataggaaagttgcttcccttaaatgtgctgagtaatttttctctttttatattaaaaatggaaagaataatttcccatctggctgaaaatggaattcatgaaggctttctcagcatcataactagatgagcccagagtccattcaagcctttacttaatatactaaatcactcctgataccagtcttctatgaaggagagagagagagagagagacacttttaaaccatgagatatcaaaagaactcactgtcacaagaacagcaaaggggaagtcctctgccgtgattcattcacctcctaccaggctcctcctctaatttgatatgagatttgggcgggacacaaatccaaaccatatcatttcagcttgcatcaatgacttgggccatcagtgcaacaaggcaggtgctcacaattggttccgatggaaatgcagaactcttgggtgcttaggagaaagggcctgcagcttgctcttagaattcacccttgcagtaagtgctaatgagtatgatttgtgagacagagagcagttcaaggatttactcatggcaatttggttctttctttccacctcctgttaaattctgcagttcttccttccatggtaggtcattgtcatgtcatgtagggtattgtacttggttctccttgaattgggctgtcttcaagattgctccttaagcccagctggttgaaaaaggaaaccggtttcagattgtgctgatgtgcaaactgctttaatcaatgacttgaagtgactgctggtggcaaacaacagacgctcttaaccaattaagatatttaggaaaggatgttaggcttttgttaaaatagtcactaatgaactgaaatgtgttaagaggagccaagaaacagctaggagttccacttaaatgcaataaaagtgtttgggtcctcccctttcaaattgcatgcccaaggcaaaaaatatgctgacacagaaagaagtggcaagtgtaatttggtacagttagcctgtcagatccatgcgtgtctacataaaacctagaaaaatgtcgtgcttgcttctttggccagaaaagggaagggagtttaattcctttatagaacagtttcagcagggctggagaatattaccagcttagatgtctttggaaatgggagaaaatttaacttgtttttagaggttccttatgttttagaggttggagaaaaatcttcagttaatagtcataattaaaggcccgtttttattttcctctgtcagattaaactactgaaatctgtagttatctgttcatgtctctcagtggtaatgaggctcagccataacactcaggataatatggtatttcattggtagccatttgaagtcaggagccattgctcatataagaactacttttttacaattcccttgctcttggaatccaataatgttttcttggggcattgagagtaagatacactgtctaagttttcatacttattctgtgatagaaacatctagtttctctcttctgtctgtggtaaatctctacaagtctcttagataaattgcacttattaattctactttttaaaatagctttattgaagtaaaatcttctactataaaatatactggtaagtataatttgatgatcttttgtaaattatagagttgtgaaattatcaccacagttcaaagaacatttctctcacacccaaaaattcctgggacctgttcatagtcagtttgggtctggagtgcacacaggtggtgggaggttgcaaggtgatgctggcctacatgacttgttctgataatcctgagttattgcaccatctgttgaatgggctggcgccatcttgggcctgacgagttgtaaattagctgcagccttcaagtaataacccggtggtggaacattctatagatacctggattgtctctggaacttctaagcaaacataattagacaagctagcaatgcagtggagtgtctggtggaaaggaggagagtaaaggttgttatttcataactaaaaagttaatacaaagggcctcagaaggaaaagtttaagaaaaaaagactaaaaaatagaatactcggatacactccaactttgttcttttctaaaaatgttttaactactctatgtcatttgcgtttccatggaaactttagcatcagcttttcttttctttttttttttttttttgagacaaagtctcactctgtcacccaggctggagcacagtggtgcgatcctagctcactgtagcctccacctcccgggttcaagtgattctcgtgcctcagcctcctgagtagctgggattacaggcatgaggtactacgcctggctcatgtttgtatttttttaatagagacagggtttcgccatgttgaccaggctggttgaactcctgacctgaggtgatcaacctgccttggcctccaagttttgggattacatgcgtgagctgccgtgcctggcccagcttttcaatttatatgaaaaacccactggtattttgatagggattttattgagtctatagaagagttaagggaaaattgccattttaataatactgagttatccatgaacatggaatagttactcatttatttagatcttattttttctccataatgttttatagtttttagtgtacaagctatacagctcttttattaaatttattgccaagtattctttttgatgatgttgtgagtggaattgttttttaattttatttttggattatttgttgctggtatatagaaatgaaattatttatttattatatcttgcaaccttattaaacttattagttcttgtggttttttaaatatacttcttaggattctctacatacaggatcatattgtctgcaaataaagaaagctttacttcttcttttataacttgtaagtttttctttctttttttttaattattgtactggctggaacttctggcacagtgttgaatagaaataagagtgaacatccttgccctgttcctgatcttaaggaaaaacctttgtctttcactattagtatgatgttagttgtaagttttacccagatttcctttgtcagcttgagaaagtttccttctatttctaattggttgaaagtttttattatgaatggatgttgagttttgttagatgcattttctgcctctattgagatgactgtgatttttattcttctgctaatatattaattgacttatagttgttaaatcaaccttgcattccaagtataaaatccagtcgttctataaaatcctttttatatgtactgaattcatttagctaatgctacagtttgaataatgtcacccaaagtttatgtgttggaaacttaatccccattctaacggtgttgagaggtgggacctttaagaagtaattaggtcatggaggcatcattctcatgaaaggattcaggccattatcacttgagtgggttagttataaaaaggatgagttcggcctgatttcttctctgtctctggcttgcttctgccttctgatgtggggtggtctcctccagctgccggtgtcatgctcttagacttcccagcctccagaactgtgagctaaataaatatctgttctttataaattacccagtcttgggtattctgttatagcagcacaaaatacactaagacagctaatattttgttgggaaattgtttgtagttttcttgttttgtgtgatgtctttggttttggtaacaggaaaatactggactcatagaatgagttaggaagtttccttctcttcaagatttctattatttattctttacatatttcatataatttaccagtgaagccatctgagttctttgtggggagcttttgttttgttttgttttttgaattttgagattgtttcatttgaaggtcaccttaatgctcttaaattcaaaaatatgctaatttaaataccaaatcctattaatctaaaacacacattgcaaacatacaaatatctcttctcttcacatgtcagtgcccattcatgtcatggtttggaaatggggacagtagattccccttgagctgcaagtcagcatatgtttctttatagttaactttagcaaaatttatacaaaatagtaattaacaataatcttctttatttgttaactcaaaagaaaataccttcaaaactgcattttaagtttctgtactaaaatacagaaaaactacacaaatattgaaaagttgaaagttctttaatttttttattcctgttatcactaccacaatttacagggcaatatacttgatgtaatgaaaaagaaacagacaaagctacaacagataaaagagctcaggaatgtacgtctaatcgacactatattgcattcattaatagctgcacttttgcaaactgtggctatgatagtcctgcacaagaagggttttctgtttaagctgcaataacttttctgaccatggatcaccattccttctgtggcagatttttacagttcctctaatgcatttgggatgactatctcaaataacctgcaacttttgtgacaactccttgttctttctcctgctaagaattgtagcccctctctgctgtttttagaaccttctgctaccatatccgtcacgtctaccgccagatccgtaaccaccaccaccacaggaactccccgagcttcttccaccaaaactgcaccctttaatgggttcataatttgattgtttttgtctgctaaaatttccagaatcattatagttcccaccaccaccatagttaccactgccaaaatttcctccttcattgtaaccatcatatccttcaccactatccccatacccgccattgtggttttcatatcctggttcaccatctccatagcccccactactgctgtaggcaggcccaccaccattgttgcccaccgtcacctccacatccattatatccaccattacaccctccataaccacctctgctgccaccacctctacttctaccaccagagcctcctcttccaccaaagtttccaccacagccaaaattacttgcaccacttccagagtttcctccacaacccataaagttgtcagatccacctccatcacctctgtgatcctgcagactgcatctcttgtttagaaagggcctttttcactttacagttgtgcttgttaatagtgtggtgtttctaaacaacagttttatcaattgtatcatgatcatcaaaagttaaaagtgcacattctctctttttccactctgtcatccataacttgtatggtttcagtcttgctatagttttcagagtaatttctgaaactgtatctactttaataccaccagcaaaaatgttcttcactgttaggtgggcaccaggctttacagaatcctctctagaaacaactgtctttggttccactccacacccatcaaccttgtgtggtcaagcacacattgctgtgtccacctcttcaacacaagagaaagccataaaaccaaagcccctggaatgtttgcttggggttctgtcattaccacacaatctgtgagtgtgccccctttctcaaaatgttctcttaacccatcatctgtagttttaaagctcagaccaccaataaacaattttctcagccgcgctggattcctttggatcatggccttcctcctcttggcggcagtggcaatgacaacggccagagtcagcctaggggcaaccgggtagtggttttacctccattttaagactagacttgcctcctccaactcaagttcaacatggaactgtgaggaagaggctgtgggaagctttttaatactaattcaatttttttcttttttttggatacggggtctcactctgttgcccaggctggagtgtagtggtgtgatcttgactcactgcaacctctgtctcccgggttcaagccattctcctgcctcagcctcccaagcagctgggatgacaggcgcccgccaccacacccggcaaacttttgtatttttagtggagacgggatttcaccatattggctaggttggtctcgaactcctgacctcaagtgatccacccaccttggcctcccaaagtgctgggattacaggcgtgagccactgcaccgggcccaatttttaagctaataaatctggtcagttttaaaatttcttattgaatcagttttagtaatatgtctttataagaatttgttccttttgtctaattttttagtataacattgattattattcccttataataatatttttgagatctgttctttatttctgatttggggattttgtatcttccctttttcttggtcagtctaggtaaaggcttatggattttatctttttaagatcccagcttttagttagttttattgattttctccattattctcatttaattaatttctgctctgatctttattattccattccttcttcttactttggctgtaattcacttttcattttcttgtttcttaaggtggaagcttagatgattgatttgaaacctcttttctaatataggcatttaaagctatacatttcctgctaagcagttttttagcttcacaccataaattgcgatgtgttatgattttgttttcatttagtttaaatatattctaatgtctttcatgattgtttctttgactcttgggttatttaaatgtgttcttaaattccaaatattgaagatttcccaatttcttcctgttgttgatttttaattctgttatgattggagatcatactttgagtggcttcagtccgtctgaatttattcagacttgttcttatgtggtctcacatatagtctgttctgccagttgttctctatggccttaaaaagtacatgtattcacctgttactaggacaagtgtgctggaaatgtcagggcaatttggttgatagtttgttcaaatctgtcttttgactttctatctagttgttttccgtgacgttttgagtattgaaagttattcaccttgagaccttgtgtgctagtgagacctttatgattttggtctcacctagctaaaccagcttgggtcatgagatcctagtgaatttttacagggtgacactaaagaaaacactgtcaattcaggtaatagagtatatgttaaataaaagtcttcaggtattggcattttaggaaaaataaacttagctatgtgtgctgcaagactgtatgtgtttctgaatcctctgcttcgagggaaaaatcatattagtagaggataagtttactcagtactggaaaaattgtgtagattttaggaacttgttggagcagaaaggcgattaattgtgagaaatgaaagtcaattttagtggcagcaggtatatcaagtacatcaagtcttagttcaatgtttatagattttgaaaatttataggttcattattcctttcatttgtttcttcttttgtcccatttttgtcaagcatgtatttattttgtttgaatccttttttgtctcatggactgagaagaaaatataactaaggttggattatcccacaatttgctctgtgtctaattattctgaggtggattgtaatgaagccagcaagacttatacattggaattttaaatgtatgggattgtaaggagggtagaagctacaaaccaaagataagatatgcctgcagatctgcttcagatttcctgagggcagtagatgaaattatttctaagggcctttttcaccactgctctttaagtatatgagtaataaacaaaaagaacaaagtatgtggttcagaaggaataaaacaaaaaagaaagaaaaggatcaatgaaatagaagtattgtgtcaccccatgaaaattgtcttcctgttgagagctcactagaaatagaaacaattgttttttatctccttgtatgacaatctcttaactgtttcgagatgatttacttgcttcttaggcttccattaaaaataagcacatgcttatatgggggaaaatgcaaatagtaatataatagcatataaagttaaaaagtggacatctccttctttattgtctccctccctttgaaactctgcccatacccacattctgtgtcttcataggaataaccctgttcatccctactgatgccctgtattgtgatcaagatggttaattgttttagggtataataaattggggatatagtcagagacagtacattttgggagaaccctccattcccagtggcatcaagcagcttgatcaaagaaaagaaaaaggtgtacaccaagatgagatgaggcatacttagtaagcaataataaaacgtcaagatgtcttcatgcatataatcatgacaatgttggatgtgatatctcatccctgtacatctgcatatatatcttatatagcatgttattctttctgcatttcccccttcaatagagctttattgtaaccatttccatctctgtaaaattaagggagggaggggataaaagagagttctagactgtctactcccctaagtggcagccagtgctaaatacacagcttatgggtttaaactgaacgaacaacaaaaagacatgttcattccttaggcttttagaggaataaaccagtgaggcctacaccatttattcatccattcaacaattatttgttgaatgcctactgtgtgccagtcataccaagatacagacagtaaacaaataagaaaatatatgtcaaatggtgataagcatttgtgttagtgtcctagtgctgcagtaatggagttccacaaactgagtgccttaaagcagtggaagtttatccttgcagttctggagactaaagtccaaaatcacaggactgcttccttctgagaggtatgggggagaatctgttcaatgctctcttgtagcctttggtgacagctggcaattcttgcatcccttgacttatagatccattactgtaatctctccttctctcttaacaggggagttcttgtatgtctgtatccaagtttgcctcttcttataaggatgtcagtcctattggattagggcctttcctagtgacctcatcttaatttgatcacacatctgcaaggactctctttccaagtaaggtcacgttgtgaggttttggtaaggacaggaatgtgggggcggggtggggatactattcagcccatgacagcactatagagaaaagttaaagcaggatagtgggatagggaatgctgggttgagatgggcttataattttatgtagaggatcagggaagtcctcactgttgaactgagaattgaggatagtgagagagagaacctagtggatatctgggaggagagctttgcagacagagggagcagcatgttcttgagaagctcaagatgactatgcttggctagaagcatcagggaggtccgtgtgactggagcaaagaaagtaggagctgagaagtcagagagctggctggggtacatatcacataaggcctcctagaccttttgcttttctctgagtgaaatgtgaaaccattgaagagtttgaagtagcgaatgatctggttttatatttcataccatgttgaggaaaagggcaaggttgaggtaggcagatgagttagaaggcttcggcgttaatccacgtgaccggaggtagtaagaagaggtccgatttttgatctgttttgaaagtagaattgtcaagttttgctgatcatttgaatgtagagtgtgtgagagagaaaaagtttaaaaataactcccaagatttttagtctgagcaactggacgaattgccatttgctgagaaggagaagatggtcatgcaggtctggacttcaggaaaaaggtctgagttgtatgtataaatcgtggagaaggagccatagagactttaagacatgagactggaagagatccttgagtaacggagaggcatgggatctagggcacaggtggaaggggtaacttagataacacacagacagttcagcaaaggcaataggatggaaggcagactatatgggtgcagatgcaggtaggtgactactttgaagaataattcgtggaggggccgggtacagtggttcacgcctgtaatcccagcactttgggaggccaaggcgggtggatcacttgaagccaggaattcaagaccagcctagccaacatggcaaaaccccatctctactaaaaatacaaaaatcagtcgtgcatgatggcttgggcctgtagtcccagctactcaggaggctgaggcacaagaattgcttgaacctgggaggcgggaggttgcagtgagctgtgatcatgccagtgcactccagcctgggcaacagagcaagactctgtcttaaaaagaattcctggaggaggttggcataacctggtccattatggtaaaggtggataggagagggcccaaagaagggcattctaaggaaggcaaccacctaagtgatggcgtgtcctgatgttattaatgggactttctccagaaataagcagtgttgttaactgttgttttgccccttgagtatctttttttttttttttccgagatggagtttcgctgtcgttgcccgggctggagtgcaatggcgcgatctcggctcactgcaacctctacttcccaggttcaaacaattctcctgtctcagccttcctgagtagctgggattacaggcatgcaccaccacacccagctaattttgtatttttagtagagacggggtttctctgtattggtcaggctggtctcgaactcccgacctcagatcatccacccgcctcggcctcccaaagtgctgggaatacaggcacgaaccactgcgcccggccttgagtttcttcattggcatttctgacaactttgtatccatttctcttctgctttctaatcatcttctaatttacttctcaggtctgtcttttcctttccatcttatcactatccgaattcaggctttcattattttatcattggacagttccagcatccttcattaataaccttcaaagttctccttcattcctgcccatatgtttgtacagatttaagttcttatagcacagattttattctgggtcagcccttattaattactcccattcagtcccccattcaaggcttgccacaatctggtcccattctgccactcccgacccattcttatacagattccctctgtgaaccttgtattcaaaccatgttcctgctaatgcccttgcagcatcggctttctaaagctgattaactcttttaaaaaaatggccattcttatctttacccccaaatcctactctaaagagatgcttgtgatttgagaaccggtatatctttggatcccaatgccgcccgtagttttattgtagtatgactcattagatactgctgctgctttaccatcagtgagacaaaatgacctccatctggcttttttggttttcattgcgactttaataaaacagtgcttgggagtaataagaatttgaatttttgaattgtagcagatttacttctctggttctttggatcaattcctaagtcttagccccatcaaagaagaagtgcagaatctaacgtgtctgtattttgacctctagaatactgtaaaactttcttcataaaattagaaaggatagaggggggaaaatgaaaagaaaaagaagaatctgagaggtccctaaggaaaaataccgtataaaccaaggcattatttatcagtttttagaaggagttatcacatagaatgtggtctttctaaaatttctggtacctaatatttcctttcaaaaaagactcaaattcttgaggcatcctagaagacttgtgtgctgcctcccccttgtccaccctccccaaaagcacattcaacaatggctgcctgtttctctccttggtgaggagtctgactcatcattcactctgtcttttcaactgatacctgcgtttcagttccattcaattaccaacttttaattggatcccattgccagattgattttgtgttcctgttccctcttggctgcactgttactatgactacttggtatcttctacttacttcctatattagtttgatgacatctagtcaggtatgaagctagatagatactataaaattgctacagtaccaatcactattatcttacatttttcctttcccctactgctcatttggaatggaatcaagcatggtgataaggttcttaattcttctctatcaattttagtaagcattggcaagttttagaattctaggaccttggaaaattgtggagaccctcttcctctgccctccctagtcttcaccccccaccacaacacattctttcaggcatatggcatatatatttcctaaaaagctgaaagatatcatttcctcatttaattagaaagtcttcctttagtttctttcttatgttagcataatgtctcaatattctactttaagtgtactccgttgtagaattggggaaaattagttacactaggcagtgcatgttctttggtctttagttaactgctgtatgccctataaatattaattgatgaccttcaggctttatgggatatgtttagtggttttttaatggttaaactgaatatttttaataaaaaattacaagaccatagaatgccacagaaccattccacttaccaggaaacttaaaatttgccagctgacctgggaacagatctggtcatatacccaagctatttaagaagaggaatattattcatcagaataaaaatgttatatcataatgctctcttacataaaatgagcttacagccagtgggctaactggatatcatttttctggtttcttgttagctcccactaccatatttgttacacagagtgaactaaggccaagagaccttccatatcattcttcctgtggctacaaactaggattcacagctagctcaaataaaaacagaaataaaaggagagagatctcatagtctgcaggaatggattctgacaataaagaccttgcatttactctgttccttgtgcctggggtttttaatttaacacatcaatgaaaaggcaccatttaaaaaaggggggaaacacccagcaggacttacttttattagtgcaatttgtaagaaattactgcacttaatgagaaaatcattaagcatgaaaaaatgggctctgactgaacttgtggaacttaaatggtgaggttttaattgagttttttagttattggtaagaataataataataatttaaaaatacaggactgcatctgtgtgttgaggtggtcagcactttgcatatcttagtccaatttcctgtgccactggtcatgcataatattatggctgtggtgttctctctgtcgtatctactgatttttctgttctgaaagggaagcagggaacttcttttttgttagattgaggaagtttggggcaaagagctagcagaacagtttctagaaggtggaagaactgtaggctaaggcaaagagcagagctatgtctgcttctcagtccagctgcttaaaaaagatgacaaatttcaatgtcattttcaggttactcaagcttatgcttttttcctagttctctgtttcttttgttgccatccagtgatttatttttcctcaataagaatatttcattaaagaccatgcaactagaaaacaagaataccaagagcaaagagcactcttcagtccgaactcttttagaagtggaagcagaaagaagggtgtttaagaaataagtcagcactgtgtgtgtgtgtgtgtgtgtgtgtgtgtgtgtgtgtgtgtgatttagagaaaaaatatttaagataccttctttttgtacttaaaatttcataagtacgtttgacttctgagaggaccagaatgccatgggaagtgctcagttgcatccagtacctgttgtttattgtcatggtccacacggttgcatgtcacaaccgtgttagaactgaaggaaaggaaatgtatgtaactctaaagacgtttcaagtagaagtgaaaacaatatttttttacataatttgttttttatagaaatacagcttttatcaaatgtctgggagaagctttaaatatgcttttgaacttcttcagtaacttttaattgaatttcattgtatcctacctcactagaaagaaagaaacctgcaaattttagcttcccttataatttaaatgatgccttgctaatttctgtgtttttgagatggagtctcaccctgtcacccaggctggagtgcagtggtgagatcttggcccactgcaacttctgcctcccaggctcagatgattctcctgcctccgcctcagcctcctgagtagctgggattacaggcatatgctaccacacccagctaacttttgtatttttagtagacggggtttcgccatattggccaggctggtcttgaactcctgacctcaggtgatccgcccgtctcggcctcccaaagtgctgtgattacaggcttgagccgctgggcccagcctgatgccttgcatttctgtctcctggaaatacccaattcttaaaagaggccatccccttgtgagttcataacacactgtgcccttagatcccctcctcaccctcccttcttctgtatgccctgcatctgagggaggtgtgggcagagctggctcttgtaggttgcatttcccaggctcctgtgtctaaagacttcctactgggttcggcatgagagatactggtgggaagtagggagggagaaaccggtgtatctcttcttccctttctatgttgggtagcatctttggtcctcagtgtcttcagctcccataggacagatccctgaactctatttatacccttttctttttcctgagtaccaagggatgctaagggtttcttgctgttaccaatcccggggttacagcaccattctcagttggctttaacacacttcgtaacctgcaaaacaatttcctgtcttaagtctcctgtgttaaatatttggagtggtttatattccttgtgttggtccctgactgatacacacaccgcctctacccacaatggccaatttatatccgatagtaaagaggcataaagaaagcccgcttttgatacgtttcttaaattgcctctgttaaaacagactttcttatcaggcaaatatcttttataagtttctggcttaaacaatgattataatttacaggtggatttaatttatggtagactggactgcttgcctagacttttatttgctgatgggcattactcctttttattctcttaataatgaattacctgaccttatacttattttgatttaagtgcttgatttttattgtcacttttaattttgtgttataaagatgcaattgtcattggctacataaatttgtttttttcttttctttttcttttttttttttgagatggaatctcactctgttgcccaggttggagtgcagtggcatgatctcggctcactgcaccctccacctcctgggttcaagtggtttctggctaatttttgtatttttagtagagacagggtttcacaatgttggccaggctggtctcgaactcctgacctcaagtgatccgtcctccttggcctcccaaggtgctagggttacaggcgtgagccattgcgactggccataaatttgttcttaacatttaaaatttatttaactgctgacatttgcaaaatgtacagcatttcaataagtaacatttacatgaggcattgagaaagtgagaagaattaaattgggaaatatcctaaatgatggctgagttcagccaaatcatttgaggtgtcttcacagtcttttatatataatgtgtgacagatgagggaacctactgctttttgggctctgtcagatggaggagaaaatcccacaataaatgacttcctttcactttgttggaaacatctttgcaaagaacagaggtagtgagtaaatgtaaagtcagaggcagacatgcacatggccctgggtgttttgaccttggtgactgtgcaatgagaggggaggtgtagtccattttataggactttgggtggtgttgaatgtattcagtagagaagcagaatgtgtatttcagattaaacaagaaaacttcgccattttcctcttctgtaacatttctaaatctggataacattttgaatatgatactgaagtattgtattgagattaattttgggtgtcaacatctgtactcatttaagatactgggttagtatatgatgcccatatctaaaggttttgcattttctaaaacctcaaaatccaaaacagacatttgaagtaatcctggaaataaatgacagccatttgcctgacttagtatcctaagatggatggcccttccaatggccattttttattttagctactaatgagtattattgagtcactaactaatttcgaaaagcattttggtgaattataattggggctgtgatttactgagtttgaagactgataagccattcctcagccctgtaattaatgtagaagcagagaaaagcaccctgatgatcagcatttcctttatgtggggcaggggagtcaaaagcatattccagccaaatattatagaatattattttttcagccatttctgcattttacttttattaaaaatggcagggaaatgtgaagtgccacaaaactttggaaaggaagtctcttgtttacatcccttttgatactcagtatattcaagcgtcatccatcacagctattccctggtgttaaatggttcgttatagtcagtgaaccacaaaagtagtctgggtagagggacagaatttagaatcatggaccagatttacaagccacgtaactgagtattcctagaaggccaaaatctggttgtttgtattctttgggtttattggaagtttggatatgtttatccatctgtgtttctgaaccctctggaggaaagagcacaacagtctaacatgtaaataagaaaaactaaatccacataggcccacagatacattaggacttcatttttttttttacaaagaaactgggtattgagactcctgctacttccttttacaaagaatttatggtagactggactgccttctttcctgtatcgttgcaaatggattgttggcttgggtatttatttttgtttcttttgaatatttttctctgtaagatagcaactgtgtgtgtgtgtgtgtgtgtgtgtgtgtgtgtgtgtgtgtgtgtgtgtgtgtgttctatcatatttcaggataaaatgagtcaggaagctggttgttttggttttttgttttgctttgttttttcgcaaagcaatttagtacctgtgtagttgtttcatgggctcccagctcttaggattccctacgtttctatccttaattgcctatgctctttttactcttttccgtgtagtctttatgcagtagtttggacacagcagacaactctttcctttaaataatctcttctcttagtatctgtgatgccatgaactcctgacacacacacacacacacacacacacacacacacactctctctctctctctctctctctctctctctctctctctccccgtctccctgtctctccctctctctctctctgactaatccttcttagcctccttcttcagctccctttccactatccaaccgctaaaatttcttctttcttctacactttctaaggagccacgctgtacccctacctcaggactctcacacacactttctcttcttggaactccctttcctccagccatttgctgtctaatcctcactcttttttcttcccctatttctgtccatgtatgaggccatttgcttttctccaaacacagcttgtgctttcttcttcatacttaggctaattgtgtttcctgctgtgtaattgccaaattctgtttttcattgcctagctaaaaagccatgttgatttgtgaagctttctgtaatcaccaaagattttttaaaaattcaaaccaattaatatatttccttaaaactcatagccctcttcacattatttcccagtgttaattttatgtatatgcattatattccctattcaactgcaaactcctcaaaggcaagggccttgtcttcaacttaattctgtctcccacagaacataacatagtatcttctacatagtagttgcacaataagtatatactatcaaacaaagagaaacatttatattatagcttcctaagatttcctattctcatttcaaaagaaatggagaatttagagtctctaggattattgcccttggcctgtaaaggtttttatttgtgcccaaatatgtaacctcgagtgaactttgtatcagatgatctgggaaagtacaccgctttctgttatcaaacatttctgttactttgcttttcaagctgaaaaggggagataacttctgtttgctttgagcttttgttgatggttttctgctctgcctactaatcagggttgtattatttaccttgtttaaaaaggttcatctgaacattctctctctattttgaattgtaattggatattaattcactgctgcgggatacgttggtaaagatttttgaaattgcagggaaatgtttctttaatccctcaagtttgttaagtgctttcttataatggagatcataatctccgagttggtagaagggatgaaacggttactggggatatttttcccttgttagaaaattgctgtattaaaaaatacttcatccagttttttaatcctttccacatgctgtatggtccttaggaaataagtagattcttagcaccgatttcatgtttttaataaggaaggcattgagtaatgttcaggtcactgtgattcacagagttagtggcctggggcctttattggtaaagcttgaaagtagttttctttagcattgtgcatacacaggtagctgctagaatgctcacaggaggctgtgatttggggaaacaggcagtcatagaatatcttgaacattcagcataaattgccaaacagccacagctagtgaatggtttcaggggacaagggagaggagcctttaggcatgattacccacatctccctgatttgttcttccacacacagatcttaagggtcagttttgatctgcacagcattaagtttcctcatgacttttagatttcctttttcctctgctttttattcatactgaagaattttttgtttctttgtaaggtgtaatctactttggaaatgataacactatgaatgcattttctctttctgtagcatttatgacattgcttgctgacagttactgtttattaagtatttgtggcttttggagtagtgagcaatagggagaatattcaggtccagctaagggcataaggtagatagcaatgatttctcattcgaaagggatattttgttaagactagggctgatcttttctaatttaaccttggattggtagaagatggggtgtccctggctcattatttttcactgcccagcactgttcgacaattatcctgagtagaattaggggagggactagaggatctgttttctgtgaatacaataggaaaggcagttttgaattatccaaatggcccctaaattctgggggaaaataaaataacaacaacagcagttttaaaaataactacaacctaggttctgacatcccaaaaaggaatatttcaactataattctcagcattttagaaattaatttcttgacaaatatcaataggtatcattcagactttgcaaatacagagttttgaaatcagaattttgcatctcatctctcccctaaaagaagtatggcaattgtgcttgctgaccatgaggcttgtgaactataatacatacttataggcacaaacacagaagcataccctctctcaggcatcactcaaatctaagaaaatttgttgtcttatgttttagcgagtaaccagctcataaatcacatcgaacagtttttggatactaatgaaacaccgtattttatgaagagcatagactgcatccgagccttccgggaagaagccattaaggtaatgctatcctagcatctcttttcttcctaaacagttggcgactatcacagggaaagaggcatacagcatcctggaaatgagtctgggccgtggaaattatcattctcaatatgaatagcagtgtatgccagtggagctaaaaatgacttaaattcatgttactatcactgtcatttctgagatgggataaagatgagtaggtagggtgttttatccctgaaagttggctttttattgtactgaagacctggcctttgctttctgttcctatttagggaaccaaggaaatttccattataacctctggtggcccactcactattgtaaaggatgggctattttagggaaatggatgggaaatatatattggtataattattgagaaagattttatgaagacaggagtagggatctaaatgtcagaaaaaaaagaacactgacaataagttcctcccatgccttttgtgtgggttttgtctgtttgattgttttattaggaattcttagaaaatatttctaaaacttttccaaattatgtataggcttttatatctctaggtaagaagtgagcaagtttaaattagaaagcatattttttaagtgggcacagttgtagtatatgttcttgtgtgggtgcttattaaatacttggcgaacgtatgaatgaattaatgcttaaataatttaggtgcttacaaagagtgacaagaaaatggaaaaatcattaaaattagattcaataacagattcagaagtagataacctgaatactcttagataaaagacaaattttagaaaagtagagtcaggacaagactgcagatgattcagttggatggagaaagatttggttcaatggaaagagatagtaaaagtgtattgcttttttaaagcactacccaggctaggtggagtgtcttataacacctctgtgcatggttgccacccagtgtccttaaaaatactaggtcacattatatctcttaaaaaaaataaaagagagacaagagaagcagaagagacttcagtgacatatcattcagtcttaatggagagattattattttttcttttccttttttttttttcttgagacggactttcactcttgtcgcccaggctggagtgcagtggcggatctcggctcactgcaacctctgcctcccaggctcaagcgattctcctgcctcagcctcccgagtagctggcattacaggcgcatgccaccacgcccagctaatttttgtatttttagtaaagatggggtttcaccatgttggccaggctggtctcgaactcctgaccacaggttattcgcccaccttggcctcccagagtgctgggattacaggggtgagccactgcgcccggccaagggatattttttgaactgtaaaaagattaagttttatggaacaattaggaaaatgagaatactggctagttatttggttctattaagaagttactaattttttatgtggtgttaatggcatgtgagtgtttgttttaaaagactatattttctatatttcatacaagaatattcataaatgaaataatttgactgaaatttgcttcaatataattggagggttatgggagaagaaggtcatagtatagaggaagcaaaattggtttggttgataattatttctttattttattttttatctttgagaaggagttttactcttgtttcccaggctggagtgcagtggcatgatctcggctcactgcaacctccgcctcccgggttcaagcaattctcctgcctcagccttccaagtagctgggaatacatgcgcctgccaccgcatccagctaatttttgtatttttagtagagatggacccatgttggccaggctgatctcgaactcctgacctcaggtgatctgcccagctcagcctcccaaagtgctgggattacaggcatgagtcaacatgctcggcctgagttgataattattgaagctgggttatgagtgtgcgagcactcactaaattgttctctgtttttgtttgggattttctacattaaatgttaaaaacaaagggctaggccaccgcagaaaaactgactctgggaagctctgtgccttccacagatggaaggatttctggtccccagtgaacacacctcagtttggaatgccagcttcccatgtaccaaagaagaacattttatttttttgtaataaataaggtgattcagaccaaactttgtttggtctggggtgaatttgtttttgtgtttgctctgacttgctgcctcctctaccccaacttgctaccacagttttcagaagagcagcgctttaacaacttcctgaaagcccttcaagagaaagtggaaattaaacaattaaatcatttctgggaaattgttgtccagggtaagttgtcatttgcctttttttttaaaaagtatttttaaaatacttatgctattttattctaaatatacatataaattctaaatataaactgtattgtataatgagttatgtgggaaacatgatgactttctacatggctttgggaaatgctcagtgttcggtgaactcaaactctcccttaataagcataaatacagagtgataaataataaataaacatgtaagttccatcttagactctttacgcagcatgacctatttcatggctgtgcctttctgtttgttgaatggagcagctgtgtgggcgaacattgtcccctttctcagatccttaggccatttcagtcctgctggttccacagccctttggttgacctcacccaggttttatctccctgctacttttcatttaccatgttcttggactttccgtttcaacagaccagcatcttcatgtaccaaaaccattcagttcttcacttgcacagcaaccaatgcaagttaaacccagaaagaagacagcacacattctttcagtgttaggcttgatctttgctttttttcatgccctttgccccaccttttttaaaacatgacctgattttcttttagaacccaagtataagatattacttgtttaaaatacatattatgaaaatgattatgtttatgagataaacttttcacttatactagagatgcaaaatttgtttcaatctctttctgtgtgaattctatataaaaagaattgcatacctatctatccgccttctaatgggcaactcttcatcacacaggtaactgttttcctgacagttaatttttcagccctttaacttctgcactggagaacaaaaggaattggaatgggtagtgaagggggcttactcaaatcacttttgtgtctctgctgttgaccccgtaaatgaaggagattggttttggtatttattgaatgcctatagcgtattatttgctgaaaagaaacttacaggtcatatgcaaaatccatattttctgatagcttatatgccactgagagaatacagatgaccaaggccattcataggtacacatgggtgttaaatacatgtgctttttgaacagtttatcaggtatcagccatttgatgtaggaaaataggaagaagagcaaactaaagagtagattttctacccttgatttgctcttactgagctaaaattgattaactgtcctaaatgatagacatgccccttggtgaagaccatgttttcttcctccctagtcctctggccactctatcaatagccagtaacatggccacaagacaaaatgcatggcgtagttccatattgggcaccggatgtcttggacaaaagcatacagtcatttaattatcatttatttattgagcttctgctatgttctacagtaagtcctctcttaacgtccataggttcttgaaaattgtgactttaagcaaaatgacacataatgaaaccatttttttctcatcagtgttataatgaaacaatattatttaagtacctacttttgtttcacttaaagtcacagtttccaacaacctattgatgatagttaagtaaggacatactgtacattgaggggaatataaagacttataagacttagtgtctgcccttgagaaaatatattcttaggagagagaacatgtgtacaaatagttacataaaatacgacaagagccatttcaaaggaataaacaaagtgatctgagatttctaaagaaggggagacttatctagagttgatcaaggaaggcttcatggaacacgtggcatttgacatgcggcctttattgcttattacacaggcaaaaactggagaaaagataatttaagatggtcattgttaattggttgcctttatagttttatattttttgtagaacagagcacctttatagttttaaaaatctccagctcaggctgggcacagtggcgcatgcttgtaatcccagcactttgggaggccgagacgggaggatcacttgagcccaggagtctgagaccagcctgggcaacatagtgggaccctgtctctatttaaaaaaaagaaatcttcagctcaaaggtgggaggaggtgtgatggaaacgaaaatgggattggggttgattctttgtgttttgattttactctctgaattactttttagatggaattactctgatcaccaaagaggaagcctctggaagttctgtcacagctgaggaagccaaaaaggtattgaggggtaaacctttgtctttagttgaattattatagtggactttattttcttgataccctcgaagaagttaaattttatgggtaactaaattagtgtactcattttgtattcaatatgtaaattgcttcaaccacagcatccccatgggagaaattataatcttactcagtttcctgtaggctgtggttatatttctggaactcacctgtaatcccagcttcagtacccctagagcatgctgttgaaccccatagtgcgcaaacttagcctcggccctggtaaaggctatgaaatccacagtgattcccaccctggccacacattagttacttggtgagcttgtttttcttttttttcttttcttttcttttcttttcttttcttttcttttcttttctctttcttttctctctctctctgtttctttctttcttttttttttttgttaatactgattaaaaatcagaattaccctagagattctgttagtctgagatgggtcctgggcacagttggtttgtttgcattttaaaacccctcaggtgattgtattgtatagtgaatagagaaacactagtattctagcataagggacatccaagtattttcagtaaaagaccccatgcagtccccatgagcttcttattcacacacattgttaggcctaggcctccttgtttggtgtgtattgaatctgattcagccatgagtcagatacatgtggttatttagttcagtagtccttcattgtacctcaaggttgtgatgaaattttaatgaattaagttgaatagctcaaaagtatatacttcgtaacactcagtttcagttacagtcactgactgatgtagttctgctggcacctgacagctctcagttactaagcttctgcgatatgctaggcactgtgctggatgataagacagcacccctgccctctagaagctcgggcagttaaaatggagcagagggaagcaacggagactcagaaaataactatacacactaagggagagcttggtctggggctggtgaataggaatctgttagggaagtgacagatgcaaagctggaaatgttaatcagatggctaaattcaggccaaaatttaaatatcttcaattttcaactcaagaaaggcatttggcagaaaccatgtttggaaaagaaattaaaatttacaagaatttttattaagcactttgcctagcaaaagatttttgttaaaaaaaaaaaaaaaacttgtcatccctactttcagggagtagaatcctggaatttttgaagcatactgtaagatggtgattatatctcagaaggggttccgtggtgtctgtaccctctctgccacaggcaatactgagcaccataggcttgagtatgccatttaactgtttggttttgtttctgtttgtcactttatacaatgtttgataatatctcctcattgaactgggctatttcagtcaaggttctccagagaaacagaaccaagagaacgtacatgtgtgcgtgtgtctgtgtgtgtgtatgcacatacacacacacatatatatagagagagagatttattggctgaatttcagaaattggcttgtgtgattgtagggcttggcaagtctgaaatttgtaggacaggctagcaggctggaaactcaggcaggatttctgtgttacagtcctgaagcagaaacctcagcttttgctcttaaggtcttcacttgattggatgagatctacgaatattactaagattaatctttacttaaaatcaggtaattttagatgttaatcacatctacaaaataccctcacagcaacatctagagtagtgtttgatggaacaactggggaccatagcccagccaagttgacacataatattcattgtcacatggtgtgaagacctatcaatcaatttttgttaaacaagtaaatcaggaaaaatattttttgtcattattacattaagaaaatttattatccaggtgacagtacatactagagtttttggaagaagtgaggagccatgacctaaaaaagcttgtgtttcctgccagcagcacatcttaaccaaagatgttccagctaagttaacccagaatattagacaggaaagaaatctgaaaacagatgatgcacttgcaaattgtgcaaggcttgttctgtaatgcaaataggatgtcttctttgaaatgtaaaggcactgagcctaagcatgaggaattttaatgtctaatgatgaagctatagagagaaatttcagttaatgaccaggtaggtataagatggtgtccttagataattctgatatcagaactgatgttagttgtagtttaagacaactctcctgagacaggagaaccgcttgaacccgggaggcagaggttggggtgagccgagatcgcgccattgcactccagcctggacaacgaaagcgaaactctgtcccaggaaaaaaaaaaaaaaaaaaaagacaactctcaaaacttcaccatctttgaatagagagaacatcataaaaaacaagtggagagaatctcttctacttcagccacgggttgcctggctctgactggcatcttcttccttttagagcatagtgtttccatagtcaaggcacagagagtgtgcttccagtactaccagcaaaactgaacttcactgtcatggcagataagaagttaggaaattcaacataaaatgtattgagtaccaccagctctatgccaggcactttgatatatattatctcatagcctccaaaaaaagtacattgcacattcacctagcagactctttcacatctagaaaatgccatttcctttttttccccacatttatcagtgctttagccaatgtagtatgtataccagatatttagataacactttgactgctaaagaaccattcacattgtatggtgtttgtctacaacactatatacatcatatctagataatggtagaaaataagagtagtagaattttacttgtatccaactcccgaaccaaagagcccagtattatctctgtaatcttcacaatgatctgctaagaattggcaagagcaggaactaccatccctgttaccactgggaagccaatccccagaaaggtaaagtggggttacactttgagctcaccgaggtagcaagaggattaaaatgcacgttcctttgcaccacaccagaccttcgttttcaagtggattaagttttgtgaatggaatcttggaccaatcatttctaaaatacagtactccctgtctgcttcatctcaacaaatgactttctggcctagagccaggtggtggttagaataacctggaagtcatagagtagaccctgtaattttgactcaccttcagtgtacgctgtgttatatctgtcagttctcattagtatagtggtgagtacccccacctgtcactgtatcatgcctgactgtgagattatgcttttgtgtctgctttaatatcacatgaaccctttattttgttttccagagtgaaaacttgatcctttgtatgaaaaatgcttttatttatttatttatttatttatttatttatttatttagagacagagtctccctctgttgcccaagctggagtgtagtggcacggtctcagctcactgcaacctctgcctcccaggttcaagcagttgtgcctcagcctcccgagtagctgggattacaagtgcgcaccaccccacccagctaatttttgtatttttagtagagatggggttttaccatgttggcaaggctgttctcaaactcctgacctcaagtggtccgcccaccttggcttcccaaagtgctgggattgcaggcgtgtaatcccagccatgcctggcctgaaaatgcttttaaatggcatctgttgatttttggagagaagtgtagaagggagagtgtacatgtaaatgataatggggagaattgcagaggaagattctggctcaaggaagctgatttcttttggttttaatagaagagacatgctttagctatttctcttagccaagtgagagaagtattatcacttttgaccatgcactgaaatattcatttatattgccttcaaatgttcaatttggtcacttcccaaataatcatttaaggaaacttgactataatcactgaggttaaagaacaatcctcacagtctatttaaattcttttgaggtgtttcccataagttatttaaagttagcaagctgtcaaattcttgctattaaatgttgacatttgaaaggaaataattatccagggatgttcattttaaatgaaaattataactttacatttgtataacatcttaagagctattaccctccagtttttctagaaatatgtggattgtatgattctttgagaaatagaaggaagtcagctctgctacagaaatagaaagtttttgcatggcgtgagtttagacagtcactttcttttaagtttcctggtacctctcatttcattttgaaacctaggcataaatcattctttaatgttcatttttattatcattataacctgtcagttcttccactttttctgtttctagtttatatgattagatatgccattagcatttgatgtttggtagaatctttgtatagcctttgtgtgctcttcatctgtcagttctcctggctctgtagtgggtggaagaggtaaagtgatgtgtctgagagctcacagtaagtcaccggccaggaatctagttctagcactgccctagtccttcattctcctttagtattgagaaagcagtgaagaaagaggatttatccccatggcattgggatcttttttttttttttttttttttttaccagattccaagaggctgagctatatctaaataatcatttgatgtaagctctgtgaaaaaaaaatcattattttagcacttatttttcttgtaactgcctaatttatccttctttattgttgttgacatttatggattttccaccttagtatcacagacattcatagatagcaattggccattttaccaattggtgttggccattttaccaacacccctgtctagagaggtaaagttttctgtgcctcacagcaagctagtggccagcagaattgactggaatccagacccccagatgcccgctgtagtcgccttatcaccacaccatggcaccagctcttcacgccttcaccttataatgccgccaaccacatctacctagagaaaggatgctcatgctccctttttcaagagtacatctggttctgtgtgtgagagtgcacaggaattctccaaagcttagtgaaggattgaagacaaaggttaagaatcatttcttgagagcagttttgtcaaactgctggcccctgttggaacctgtgacatttttctttgcttttttctgctttcattttctgccttaattctctggtgtagtttgctagtacaagaaaagtaataatgaaaatatcacagtgttacccaatatttatttaaggcttgatacatttaagatatgatattaaattttttattgaggtagaacatgtgtacagtaaatgcacagatcttaactgtgcaacttgatgaattcttacacattcatgtacctgggtgctcaccacccagatcaaaataatagaacatttccatcaccacataagcctccctggtaccttcctagtcagaagcccccatcccttgaggtaaccactattctgacttctgtcacttgagagtcatctggcctgtttttgaccttcatataattggaatcatgcctttttttcatcaattatgtgattatagctatgtagtaatcccttttatgattttaccacaatttattcatccattctcctaatgatggacatttgcttgtttgtcctttggcagttatgaataaagatgctgtggatattcttgtacataccacttggtggacatatgttaagtgtattcctaggaattagaacatgaaacttacaataccataatgaattttttcatactttagtttatctgagactcaacaacccctaagataggtatggtaagtagtagtattcacattttgtttttgagcgaaattagttatgaaaaggtcaggtggcttgcgtaaggttcctgagaaactgacagggttatagttgtgttctccacactaggctgcaggatttccctcttgcaccatgttagtgtttatagcatccattaagctacaagtggcattaatgaaacccaaatatatgtcattttaggcaaagtacatgcaaactgacttttattctttttgatgcttttttacacatctagattgtcagtaatcctttggaatcacctgatggtgttggaaacaacccagtggaagtcatgtgtttttactttgggggtcagtaagggtctgagcacaagatgatagtcttttagtcttatggtggtataggactggcagtttctatatagaggttattgatttcattactctgcttgtggccaggattatatttcagtgtacttgaaaagtagtaggttatccatttcataaagttctccaggtaaggaggcacttttatggtaaccccaggtaagtgatggtggtttgaggaagaaggaatatgtcactcacacacatgccctttctatctgttctctactttctcagcatattgcagagggaaagaacacatgagaaaagatgagaattgactcctacccctttctgcagaagagattcggagaatctcttgcttttattgagaaagcaggccagtcattgagttctctgctctatcttgcttccctgtcactgcatgggctagaattacttgcagttacaaacattaatgatgaggagtgatatgtggaagagatcagccttgcctggggcattgggaaggataatggatggcagcccagcttttaaacataatttgcttacacagaaatgtgaagcagatctgtcaggaaaatcagttgcagacgatacttagcacttaatgaaaatgtaggatttttgttgctgctcatttcttcctaggaatttggcctagtctcagagatgtgccatttgtgcttaagtatatataccatggtcatactgtgccaacaataagtccttatctaaggggtcatacaagatgtagtggactacagaaccattaagcctatggagtttttcagatgtttggaagataccagtcatttgtggccctacagagatttatggcaggatgcagctctactgtttattctcttgccccaactggataagtcttatcctgtagccatatagtcctgatatcacgaaaatcatgcaggggttaatgacaatgagtaggagaggagaggtacaacataaaaagtatgataataacccggaaaaccccaaataaaaacccatttgagaatctaggatagagtagtttatttaacctttacagataaatcatatgctagtaaatgtatagattttttattcatttatctgtatttggctgtcagatatctttattcataatcacccagaataaacagaatgaatgaaacagaagcttcatcacaattctgttacagactgtctgcctccattgctgggatttcctctctcttataccattgattctcagtcttgcacatggcccagtttagggtcaacaaagagctatggaaagatccataaatgtccttaaaagaagataaattccttattcgctcagtcataaaagaagttaatgaatagtgaggtggtcttaactgagggaaaaaaagtccaagagagtggttgagtcaacaaacaattatgtccatggtgctgacaaaggcactgcaccttaaggcagacacagcctccactgttatcactttgttacctgtgtgtgtttttgtatatgaggactagaagaacaggcagagctttcttgcttcctgaaacttgccacatgcagcctcatatttcatggttgactttggtttgactttttaaagagacatattttagtttatttataggtcttaggtttcagaggtcatgattgtgtccattgtaccataaaagtaacaggaatgtagagaatggcagctcttaccattttttcatgttgagagtgaggaaagtataattatactttttcctcttgggtggaagcaactacaggagagcataagtgggctggaaggctctctcaccgcgtgcctgctccatgcactctcagcctgaagaatgccagaatgcctctaggggccagtcagttgtggtaccataactgattctctatttactgtttctggcccccaaaggaaaagtagaagtgccccactttccactgccctctctaaaacactcactcctacaggcaggcatgctaccagaaaatcaccttctcgtgttaggatagataggcattgctagatagatatgcattgctagaacccagctcttagaggcagctgccacatgccttgaaggaaaaggctccccactgctatcccttggagggacaggatggaaaaagagtgttcagataattttcaagggcactcacctcactacccttttaaaatctgagtgtcattcctagatcctcacagacttcacttcctggactttgctgtattactatgtatctgcctttcagaagctccagatctagaacagtgatgctgaatggttttctcatccatttctcatctgcctgttttcaaacaatttctaacacaaattgaaagatttccataaaaggaatcaaacaaccttccaagctcactcatttttgcatttcacgtttcttatgagaagtcccccttttactgcttttgtccacagtggaatttaagagtagattattctaagctttttttttttttttttcctgattcttcatcattcaacttgagattattctaatcttgatttgattctcatgctcctttcaaaagagcatactagtttggggtggttggttattttcttaaccttagcaagccagcttatttcctatggaagcagaactggaaacagcagatgtccaccatgcttatacaggacactacacactgtctcgacaagccatgttctttcctccctcttcgtgagcactttctctggtgatgagttagtatggactacttgaacctcaaaactgggcctctcacccaaagccaaatgaagtagcgtatgccaggatgatgtttcttttgggccgttggcagtgagactgctaagcaggctgccttaggttttgctgtggcaatgctagcagattgttccctctttcaaaggggcaaaaatatcattttggtatgataactgactttctatttacagtttctggcccccaaagacaaaccaagtggagacacagcagctgtatttgaagaaggtggtgatgtggacgatttagtaagtacttttaatatgcacctggtgttctatgattgaagtcacctgagctgtaaatacagccacaaaggctgattatcttacacttgttgcttatttgtgttttaatttccaatacaccagaagcttcctacaccattatatattgccattataaattcaatcagataggtaatttcataatagaaattcctgtgtttcatggtgtcggctatattgttcattcagattaatcctctcccttgaagggctgaaaaagagctagggaggctattccattagtagcaaaatgttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagaccgataggcatttgaggatttctggaccccattacaccatgttgttgatgtctgggaagctgtgtagtaaatgtcttttgtatctatccttaatgtttggaaacttcccgcctttaagcttcatatgacaactgaccaacaaacactacgtactatgatgtcaatcttttttagagacattctcattactaaaatgagtggatacttgaatgtttaactcctaaaataatgagcggtgaataaatgagcaagtacatgcatgccttccaatgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaa
